United States Patent 12,569,549 (FLAVIVIRUS VACCINE) - sequence listing, part 58

SEQ ID NO: 20442 - RNA, 9873 nt, synthetic construct
  misc_feature 1..9873: note = derived and/or modified CDS sequence (opt5) from DENV-3__FJ898455__SS-prME
  source 1..9873: mol_type = other RNA
accagcctgtgcctcatgatgatgctgcccgccacccttgctttccacctgacgtccagagacggcgagcctcggatgatcgtggggaagaacgaacgcggaaagtctctcctgtttaagaccgccagcggcattaatatgtgtacccttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgttgggatgggactcgatacaagaacccaaacatggatgagcgctgagggcgcctggcggcaagtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctgcccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaaacttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaattttcacgctgaccgttgcttggagaacagccaccctgatccttgccgtgatctccctgctccctgtctgccaatctagctccatgcgcaaaacagactggctgccgatgaccgtggctgcgatgggcgtgccccctctccccctgtttattttctctcttaaggatacgctgaaacggagaagctggcctctgaacgagggggtcatggccgttggactcgtgtccatcctggcttctagctttcttcgcaatgacgtgcccatggccggccctctggtcgccgggggactcctgattgcttgttatgtgatcacaggcacctccgccgatctcaccgttgaaaaggcggctgacgtgacatgggaggaagaggccgaacagaccggggtcagccataacctgatgattacagtggacgatgacggaacgatgagaatcaaagatgacgagaccgagaacatccttacagttctgctgaagaccgccctcctgattgtgtctggcatcttcccctactccattccggctacacttctggtctggcacacctggcagaaacagacgcaacggagcggcgtgctctgggatgtcccttctccccctgaaacccagaaggccgagctggaagagggggtgtaccgcatcaagcagcagggaatttttggcaaaacacaagttggggtgggagtccataaggagggcgtgttccacaccatgtggcacgttacaagaggggcggtgctcacccataatggaaaacggctggaacccaactgggctaatgtcaagaaagaccttatctcctatggcggcgggtggaagctgagcgcccagtggcagaagggagaggaagtgcaagtgattgccgttgagccgggcaaaaaccctaagaatttccagacaatgcccgggatctttcagacgaccacaggagaaatcggcgctattgccctggatttcaaacctgggacctctggatcccccatcattaaccgcgagggcaaggtcgtgggcctctacgggaatggagtggtcaccaaaaacggcgggtatgtgagcggaatcgctcagacaaatgccgagcccgacggccctacgccggaactggaggaagagatgtttaagaagagaaaccttaccattatggatctgcaccccgggtccggcaaaacacggaagtacctccctgcgatcgttcgcgaagccatcaaaagacggctgcgcaccctcattctggctcccacaagagtggtcgccgctgagatggaggaagcccttaagggactgcctatccggtatcaaaccacggccacaaaaagcgagcataccggcagagaaattgtggacctgatgtgccacgctaccttcacaatgcgcctcctgtctcccgttcgggtgcctaattacaaccttatcgtcatggatgaggcgcattttaccgacccggccagcattgctgccagagggtatatctccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtttggtttgtgccgtctatcaaggccgggaacgacattgcgaactgtctgcgcaaaaatggcaagaaagtcatccagctcagccggaagaccttcgatacggaataccagaagaccaagctgaacgactgggattttgtggtgacaaccgacatttccgagatgggagccaatttcaaggctgatagagtcatcgaccctcgccggtgcctgaaacccgttatcctcacagatggccccgagagagtgattcttgccgggcctatgcccgtgaccgtcgcttctgccgctcagcggcgcggaagagtgggccggaaccctcagaaggaaaatgaccagtacatcttcacagggcaaccgctgaacaatgatgaggaccacgcccactggaccgaagcgaaaatgctgctcgacaacattaatacgcccgagggaatcattcctgccctgtttgaacccgagcgcgaaaagagcgctgccatcgatggcgaatatagacttaaaggggagtcccggaagacattcgttgaactgatgagacgcggcgacctccctgtgtggctggctcataaagtcgccagcgagggaatcaagtacaccgatcggaagtggtgctttgacggcgaaagaaacaatcagattctggaggagaacatggatgtggaaatctggaccaaagagggggaacgcaagaaactccggcccagatggcttgacgcccgcacatattctgatccgctggctctgaaggagttcaaagactttgcggccggacggaagtccattgctctcgatctggttaccgaaatcggcagagtgcctagccaccttgcccatcgcacaagaaatgccctggacaacctcgtcatgctgcacacgtctgagcacgggggacgggcttaccgccatgccgtggaggaactgcccgagaccatggaaacactccttctgctgggcctcatgattctgcttaccggcggggcgatgctgttcctcatctccggaaagggcatcgggaaaacaagcattggactgatctgtgtcgtggcctcctctggcatgctgtggatggctgatgttcctctccagtggattgccagcgctatcgtgcttgagtttttcatgatggtgctgctgattcccgagcctgaaaagcagagaacaccccaggacaatcagctcgcctatgtcgttatcgggattctgacgcttgcggccatcgtggctgccaacgagatgggactgctcgaaaccacaaaacgggatctgggcatgtccaaggagccgggcgtggtcagccctacctcttacctggacgtggacctccaccccgcttccgcctggacactttatgctgttgccaccacggtgatcacacccatgctgcgccataccattgaaaatagcacagcgaacgtctctctggccgctatcgccaaccaggctgtggtcctcatggggctggataaaggatggcctattagcaagatggaccttggcgtgccgctgctcgccctggggtgctactcccaagttaatcccctgaccctcaccgccgcggtgcttctgctggtcacacactacgctatcattggacctggcctccaggccaaggctacgagagaggcccagaaacggaccgccgctgggatcatgaagaaccccacagtggatggaatcatgaccattgacctggatcctgttatctatgactctaaatttgagaagcagcttggccaagtgatgctgctcgtcctgtgtgccgtgcagctgctccttatgagaacaagctgggcgttctgcgaagccctgaccctggctacgggccccattacaaccctctgggaggggtcccctggaaaattttggaataccacaatcgccgtgtctatggctaacattttccgcggcagctacctggccggggcgggacttgccttttccatcatgaaaagcgttggcaccgggaagcggggaacaggctctcagggcgaaacgctgggggagaaatggaagaaaaagctcaatcagctgtccagaaaagagttcgatctgtataagaaaagcggaatcaccgaggtcgaccgcacagaggctaaggaaggcctcaagagaggggaaattacccatcacgccgtgtcccggggatctgctaaacttcaatggttcgtggaacggaacatggtcatcccggagggccgcgttattgatctggggtgtggaagaggcggctggagctactattgcgccgggctgaagaaagtgacagaagtgcggggatacaccaagggcgggcccggacacgaggagcctgtccccatgtccacgtatggctggaatatcgtgaaactcatgtctgggaaggacgtcttttacctgcctcccgaaaagtgtgatacccttctgtgcgacattggagagagctccccgagccctacagtggaagagtctcgcaccatcagagtcctcaaaatggtggagccctggctgaagaacaatcagttctgtattaaagttctgaacccctacatgcctacagtgatcgaacatctcgagcggcttcagcgcaagcacggcggcatgctggtcagaaatcccctgtcccggaacagcacccatgaaatgtattggatctctaatgggacaggaaacattgtgtccagcgtgaatatggtctctcgcctcctgcttaacagatttaccatgacgcaccggagacctacaatcgagaaagatgttgacctgggcgctgggacccgccacgtgaacgccgaaccggagacccccaatatggacgtgattggagagcggatcagacgcattaaggaggaacatagctccacatggcactacgatgacgaaaacccttataagacgtgggcgtaccatggctcttatgaggtcaaagccaccgggagcgcttccagcatgatcaatggagtggttaagctcctgacaaaaccctgggatgtggtccctatggtgacccagatggccatgacagacaccacacccttcggccaacagcgggtttttaaggaaaaagtggataccagaacgccgcgccctatgcccggcacccggaaggtcatggagatcacagctgagtggctgtggagaaccctcgggcgcaacaagcggcctagactgtgcacacgcgaagagttcattaaaaaggtgcggaccaatgccgccatgggagcggtttttacggaagagaaccagtgggactccgctagagccgccgtggaagatgaggagttctggaaacttgtcgaccgcgaaagagagctgcacaagctcggcaaatgtgggtcttgcgtgtacaatatgatgggaaagcgggagaagaagctgggcgagtttgggaaggctaaaggcagccgcgccatctggtatatgtggcttggagctagatacctggagttcgaagccctcggctttctgaacgaggatcattggttctcccgggaaaattcttacagcggggtcgagggagaaggcctgcacaagctcgggtatattctgagagacatctccaaaattcccggaggcgcgatgtacgccgatgacacagctgggtgggacacccggatcacagaggatgaccttcacaacgaggaaaagatcacccaacagatggatcctgagcatcgccagctggccaatgctatttttaaactcacgtatcagaacaaggtggttaaggtgcaaagacccaccccgaaaggcacagtcatggacatcatttctcggaaggatcagcgcggaagcggccaggtggggacctacggactgaatacattcaccaacatggaagcccagcttatcagacaaatggagggcgaaggggtgctgtccaaagcggacctcgagaatcctcacctcctggagaagaaagttacacagtggctcgaaaccaagggagtggagcggctgaagcgcatggccattagcggcgatgactgcgtcgtgaaacccatcgatgacagattcgctaacgcccttctggctctcaacgatatggggaaggttcggaaagacatcccccagtggcagccttctaagggctggcatgattggcaacaggtgccgttttgttcccaccacttccatgaactgattatgaaagacggacgcaaacttgtcgtgccctgcagacctcaggacgagctgatcggccgggcccgcattagccagggggctggatggtctctcagagaaacggcctgtctgggcaaggcgtatgcccaaatgtgggctctgatgtactttcaccggcgcgatctcagactggcctccaatgccatctgcagcgctgtccccgtgcattgggttcctacatctcggaccacctggtccattcacgcccatcaccagtggatgacaaccgaggacatgcttacagtgtggaacagagtctggatcgaggataatccctggatggaagacaaaacgcctgtgaccacatgggaggatgttccctatctggggaagcgcgaagaccagtggtgtggaagcctcattggcctgacctcccgggcgacatgggctcaaaacatccttaccgccatccaacaggtgagaagcctgattgggaatgaggagttcctcgattacatgccgtctatgaaacgctttcggaaggaagaggaaagcgagggcgccatctggtga

SEQ ID NO: 20443 - RNA, 9873 nt, synthetic construct
  misc_feature 1..9873: note = derived and/or modified CDS sequence (opt5) from DENV-3__GQ199891__SS-prME
  source 1..9873: mol_type = other RNA
accagcctgtgcctcatgatgatcctgcccgcggctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacagctggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcgaagttgacaacttcaccatgggggtgctgtgcctcgccattctgtttgaggaagtcatgcggggaaagttcggcaagaaacatatgatcgctggcgtgttctttacattcgttcttctgctcagcgggcagattacctggcgcgatatggcccacacactgatcatgattggatccaatgcgagcgacagaatgggcatgggggtgacctacctggctcttatcgccacgtttaagatccagcccttcctggccctcggatttttcctgcggaaactcacatctagagagaacctgcttctgggcgtcgggctcgctatggccaccacactgcaactgcctgaagatattgagcagatggctaatggaatcgcccttggcctgatggcgctcaagctgattacccagtttgagacctatcagctctggacagccctgatctcccttacgtgtagcaacaccattttcacactgaccgtggcttggcgcacagccaccctcatcctggctggcgtgtccctgcttccggtctgccaatctagctccatgcggaaaacggactggctgcccatgacagttgccgccatgggggtgcctcccctccctctgtttatcttctctctcaaggataccctgaagagacgcagctggccccttaatgaaggagtgatggctgtcggcctggtgtccattctggcgtctagcctcctgagaaacgacgttcctatggccgggccccttgtggctggaggcctgctcatcgcctgttacgtcattaccgggacatccgccgatctgaccgtggagaaagctgccgacgttacatgggaagaggaagcggagcagacgggagtgagccataacctcatgatcaccgtcgacgatgacggcacaatgcggattaaggatgacgagaccgaaaatatcctgacagtgcttctgaaaaccgctctgctcatcgtctctggcatttttccgtactccatccctgccacgctgcttgtgtggcacacctggcagaagcagacacaacgcagcggggttctgtgggatgtgccctctcctcccgagacccagaaagccgaactcgaggagggagtctatagaattaagcagcagggcatcttcgggaaaacacaagtgggagttggcgtgcagaaggaaggggtctttcataccatgtggcacgtgacacggggagctgtgctgacgtacaacggcaagcgcctcgagccgaattgggcctccgttaaaaaggacctgattagctatggcgggggatggagactttctgcgcagtggcaaaaaggcgaagaggtccaggtgatcgctgtggaacctgggaagaaccccaaaaatttccagaccatgcctggaacattccagaccaccacaggcgagattggggccatcgccctggattttaagcccggaacgtccggcagccccatcattaaccgggagggcaaggtcgtggggctgtacggaaatggcgttgtgaccaaaaacgggggatatgtctccggcatcgctcaaacaaatgccgaacctgacgggccgacccccgagctcgaagaggaaatgttcaagaaacgcaacctgacaattatggatcttcaccctggcagcggaaagaccagaaaatacctgcccgctatcgtgcgggaggccattaagcgcagactccggacgctgatcctcgcgcctacaagagttgtggccgctgagatggaagaggccctgaagggccttcccatccgctatcagaccaccgctacaaaatctgaacataccgggcgggagattgtcgacctgatgtgccacgccacatttaccatgagactgctcagccctgtgcgcgttccgaattacaacctgatcattatggatgaagcccatttcacggaccccgcttccatcgcggcccggggatacatttctacaagagtgggcatgggggaggctgccgccatctttatgaccgctacacctcccggaaccgccgatgcgttccctcagagcaatgctcccatccaggacgaggaacgcgacattccggagcggtcctggaactctggcaatgaatggatcacggattttgccgggaagaccgtctggttcgtgcctagcattaaagccggcaacgacatcgctaactgtcttagaaagaatggcaaaaaggtgattcaactgtcccgcaagacatttgataccgagtatcagaaaacaaagctcaacgactgggatttcgtcgttaccacagacatctctgagatgggagccaattttaaagcggatcgggtgattgaccccagacggtgcctgaagcccgtgatcctgaccgatgggcctgaacgcgtcatcctcgccggacccatgcctgtgacggctgccagcgctgcccagagacggggccgcgttgggagaaacccgcagaaagagaatgaccaatacattttcacaggacagccccttaacaatgatgaagaccacgctcattggaccgaggccaagatgctgctggacaacatcaatacccctgaaggcattatccccgccctcttcgagcctgagcgggaaaagtccgccgctattgatggggagtatagactgaaaggcgaaagccgcaagacatttgtggagcttatgcggagaggagacctgcccgtctggctcgcccacaaagtggcttctgaaggcatcaagtacaccgatcgcaaatggtgcttcgacgggcagcggaacaatcagatcctggaggagaacatggatgttgaaatttggacaaaggagggagagaagaagaagctgagaccgcgctggctcgacgcccggacgtattccgatcctcttgccctgaaagagtttaaggacttcgctgcgggcagaaaaagcatcgccctggatctcgtgaccgaaattgggcgcgtccccacacacctggctcatagaacccggaatgcccttgacaacctggtgatgctccacacatctgagcatggaggcaaggcctaccgccacgctgtcgaggaactgcctgagaccatggaaacgctgctccttctgggcctgatgatcctcctgaccgggggagccatgctttttctgatttccggcaaagggatcggaaagacaagcatcggcctcatttgtgtgatcgcgtcctctgggatgctgtggatggccgagattcccctgcaatggatcgctagcgccattgttctcgagttctttatgatggtgcttctgatccctgaacccgagaagcagagaaccccgcaggataatcaactggcttatgtggtcattggaatcctcacactggccgcgatcattgccgctaacgaaatgggccttctggagaccacgaaacgggacctcggcatgtccaaggaacctggggttgtgagccccacatcttacctggatgtggacctgcaccccgcctccgcttggaccctctacgccgtcgctacaaccgtgatcacccctatgcttcgccatacaattgagaatagcacggccaacgtttctctggcggccatcgctaaccaggccgtggtcctgatgggactcgacaaaggctggccgattagcaagatggatctgggggtgccccttctggctctcggatgctattcccaggtcaatcctctgaccctgacagccgccgtgctccttctgatcacccactacgcgatcattggccccgggctgcaggctaaagccacaagagaggctcaaaagcggaccgccgccggaatcatgaagaaccctacggttgacggcattatgacaatcgatctcgaccccgtgatttatgattctaaattcgaaaagcagctgggccaggtcatgcttctggtgctctgtgctgttcagctgctgctcatgagaaccagctgggccctttgcgaggcgctgaccctggccacagggcctatcaccacactctgggaaggatccccgggcaaattttggaatacgaccatcgctgtgtctatggccaacattttccgcgggagctacctggctggagccggccttgcgttttccatcatgaaaagcgtcgggacaggaaaacggggcaccggctctcaaggggagacactgggagaaaagtggaagaaaaagctcaatcagctgtccagaaaagagttcgacctgtataagaaaagcggcattaccgaggtggatcgcacggaagccaaggaggggctcaaacggggagaaatcacccatcacgctgtgtccagaggctctgccaaacttcagtggtttgttgagcggaacatggtcattcccgaagggcgcgtgatcgacctgggatgtggcagaggcgggtggagctactattgcgctggactgaagaaagtgacagaggtccggggctacaccaaagggggacctggccatgaggaacccgttcctatgtccacatacgggtggaatattgtgaaactcatgtctggaaaggatgtgttctatctgcccccggagaaatgtgacacccttctgtgcgatatcggcgaaagctcccctagccccacagtcgaggagtctcgcaccatcagagtgctcaagatggttgaaccctggctgaagaacaatcagttctgtattaaagtgctgaacccttacatgcccacggtcatcgagcacctcgaacggcttcaacgcaagcacggcgggatgctggtgagaaatcctctgtcccggaacagcacacatgagatgtattggatttctaatggaaccggcaacatcgttgcctccgtgaatatggtcagccgcctcctgcttaacagatttaccatgacacaccggagaccgacgattgaaaaagacgtggatctgggggctggaacccgccatgtgaacgccgagcccgagacacctaatatggacgtcatcggcgaacggatcaagagaattaaagaggaacacaactctacctggcactacgacgatgagaatccctataagacatgggcgtaccatgggagctatgaagttaaggccaccggatccgcttctagcatgatcaacggcgtggtgaaactcctgacaaagccttgggacgtcgtgcccatggttacccagatggccatgacggataccacaccgttcggccagcaacgcgtgtttaaagagaaggtcgacacccggacacctagatccatgcccgggacccgccgggtgatgggaattacggctgagtggctgtggagaacactcggccgcaataaaaagcctcggctgtgcaccagagaagagttcacaaagaaagttcgcaccaacgccgccatgggggcggtgtttacggaagagaatcagtgggatagcgctaaggccgccgtcgaagacgaggatttctggaaacttgtggaccgggagagagaactgcacaagctcggaaaatgtggctcctgcgtttacaacatgatggggaagcgcgagaaaaagctgggcgaatttggaaaggctaaaggctctagagccatctggtacatgtggcttggggctcggtatctggagttcgaggccctcggatttctgaatgaagatcattggttcagccgcgagaactcctactctggcgtggaaggggagggactgcacaagctcggctatattctgagagacatcagcaaaatccccgggggcgcgatgtacgccgatgacaccgctggatgggacacacggattaccgaagatgaccttcataatgaggagaagatcacacagcagatggatcctgaacacagacaactggccaacgctatttttaaactcacctatcagaataaggtcgtgaaggtccagcggcccacaccgaccggcacggtgatggacatcatttcccgcaaagatcagagagggtctggacaagttggcacatacgggctgaacaccttcaccaatatggaggcccagcttatccggcagatggaaggagagggcgtgctgagcaaggcggacctcgaaaaccctcatctgcccgagaaaaagatcacacagtggctggagaccaaaggggtcgaacgcctcaagagaatggccatttccggcgatgactgcgtggtgaagcccatcgatgaccggtttgctaacgccctgcttgctctgaatgatatgggaaaagttcgcaaggacattcctcaatggcagccgagcaaaggctggcatgattggcaacaggtgcccttctgttctcaccatttccacgagctcatcatgaaggacgggagaaaactggtcgtgccttgccggccccaagacgaacttattggacgcgccagaatctcccagggcgctgggtggagcctgcgggagacagcctgtctcggaaaggcgtatgcccagatgtggtctctgatgtactttcaccgcagagatctgcggctcgcttccaacgccatttgcagcgccgttcctgtgcattgggtccccacgtctcgcaccacatggtccatccacgctcatcaccaatggatgaccacagaagacatgctgaccgtgtggaatagagtctggatcgaggataacccttggatggaggacaagacgcccgtgaccacatgggaaaatgttccgtaccttggcaaacgggaggatcagtggtgtgggagcctgattggcctcacctccagagccacatgggcgcagaacatccctaccgctattcagcaagtgcgcagcctgatcggaaatgaagagttccttgactatatgccctctatgaagcggtttagaaaagaggaagagagcgaaggcgccatttggtga

SEQ ID NO: 20444 - RNA, 9873 nt, synthetic construct
  misc_feature 1..9873: note = derived and/or modified CDS sequence (opt5) from DENV-3__FJ898443__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacagctggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggacgggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccaccagatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcatacctggacagaacagtacaaatttcaagcggattcccccaagcggctggccaccgctattgccggcgcttgggagaatggagtttgtggcatcagaagcacaacccgcatggaaaaccttctctggaaacagattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggcggggcctatcagccagcacaactatcgccccggataccatacccaaacggctggcccttggcaccttgggaagctggagctcgactttaattattgcgagggaacaaccgtggttattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggtcaaatccctggtgagcgccggatctggcaaggttgacaacttcacaatgggggtgctgtgcctcgccatcctgtttgaagaggtcatgcggggaaagttcggcaaaaagcatatgattgctggcgtgttctttaccttcgttcttctgctcagcgggcagatcacatggcgcgatatggcccacaccctgattatgatcggatccaatgcgagcgacagaatgggcatgggggtgacgtacctggctcttattgccacatttaaaatccagcccttcctggccctcggatttttcctgcggaagctcacctctagagaaaacctgcttctgggcgtcgggctcgctatggccacaaccctgcaactgcctgaggatatcgaacagatggctaatggaattgcccttggcctgatggcgctcaaactgatcacccagtttgagacatatcagctctggacggccctgatttcccttacctgtagcaacacaatcttcaccctgacagtggcttggcgcaccgccacgctcattctggctggcgtgtccctgcttccggtctgccaatctagctccatgcggaagacagactggctgcccatgaccgttgccgccatgggggtgcctcccctccctctgtttatcttctctctcaaggataccctgaaaagacgcagctggccccttaatgagggagtgatggctgtcggcctggtgtccatcctggcgtctagcctcctgagaaacgacgttcctatggccgggccccttgtggctggaggcctgctcattgcctgttacgtcatcacagggacctccgccgatctgacagtggaaaaggctgccgacgttacgtgggaggaagaggcggaacagaccggagtgagccataacctcatgattacagtcgacgatgacggcaccatgcggatcaaagatgacgagacagagaatattctgaccgtgcttctgaagacggctctgctcatcgtctctggcatctttccgtactccattcctgccaccctgcttgtgtggcacacatggcagaaacagacccaacgcagcggggttctgtgggatgtgccctctcctcccgaaacacagaaggccgagctcgaagagggagtctatagaatcaaacagcagggcattttcgggaagacccaagtgggagttggcgtgcagaaggagggggtctttcatacaatgtggcacgtgacgcggggagctgtgctgacctacaacggcaaacgcctcgaaccgaattgggcctccgttaagaaagacctgatcagctatggcgggggatggagactttctgcgcagtggcaaaagggcgaggaagtccaggtgattgctgtggagcctgggaaaaaccccaagaatttccagacaatgcctggaaccttccagaccacaacgggcgaaatcggggccattgccctggattttaagcccggaacctccggcagccccatcatcaaccgggagggcaaagtcgtggggctgtacggaaatggcgttgtgacaaagaacgggggatatgtctccggcattgctcaaaccaatgccgagcctgacgggccgacacccgaactcgaggaagagatgttcaaaaagcgcaacctgaccatcatggatcttcaccctggcagcggaaaaacgagaaagtacctgcccgctattgtgcgggaagccatcaagcgcagactccggacactgattctcgcgcctaccagagttgtggccgctgagatggaggaagccctgaaaggccttcccatccgctatcagaccacagctaccaagtctgagcatacagggcgggaaatcgtcgacctgatgtgccacgccacctttacgatgagactgctcagccctgtgcgcgttccgaattacaacctgattatcatggatgaggcccatttcacagaccccgcttccattgcggcccggggatacatctctaccagagtgggcatgggggaagctgccgccatttttatgacagctacccctcccggaacggccgatgcgttccctcagagcaatgctcccatccaggacgaggagcgcgacatcccggaacggtcctggaactctggcaatgagtggattaccgattttgccgggaaaacagtctggttcgtgcctagcatcaaggccggcaacgacattgctaactgtcttcgcaaaaatggaaagaaggtgatccaactgtccagaaaaacctttgatacagaatatcagaagaccaaactcaacgactgggatttcgtcgttacaaccgacatttctgagatgggcgccaattttaaggcggatcgggtgatcgaccccagacggtgcctgaaacccgtgattctgacggatgggcctgagcgcgtcatcctcgccggacccatgcctgtgacagctgccagcgctgcccagagacggggccgcgttgggagaaacccgcagaaggaaaatgaccaatacatcttcaccggacagccccttaacaatgatgaggaccacgctcattggaccgaagccaagatgctgctggacaacattaatacacctgagggcatcattcccgccctcttcgaacctgagcgggagaaatccgccgctatcgatggggaatatagactgaagggcgagagccgcaaaacctttgtggaacttatgcggagaggagacctgcccgtctggctcgcccacaaggtggcttctgagggcattaaatacacagatcgcaagtggtgcttcgacgggcagcggaacaatcagatcctggaagagaacatggatgttgagatctggacgaaagaaggagagaagaagaaactgagaccgcgctggctcgacgcccggacctattccgatcctcttgccctgaaggaatttaaagacttcgctgcgggcagaaagagcattgccctggatctcgtgacagagatcgggcgcgtccccacccacctggctcatagaacacggaatgcccttgacaacctggtgatgctccacacctctgaacatggaggcaaagcctaccgccacgctgtcgaggagctgcctgaaacgatggagaccctgctccttctgggcctgatgattctcctgacagggggagccatgctttttctgatctccggcaaggggattggaaagaccagcatcggcctcatctgtgtgattgcgtcctctgggatgctgtggatggccgaaatccccctgcaatggattgctagcgccatcgttctcgagttctttatgatggtgcttctgattcctgagcccgaaaaacagagaacaccgcaggataatcaactggcttatgtggtcatcggcattctcaccctggccgcgatcatcgccgctaacgagatgggccttctggaaacgacaaagcgggacctcggcatgtccaaagagcctggggttgtgagccccacctcttacctggatgtggacctgcaccccgcctccgcttggacactctacgccgtcgctaccaccgtgattacacctatgcttcgccatacgatcgaaaatagcaccgccaacgtttctctggcggccattgctaaccaggccgtggtcctgatgggactcgacaagggctggccgatcagcaaaatggatctgggggtgccccttctggctctcggatgctattcccaggtcaatcctctgacactgaccgccgccgtgctccttctgattacacactacgcgatcatcggccccgggctgcaggctaaggccaccagagaggctcaaaagcggacggccgccggaattatgaaaaaccctacagttgacggcatcatgaccattgatctcgaccccgtgatctatgattctaagttcgagaaacagctgggccaggtcatgcttctggtgctctgtgctgttcagctgctgctcatgagaaccagctgggccctttgcgaagcgctgacactggccaccgggcctattacaacgctctgggagggatccccgggcaagttttggaataccacaatcgctgtgtctatggccaacatcttccgcgggagctacctggctggagccggccttgcgttttccattatgaaaagcgtcgggaccggaaagcggggcacaggctctcaaggggaaaccctgggagagaagtggaaaatgaagctcaatcagctgtccagaaaagagttcgacctgtataagaaaagcggcatcacggaggtggatcgcaccgaggccaaggaagggctcaaacggggagagattacacatcacgctgtgtccagaggctctgccaaacttcagtggtttgttgaacggaacatggtcatccccgaggggcgcgtgattgacctgggatgtggcagaggcgggtggagctactattgcgctggactgaagaaagtgaccgaagtccggggctacacaaaagggggacctggccatgaggagcccgttcctatgtccacctacgggtggaatatcgtgaaactcatgtctggaaaggatgtgttctatctgcccccggaaaaatgtgacacacttctgtgcgatattggcgagagctcccctagccccaccgtcgaagagtctcgcacgatcagagtgctcaagatggttgagccctggctgaagaacaatcagttctgtatcaaagtgctgaacccttacatgcccacagtcattgaacacctcgagcggcttcaacgcaagcacggcgggatgctggtgagaaatcctctgtcccggaacagcacccatgaaatgtattggatctctaatggaaccggcaacattgttgcctccgtgaatatggtcagccgcctcctgcttaacagatttacaatgacgcaccggagaccgaccatcgagaaagacgtggatctgggggctggaacacgccatgtgaacgccgaacccgagacccctaatatggacgtcattggcgagcggatcaagagaatcaaagaagaacacaactctacatggcactacgacgatgaaaatccctataagacctgggcgtaccatgggagctatgaggttaaggccacaggatccgcttctagcatgattaacggcgtggtgaaactcctgaccaagccttgggacgtcgtgcccatggttacgcagatggccatgaccgatacaaccccgttcggccagcaacgcgtgtttaaagaaaaggtcgacacacggacccctagatccatgcccgggacgcgccgggtgatgggaatcacagctgagtggctgtggagaaccctcggccgcaataaaaagcctcggctgtgcacaagagaggagttcaccaagaaagttcgcacgaacgccgccatgggggcggtgtttaccgaggaaaatcagtgggatagcgctaaggccgccgtcgaggacgaagatttctggaaacttgtggaccgggagagagagctgcacaagctcggaaaatgtggctcctgcgtttacaacatgatggggaagcgcgagaagaagctgggcgagtttggaaaggctaaaggctctagagccatttggtacatgtggcttggggctcggtatctggagttcgaggccctcggatttctgaatgaggatcattggttcagccgcgaaaactcctactctggcgtggagggggaaggactgcacaagctcggctatatcctgagagacattagcaaaatccccgggggcgcgatgtacgccgatgacacagctggatgggacacccggatcacagaggatgaccttcataatgaagagaagattacccagcagatggatcctgagcacagacaactggccaacgctatctttaaactcacatatcagaataaggtcgtgaaggtccagcggcccaccccgacgggcacagtgatggacattatctcccgcaaagatcagagagggtctggacaagttggcacctacgggctgaacaccttcacaaatatggaagcccagcttattcggcagatggagggagaaggcgtgctgagcaaggcggacctcgagaaccctcatctgcccgagaagaagatcacccagtggctggagacaaaaggggtcgagcgcctcaagagaatggccatctccggcgatgactgcgtggtgaagcccattgatgaccggtttgctaacgccctgcttgctctgaatgatatgggaaaagttcgcaaggacatccctcaatggcagccgagcaaaggctggcatgattggcaacaggtgcccttctgttctcaccatttccacgaactcattatgaaggacgggagaaaactggtcgtgccttgccggccccaagacgagcttatcggacgcgccagaatttcccagggcgctgggtggagcctgcgggaaacggcctgtctcggaaaggcgtatgcccagatgtggtctctgatgtactttcaccgcagagatctgcggctcgcttccaacgccatctgcagcgccgttcctgtgcattgggtccccacctctcgcacaacctggtccattcacgctcatcaccaatggatgacaaccgaggacatgctgacggtgtggaatagagtctggatcgaagataacccttggatggaggacaagacccccgtgacaacctgggagaatgttccgtaccttggcaaacgggaagatcagtggtgtgggagcctgatcggcctcacatccagagccacctgggcgcagaacattcctacggctatccagcaagtgcgcagcctgattggaaatgaggagttccttgactatatgccctctatgaagcggtttagaaaagaggaggaactggagggcgccatctggtga

SEQ ID NO: 20445 - RNA, 9873 nt, synthetic construct
  misc_feature 1..9873: note = derived and/or modified CDS sequence (opt5) from DENV-3__FJ898444__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacgagcaaggcaaggcgcataacgggagactgatcacagctaatcccgttgtgaccaaaaaggaagagcccgtcaacattgaagccgagcctccgttcggagaatccaatatcgtgattggcatcggggataacgccctgaaaatcaattggtataagaagggctctagcattggaaaaatgtttgaggctacggcccggggcgctagacgcatggccatccttggggacacagcgtgggatttcggatccgtgggcggggttctcaacagcctgggaaagatggtccaccagatttttggctctgcctacaccgctctgttctccggggtgagctgggtgatgaaaatcggcattggagtcctcctgacctggatcggccttaattctaagaacacaagcatgtccttttcttgcattgccatcgggatcattaccctgtatctcggagctgtggttcaggccgacatgggctgtgtggtcaattggaaagggaaggagctgaagtgcggaagcggcatcttcgtgacaaacgaagttcatacgtggaccgagcagtacaaatttcaagcggattcccccaagcggctggccacagctattgccggggcttgggaaaatggcgtgtgtggaatcagaagcaccacacgcatggagaaccttctctggaaacagattgccaatgaactgaactatatcctgtgggagaataacatcaagctcaccgtcgtggttggcgacattatcggggtgctggagcagggaaaacggacgcttacccctcagcccatggaactgaagtactcttggaaaacatggggcaaggccaagattgtcaccgctgagacacaaaactccagcttcatcattgatgggcctaatacccccgaatgcccgtctgcgtccagagcctggaacgtgtgggaggtggaagactatggatttggcgtcttcacaaccaatatctggctcaaactgcgcgaggtttacacgcagctgtgtgaccaccggcttatgagcgctgccgtgaaggatgagagagccgtgcacgctgacatgggctactggatcgaatcccagaaaaacgggtcttggaagctcgagaaagccagcctgattgaagtcaagacatgcacctggcctaagtcccataccctgtggtctaatggagtgctcgagagcgatatgatcattcccaaatccctggcgggccctatcagccagcacaactatcgccccgggtaccatacacaaaccgctggaccttggcaccttggcaagctggagctcgactttaattattgcgaagggacgacagttgtgattaccgagaactgtggaacacggggcccctctctgagaaccacaaccgtctccggcaaactgatccacgaatggtgctgtcgcagctgcacgcttccgcctctccggtacatgggggaggatggatgttggtatggcatggaaatcagacccatttctgagaaggaggaaaatatggtgaaatccctggttagcgccgggtctggagaggtggacaacttcaccatgggcgtcctgtgcctcgccatcctgtttgaagaggtgatgcgggggaagttcggaaagaaacatatgattgctggcgttttctttacattcgtgcttctgctcagcggccagatcacctggcgcgatatggcccacacactgattatgatcgggtccaatgcgagcgacagaatgggaatgggcgtcacctacctggctcttattgccacgtttaagatccagcccttcctggccctcgggtttttcctgcggaaactcacatctagagaaaacctgcttctgggagtgggcctcgctatggccaccacactgcaactgcctgaggatatcgagcagatggctaatgggattgcccttggactgatggcgctcaagctgatcacccagtttgaaacctatcagctctggacagccctgatttcccttacgtgtagcaacaccatcttcacactgaccgtggcttggcgcacagccaccctcattctggctggcgtctccctgcttccggtttgccaatctagctccatgcggaaaacggactggctgcccatgacagtggccgccatgggcgtgcctcccctccctctgtttatcttctctctcaaggataccctgaagagacgcagctggccccttaatgagggggtcatggctgtgggactggtttccatcctggcgtctagcctcctgagaaacgacgtgcctatggccggcccccttgtcgctgggggactgctcattgcctgttacgtgatcaccggcacatccgccgatctgaccgttgaaaaagctgccgacgtgacatgggaggaagaggcggagcagacgggggtcagccataacctcatgattaccgtggacgatgacggaacaatgcggatcaaggatgacgaaaccgagaatattctgacagtccttctgaaaaccgctctgctcatcgtgtctggcatctttccgtactccattcctgccacgctgcttgtttggcacacctggcagaagcagacacaacgcagcggcgtgctgtgggatgtcccctctcctcccgaaacccagaaagccgagctcgaggaaggggtgtatagaatcaagcagcagggaattttcggcaaaacacaagttggggtgggagtccagaaggagggcgtgtttcataccatgtggcacgtgacacggggggctgttctgacgtacaacggaaagcgcctcgaaccgaattgggcctccgtcaaaaaggacctgatcagctatggcggcgggtggagactttctgcgcagtggcaaaaaggagaggaagtgcaggtgattgctgtcgagcctggcaagaaccccaaaaatttccagaccatgcctgggacattccagaccaccacaggagagatcggcgccattgccctggattttaagcccgggacgtccggaagccccatcatcaaccgggaaggcaaggtggttggcctgtacgggaatggagtggtcaccaaaaacggcgggtatgtgtccggaattgctcaaacaaatgccgagcctgacggcccgacccccgaactcgaggaagagatgttcaagaaacgcaacctgacaatcatggatcttcaccctgggagcggcaagaccagaaaatacctgcccgctattgttcgggaggccatcaagcgcagactccggacgctgattctcgcgcctacaagagtggtcgccgctgaaatggaggaagccctgaagggacttcccatccgctatcagaccaccgctacaaaatctgagcataccggccgggaaatcgtggacctgatgtgccacgccacatttaccatgagactgctcagccctgttcgcgtgccgaattacaacctgattatcatggatgaggcccatttcacggaccccgcttccattgcggcccgggggtacatctctacaagagtcggaatgggcgaggctgccgccatttttatgaccgctacacctcccgggaccgccgatgcgttccctcagagcaatgctcccatccaggacgaagagcgcgacatcccggaacggtcctggaactctggaaatgagtggattacggattttgccggcaagaccgtgtggttcgtgcctagcatcaaagccgggaacgacattgctaactgtcttagaaagaatggcaaaaaggtcatccaactgtcccgcaagacatttgataccgagtatcagaaaacaaagctcaacgactgggatttcgttgtgaccacagacatttctgaaatgggagccaattttaaagcggatcgggtgatcgaccccagacggtgcctgaagcccgtcattctgaccgatggccctgagcgcgtgatcctcgccgggcccatgcctgttacggctgccagcgctgcccagagacggggacgcgtgggcagaaacccgcagaaagaaaatgaccaatacatcttcacagggcagccccttaacaatgatgaggaccacgctcattggaccgaagccaagatgctgctggacaacattaatacccctgagggaatcattcccgcgctcttcgagcctgaacgggagaagtccgccgctatcgatggcgaatatagactgaaaggggagagccgcaagacatttgtcgaacttatgcggagaggcgacctgcccgtgtggctcgcctacaaagttgcttctgagggaattaagtataccgatcgcaaatggtgcttcgacggccagcggaacaatcagatcctggaggaaaacatggatgtggagatctggacaaaggaaggggagaaaaagaagctgagaccgcgctggctcgacgcccggacgtactccgatcctcttgccctgaaagaatttaaggacttcgctgcgggaagaaaaagcattgccctggatctcgtcaccgagatcggccgcgtgcccacacacctggctcacagaacccggaatgcccttgacaacctggtcatgctccatacatctgagcacgggggaaaggcctatcgccatgctgtggaagagctgcctgaaaccatggagacgctgctccttctgggcctgatgattctcctgaccggcggggccatgctttttctgatctccggaaaaggcattgggaagacaagcatcggactcatctgtgttattgcgtcctctggcatgctgtggatggccgagatccccctgcaatggattgctagcgccatcgtgctcgaattctttatgatggtgcttctgattcctgagcccgaaaagcagagaaccccgcaggataatcaactggcttacgtcgttatcgggattctcacactggccgcgatcatcgccgctaacgagatgggacttctggaaaccacgaaacgggacctcggcatgtcccgcgagcctggcgtggtgagccccacatcttacctggatgtcgacctgcaccccgcctccgcttggaccctctatgccgtggctacaaccgttattacccctatgcttagacacacaatcgagaatagcacggccaacgtgtctctggcggccattgctaaccaggccgtcgtgctgatggggctcgacaagggatggccgatcagcaaaatggatctgggcgtcccccttctggctctcgggtgctactcccaggtgaatcctctgaccctgacagccgccgttctccttctgattacccattatgcgatcatcggacccggcctgcaggctaaggccacacgggaagctcaaaaaagaaccgccgccgggattatgaagaaccctacggtggacggaatcatgacaattgatctcgaccccgtcatctacgattctaagttcgagaaacagctgggccaggtgatgcttctggttctctgtgctgtgcagctgctgctcatgcgcaccagctgggccctttgcgaagcgctgaccctggccacaggccctattaccacactctgggaggggtccccgggaaagttttggaatacgaccatcgctgtctctatggccaacatcttccggggcagctatctggctggggccggacttgcgttttccattatgaaaagcgtgggcacagggaagagaggaaccggctctcaaggcgaaacactgggggagaaatggaagaagaaactcaatcagctgtcccgcaaggagttcgacctgtacaaaaagagcggaatcaccgaagtggatcggacggaggccaaagaaggcctcaagaaaggggagattacccaccatgctgtttccagaggatctgccaagcttcagtggtttgtcgaacggaacatggtgatccccgagggccgcgtgattgacctggggtgtggaagaggcggctggagctattactgcgctgggctgaagaaagtcacagaggttcggggatacaccaagggcgggcctggacacgaagagcccgtgcctatgtccacatatggctggaatatcgtgaaactcatgtctgggaaggatgtcttctacctgcccccggaaaaatgtgacacccttctgtgcgatattggagagagctcccctagccccacagtggaggaatctcgcaccatcagagttctcaagatggtggagccctggctgaagaacaatcagttctgtatcaaagtcctgaacccttatatgcccacggtgattgaacatctcgagcggcttcaacgcaagcacggcggcatgctggttagaaatcctctgtcccggaacagcacacacgaaatgtactggatctctaatgggaccggaaacattgtggcctccgtcaatatggtgagccgcctcctgcttaacagatttaccatgacacatcggagaccgacgatcgagaaagacgtggatctgggcgctgggacccgccacgtcaacgccgagcccgaaacacctaatatggacgttattggagagcggatcaagagaatcaaagaagagcataactctacctggcactatgacgatgaaaatccctacaagacatgggcgtatcacggcagctacgaggtgaaggccaccgggtccgcttctagcatgattaacggagtggtcaaactcctgacaaagccttgggacgtggttcccatggtgacccagatggccatgacggataccacaccgttcggccagcaacgcgtctttaaagagaaggtggacacccggacacctagacccatgcctggcacccgccgggttatggggatcacggctgaatggctgtggagaacactcggacgcaataaaaagccccggctgtgcaccagagaggaattcacaaagaaagtgcgcaccaacgccgccatgggcgcggtctttacggaggaaaatcagtgggattccgctaaggccgccgtggaggacgaggatttctggaaacttgttgaccgggaaagagagctgcataagctcgggaaatgtggaagctgcgtgtacaacatgatgggcaagcgcgaaaaaaagctgggggagtttggcaaggctaaaggatccagagccatttggtatatgtggcttggcgctcggtacctggagttcgaagccctcgggtttctgaatgaggatcactggttctctcgcgaaaacagctattccggagtcgagggcgaagggctgcataagctcggatacatcctgagagacatttctaaaatccctggcggggcgatgtatgccgatgacaccgctggctgggacacacggatcaccgaggatgaccttcacaatgaggaaaagattacacagcagatggatcccgagcatagacaactggccaacgctatctttaaactcacctaccagaataaggtggtcaaggtgcagcggccgacacctaccggaacggttatggacattatcagccgcaaagatcagagaggctccgggcaagtgggaacatatggcctgaacaccttcaccaatatggaagcccagcttattcggcagatggagggggaaggagtcctgtctaaggcggacctcgagaacccccacctgcccgagaaaaagatcacacagtggctggaaaccaaaggcgtggagcgcctcaagagaatggccatcagcggggatgactgcgtggttaagcctattgatgaccggtttgctaacgccctgcttgctctgaatgatatgggcaaagtgcgcaaggacatcccgcaatggcagccctccaaaggatggcacgattggcagcaggtccctttctgtagccatcacttccatgaactcattatgaaggacggcagaaaactggtggttccctgccggcctcaagacgagcttatcgggcgcgccagaatttctcagggagctggctggtccctgcgggaaacagcctgtctcgggaaggcgtacgcccagatgtggagcctgatgtactttcaccgcagagatctgcggctcgcttctaacgccatctgctccgccgtgcccgtccactgggtgcctacgagccgcaccacatggtctattcatgctcaccatcaatggatgaccacagaggacatgctgaccgtctggaatagagtgtggatcgaggataacccctggatggaagacaagacgccggttaccacatgggagaatgtgccttatcttggaaaacgggaagatcagtggtgtggctccctgatcgggctcaccagcagagccacatgggcgcagaacattcccaccgctatccagcaagtccgctccctgattggcaatgaggagttccttgactacatgcctagcatgaagcggtttagaaaagaagaggaatctgagggagccatctggtga

SEQ ID NO: 20446 - RNA, 9873 nt, synthetic construct
  misc_feature 1..9873: note = derived and/or modified CDS sequence (opt5) from DENV-3__FJ898445__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggctgtgattttcaccctgcttatgctggtcacaccttctatgaccatgagatgtgtgggagttggcaaccgggactttgtggaagggctcagcggagccacctgggtcgatgtggtgctggagcacggcgggtgcgtcacaacgatggctaagaataaacccaccctggacatcgagctccagaagacagaagccacccaactggcgacacttcgcaaactgtgtattgagggaaagatcaccaacattacgacagattccagatgccctacccagggcgaagccgttctcccggaggaacaggaccagaattatgtgtgtaaacacacctacgtggatcggggctgggggaacggatgcggcctgttcgggaagggaagccttgtcacatgcgctaagtttcaatgtctggagcccatcgagggcaaagtggttcagtatgaaaatctcaagtacaccgtgattatcacagtccatacgggggaccagcaccaggtgggaaacgagacccaaggcgttacagccgaaatcacccctcaggcttctacaaccgaggccattctgcccgaatatggcacgctggggctcgagtgctcccctcgcaccggactggacttcaatgagatgatccttctgacaatgaaaaacaaggcctggatggtgcatagacagtggtttttcgatctccccctgccgtggaccagcggcgctacaaccgaaacgcctacatggaatcggaaagagcttctggtcacctttaagaacgcgcacgccaaaaagcaagaagtggtcgtgctcgggtctcaggagggagctatgcacacagccctgaccggcgccaccgaaattcagaattccgggggcacaagcatcttcgctggacatctgaagtgtcgcctcaaaatggacaagctggagcttaaaggcatgtcttacgccatgtgcacgaacacctttgttctgaagaaagaggtgtccgaaacacagcacgggaccattctcatcaaggtcgagtacaagggagaagatgtgccctgtaaaatccctttcagcacagaggacggccaagggaaggcgcataacggaagactgattaccgctaatcccgttgtgacgaaacgggaggaacccgtcaacatcgaggccgaacctccgttcggcgagtccaatattgtgatcgggattggcgataacgccctgaagatcaattggtataaaaagggatctagcatcggcaagatgtttgaagctacagccagaggggctcgccggatggccattcttggagacaccgcgtgggatttcggctccgtggggggagttctcaacagcctgggcaaaatggtccaccagatctttgggtctgcctacaccgctctgttctccggcgtgagctgggtgatgaagattggaatcggcgtcctcctgacatggattgggcttaattctaaaaacaccagcatgtccttttcttgcatcgccattggaatcatcacactgtatctcggcgctgtggttcaggccgacatggggtgtgtgattaattggaagggaaaagagctgaagtgcggcagcgggatcttcgtcacgaacgaggtgcatacctggacagaacagtacaagtttcaagcggattcccccaaaagactggccaccgctattgccggcgcttgggagaatggagtttgtggcatccgcagcacaacccggatggaaaaccttctctggaagcagattgccaatgagctgaactatatcctgtgggaaaataacatcaaactcacggtggtcgtgggggacattatcggagttctggagcagggcaagagaacccttacacctcagcccatggagctgaaatactcttggaagacctgggggaaagccaagattgtgacagctgaaacccaaaactccagcttcatcattgatggacctaatacacccgagtgcccgtctgcgtcccgcgcctggaacgtctgggaagtggaggactatggctttggcgtgttcaccacgaatatctggctcaagctgcgggaagtctacacacagctgtgtgaccacagacttatgagcgctgccgttaaagatgagcgcgccgtgcacgctgacatggggtactggatggagtcccagaagaacggatcttggaaactcgaaaaggccagcctgatcgaggtgaaaacctgcacctggcctaagtcccatacactgtggtctaatggcgtcctcgaaagcgatatgattatccccaagtccctggcggggcctattagccagcacaactatcggcccggataccatacccaaacggctggcccttggcaccttgggaaactggagctcgactttaattattgcgagggaacaaccgtggttatcacagaaaactgtggcaccagaggcccctctctgcgcacaaccacggtgtccgggaagctgattcacgagtggtgctgtcggagctgcacccttccgcctctcagatacatgggagaagatggctgttggtatgggatggagatccggcccatctctgaaaaagaggagaatatggtcaagtccctggtgagcgccggatctggcgaagttgacaacttcacaatgggggtgctgtgcctcgccattctgtttgaggaagtcatgcgcggaaaattcggcaagaagcatatgatcgctggcgtgttctttaccttcgttcttctgctcagcgggcagattacatggagagatatggcccacaccctgatcatgattggatccaatgcgagcgaccggatgggcatgggggtgacgtacctggctcttatcgccacatttaaaattcagcccttcctggccctcggatttttcctgagaaagctcacctctcgcgagaacctgcttctgggcgtcgggctcgctatggccacaaccctgcaactgcctgaagatatcgagcagatggctaatggaatcgcccttggcctgatggcgctcaaactgattacccagtttgagacatatcagctctggacggccctgatctcccttacctgtagcaacacaattttcaccctgacagtggcttggcggaccgccacgctcatcctggctggcgtgtccctgcttccggtctgccaatctagctccatgagaaagacagactggctgcccatgaccgttgccgccatgggggtgcctcccctccctctgtttattttctctctcaaagataccctgaagcgcagaagctggccccttaatgaaggagtgatggctgtcggcctggtgtccatcctggcgtctagcctcctgcggaacgacgttcctatggccgggccccttgtggctggaggcctgctcatcgcctgttacgtcattacagggacctccgccgatctgacagtggagaaggctgccgacgttacgtgggaagaggaagcggagcagaccggagtgagccataacctcatgatcacagtcgacgatgacggcaccatgcgcattaaagatgacgagacagaaaatatcctgaccgtgcttctgaagacggctctgctcattgtctctggcatctttccgtactccatccctgccaccctgcttgtgtggcacacatggcagaaacagacccaaagaagcggggttctgtgggatgtgccctctcctcccgagacacagaaggccgaactcgaggagggagtctatcggattaaacagcagggcatcttcgggaagacccaagtgggagttggcgtgcagaaagaaggggtctttcatacaatgtggcacgtgacgcgcggagctgtgctgacctacaacggcaagagactcgagccgaattgggcctccgttaagaaagacctgattagctatggcgggggatggcggctttctgcgcagtggcaaaagggcgaagaggtccaggtgatcgctgtggaacctgggaaaaaccccaagaatttccagacaatgcctggaaccttccagaccacaacgggcgagattggggccatcgccctggattttaaacccggaacctccggcagccccattatcaaccgcgagggcaaggtcgtggggctgtacggaaatggcgttgtgacaaagaacgggggatatgtctccggcatcgctcaaaccaatgccgaacctgacgggccgacacccgagctcgaagaggaaatgttcaaaaagagaaacctgaccattatggatcttcaccctggcagcggaaaaacgcggaagtacctgcccgctatcgtgcgcgaggccattaaaagacggctcagaacactgatcctcgcgcctacccgcgttgtggccgctgagatggaagaggccctgaagggccttcccattcggtatcagaccacagctaccaagtctgaacatacagggagagagatcgtcgacctgatgtgccacgccacctttacgatgcgcctgctcagccctgtgcgggttccgaattacaacctgatcattatggatgaagcccatttcacagaccccgcttccatcgcggccagaggatacatttctacccgcgtgggcatgggggaggctgccgccatctttatgacagctacccctcccggaacggccgatgcgttccctcagagcaatgctcccattcaggacgaggaacgggacatcccggagagatcctggaactctggcaatgaatggatcaccgattttgccgggaaaacagtctggttcgtgcctagcattaaggccggcaacgacatcgctaactgtcttcgcaaaaatggaaagaaagtgattcaactgtcccggaagacctttgatacagagtatcagaagaccaaactcaacgactgggatttcgtcgttacaaccgacatctctgagatgggcgccaattttaaggcggatagagtgattgacccccggcgctgcctgaaacccgtgatcctgacggatgggcctgaaagagtcattctcgccggacccatgcctgtgacagctgccagcgctgcccagcggcgcggcagagttgggcggaacccgcagaaggagaatgaccaatacatcttcaccggacagccccttaacaatgatgaagaccacgctcattggaccgaggccaaaatgctgctggacaacatcaatacacctgaaggcattatccccgcgctcttcgagcctgagagagaaaagtccgccgctattgatggggagtatcgcctgaagggcgaaagccggaaaacctttgtggagcttatgagacgcggagacctgcccgtctggctcgcctacaaggtggcttctgaaggcatcaaatatacagatcggaagtggtgcttcgacgggcagagaaacaatcagattctggaggagaacatggatgttgaaatctggacgaaagagggagaaaagaaaaagctgcgcccgcggtggctcgacgccagaacctactccgatcctcttgccctgaaggagtttaaagacttcgctgcgggccgcaagagcatcgccctggatctcgtgacagaaattgggagagtccccacccacctggctcaccggacacgcaatgcccttgacaacctggtgatgctccatacctctgagcacggaggcaaagcctatagacatgctgtcgaggaactgcctgagacgatggaaaccctgctccttctgggcctgatgatcctcctgacagggggagccatgctttttctgatttccggcaaggggatcggaaaaaccagcattggcctcatctgtgtgatcgcgtcctctgggatgctgtggatggccgagattcccctgcaatggatcgctagcgccattgttctcgagttctttatgatggtgcttctgatccctgaacccgagaagcagcggacaccgcaggataatcaactggcttacgtggtcattggaatcctcaccctggccgcgattatcgccgctaacgaaatgggcatgcttgagacgacaaagcgcgacctgggcatgtccaaagaacctggggttgccagccccacctcttacctcgatgtggacctgcaccccgcttccgcctggacactgtatgctgtggccaccaccgtcatcacacctatgctcagacacacgattgagaatagcaccgcgaacgtgtctcttgccgctatcgccaaccaggctgttgtgctgatgggactggacaagggctggccgattagcaaaatggatctcggggtccccctgcttgccctgggatgctactcccaggtgaatcctctcacactgaccgccgcggtcctgctccttatcacacattatgctattatcggccccgggctgcaggccaaggctacccgggaggcccaaaaaagaacggccgctggaatcatgaagaaccctacagtggacggcattatgaccatcgatctggaccccgttatttacgattctaagttcgaaaaacagctcggccaggtgatgctgcttgtcctgtgtgccgtgcagctcctgctgatgcgcaccagctgggcgctctgcgaggcccttacactggctaccgggcctatcacaacgctgtgggaaggatccccgggcaagttttggaataccacaattgccgtttctatggctaacatcttccgggggagctatctcgccggagcgggcctggccttttccatcatgaaaagcgtggggaccggaaagagaggcacaggctctcaaggggagacccttggagaaaaatggaagaagaaactgaatcagctctcccgcaaggagttcgacctgtacaaaaagagcggcattacggaggtcgatcggaccgaagctaaagaggggctgaagagaggagaaatcacacaccatgccgtgtcccggggctctgctaaactccagtggtttgtggagcgcaacatggttattcccgaagggagagtcatcgaccttggatgtggccggggcgggtggagctattactgcgccggactgaagaaggtgaccgaggtgcgcggctacacaaaagggggacctggccacgaggaacccgtccctatgtccacctatgggtggaatattgttaagctgatgtctggaaaagatgtgttctacctccccccggagaagtgtgacacactgctttgcgatatcggcgaaagctcccctagccccaccgtggaggagtctagaacgattcgggtcctgaaaatggtggaaccctggctcaagaacaatcagttctgtatcaaggttctgaacccttatatgcccacagtgatcgagcatctggaacgcctccaaagaaaacacggcgggatgcttgtccggaatcctctgtcccgcaacagcacccacgagatgtactggatttctaatggaaccggcaacatcgtggcttccgttaatatggtgagcagactgctcctgaaccggtttacaatgacgcatagacgcccgaccattgaaaaggacgtcgatcttggggccggaacacggcacgtgaacgcggagcccgagacccctaatatggacgtgatcggcgaaagaattaaacgcatcaaggaggaacataactctacatggcactatgacgatgagaatccctacaaaacctgggcctatcacgggagctacgaagtcaaggctacaggatccgcctctagcatgatcaacggcgttgtgaagctgctcaccaaaccttgggacgtggtccccatggtgattcagatggctatgacggataccacaccgttcggccagcaacgggtttttaaggagaaagtggacaccagaacacctcgctccatgcccgggacccggagagtcatgggaatcacggccgagtggctgtggcgcacactgggccggaataagaaacctagactctgcacccgcgaagagttcacacggaaggtgagaaccaacgccgcgatgggggctgtttttacggaagagaatcagtgggatagcgccaaggccgctgtggaagacgaggatttctggaaactggtcgaccgcgagagagaacttcataagctgggaaaatgtggctcctgcgtgtacaacatgatggggaagcgggagaaaaagctcggcgaatttggaaaagccaagggctctcgcgctatttggtatatgtggctgggggccagataccttgagttcgaggcgctgggatttctcaatgaagatcactggttcagccgggagaactcctattctggcgttgaaggggagggactgcataagctgggctacatcctcagagacattagcaaaatccccgggggcgccatgtatgctgatgacaccgccggatgggacacacggatcaccgaagatgacctgcacaatgaggagaagattacacagcagatggatcctgaacatcgccaacttgctaacgccatctttaaactgacctaccagaataaggtggtcaaagtgcagagacccacaccgaccggcacggtcatggacattatctcccggaaggatcagcgcgggtctggacaagtgggcacatatgggctcaacaccttcaccaatatggaggcgcagctgattagacagatggaaggagagggcgttcttagcaaggccgacctggaaaaccctcacctccccgagaaaaagatcacacagtggctggagaccaaaggggtggaacggctgaagcgcatggctatctccggcgatgactgcgtcgtgaaacccattgatgacagatttgccaacgctctcctggcccttaatgatatgggaaaggtgcggaaggacatccctcaatggcagccgagcaaaggctggcacgattggcagcaggttcccttctgttctcatcacttccatgagctgattatgaaggacgggcgcaaactcgtggtcccttgcagaccccaagacgaactgatcggacgggctcgcatttcccagggcgccgggtggagccttagagagacagcgtgtctgggaaaggcctacgctcagatgtggtctctcatgtactttcaccggcgcgatctgagactggcctccaacgccatctgcagcgctgtgcctgttcactgggtgcccacgtctcggaccacatggtccattcatgcccaccatcaatggatgaccacagaagacatgctcaccgtctggaatagagtgtggatcgaggataacccttggatggaggacaaaacgcccgtcaccacatgggaaaatgtgccgtatctgggcaagcgcgaggatcagtggtgtgggagccttatcggcctgacctcccgggcgacatgggctcagaacattcctaccgccatccagcaagttagaagcctcattggaaatgaagagttcctggactacatgccctctatgaagcgctttcggaaagaggaagagagcgaaggcgccatctggtga

SEQ ID NO: 20447 - RNA, 9873 nt, synthetic construct
  misc_feature 1..9873: note = derived and/or modified CDS sequence (opt5) from DENV-3__GQ868571__SS-prME
  source 1..9873: mol_type = other RNA
accagcctctgcctcatgatgatcctgcccgcggctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtcacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacagctggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcgaagttgacaacttcaccatgggggtgctgtgcctcgccattctgtttgaggaagtcatgcggggaaagttcggcaagaaacatatgatcgctggcgtgttctttacattcgttcttctgctcagcgggcagattacctggcgcgatatggcccacacactgatcatgattggatccaatgcgagcgacagaatgggcatgggggtgacctacctggctcttatcgccacgtttaagatccagcccttcctggccctcggatttttcctgcggaaactcacatctagagagaacctgcttctgggcgtcgggctcgctatggccaccacactgcaactgcctgaagatattgagcagatggctaatggaatcgcccttggcctgatggcgctcaagctgattacccagtttgagacctatcagctctggacagccctgatctcccttacgtgtagcaacaccattttcacactgaccgtggcttggcgcacagccaccctcatcctggctggcgtgtccctgcttccggtctgccaatctagctccatgcggaaaacggactggctgcccatgacagttgccgccatgggggtgcctcccctccctctgtttatcttctctctcaaggataccctgaagagacgcagctggccccttaatgaaggagtgatggctgtcggcctggtgtccattctggcgtctagcctcctgagaaacgacgttcctatggccgggccccttgtggctggaggcctgctcatcgcctgttacgtcattaccgggacatccgccgatctgaccgtggagaaagctgccgacgttacatgggaagaggaagcggagcagacgggagtgagccataacctcatgatcaccgtcgacgatgacggcacaatgcggattaaggatgacgagaccgaaaatatcctgacagtgcttctgaaaaccgctctgctcatcgtctctggcatttttccgtactccatccctgccacgctgcttgtgtggcacacctggcagaagcagacacaacgcagcggggttctgtgggatgtgccctctcctcccgagacccagaaagccgaactcgaggagggagtctatagaattaagcagcagggcatcttcgggaaaacacaagtgggagttggcgtgcagaaggaaggggtctttcataccatgtggcacgtgacacggggagctgtgctgacgtacaacggcaagcgcctcgagccgaattgggcctccgttaaaaaggacctgattagctatggcgggggatggagactttctgcgcagtggcaaaaaggcgaagaggtccaggtgatcgctgtggaacctgggaagaaccccaaaaatttccagaccatgcctggaacattccagaccaccacaggcgagattggggccatcgccctggattttaagcccggaacgtccggcagccccatcattaaccgggagggcaaggtcgtggggctgtacggaaatggcgttgtgaccaaaaacgggggatatgtctccggcatcgctcaaacaaatgccgaacctgacgggccgacccccgagctcgaagaggaaatgttcaagaaacgcaacctgacaattatggatcttcaccctggcagcggaaagaccagaaaatacctgcccgctatcgtgcgggaggccattaagcgcagactccggacgctgatcctcgcgcctacaagagttgtggccgctgagatggaagaggccctgaagggccttcccatccgctatcagaccaccgctacaaaatctgaacataccgggcgggagattgtcgacctgatgtgccacgccacatttaccatgagactgctcagccctgtgcgcgttccgaattacaacctgatcattatggatgaagcccatttcacggaccccgcttccatcgcggcccggggatacatttctacaagagtgggcatgggggaggctgccgccatctttatgaccgctacacctcccggaaccgccgatgcgttccctcagagcaatgctcccatccaggacgaggaacgcgacattccggagcggtcctggaactctggcaatgaatggatcacggattttgccgggaagaccgtctggttcgtgcctagcattaaagccggcaacgacatcgctaactgtcttagaaagaatggcaaaaaggtgattcaactgtcccgcaagacatttgataccgagtatcagaaaacaaagctcaacgactgggatttcgtcgttaccacagacatctctgagatgggagccaattttaaagcggatcgggtgattgaccccagacggtgcctgaagcccgtgatcctgaccgatgggcctgaacgcgtcatcctcgccggacccatgcctgtgacggctgccagcgctgcccagagacggggccgcgttgggagaaacccgcagaaagagaatgaccaatacattttcacaggacagccccttaacaatgatgaagaccacgctcattggaccgaggccaagatgctgctggacaacatcaatacccctgaaggcattatccccgccctcttcgagcctgagcgggaaaagtccgccgctattgatggggagtatagactgaaaggcgaaagccgcaagacatttgtggagcttatgcggagaggagacctgcccgtctggctcgcccacaaagtggcttctgaaggcatcaagtacaccgatcgcaaatggtgcttcgacgggcagcggaacaatcagatcctggaggagaacatggatgttgaaatttggacaaaggagggagagaagaagaagctgagaccgcgctggctcgacgcccggacgtattccgatcctcttgccctgaaagagtttaaggacttcgctgcgggcagaaaaagcatcgccctggatctcgtgaccgaaattgggcgcgtccccacacacctggctcatagaacccggaatgcccttgacaacctggtgatgctccacacatctgagcatggaggcaaggcctaccgccacgctgtcgaggaactgcctgagaccatggaaacgctgctccttctgggcctgatgatcctcctgaccgggggagccatgctttttctgatttccggcaaagggatcggaaagacaagcatcggcctcatttgtgtgatcgcgtcctctgggatgctgtggatggccgagattcccctgcaatggatcgctagcgccattgttctcgagttctttatgatggtgcttctgatccctgaacccgagaagcagagaaccccgcaggataatcaactggcttatgtggtcattggaatcctcacactggccgcgatcattgccgctaacgaaatgggcatgcttgagaccacgaaacgggacctgggcatgtccaaggaacctggggttgtgagccccacatcttacctcgatgtggacctgcaccccgcctccgcttggaccctgtacgccgtcgctacaaccgtgatcacccctatgctccgccatacaattgagaatagcacggccaacgtttctcttgcggccatcgctaaccaggccgtggtcctgatgggactggacaaaggctggccgattagcaagatggatctcggggtgcccctgcttgctctgggatgctattcccaggtcaatcctctcaccctgacagccgccgtgctgctccttatcacccactacgcgatcattggccccgggctgcaggctaaagccacaagagaggctcaaaagcggaccgccgccggaatcatgaagaaccctacggttgacggcattatgacaatcgatctggaccccgtgatttatgattctaaattcgaaaagcagctcggccaggtcatgctgcttgtgctgtgtgctgttcagctcctgctgatgagaaccagctgggccctctgcgaggcgcttaccctggccacagggcctatcaccacactgtgggaaggatccccgggcaaattttggaatacgaccatcgctgtgtctatggccaacattttccgcgggagctacctcgctggagccggcctggcgttttccatcatgaaaagcgtcgggacaggaaaacggggcaccggctctcaaggggagacacttggagaaaagtggaagaaaaagctgaatcagctctccagaaaagagttcgacctgtataagaaaagcggcattaccgaggtggatcgcacggaagccaaggaggggctgaaacggggagaaatcacccatcacgctgtgtccagaggctctgccaagctccagtggtttgttgagcggaacatggtcattcccgaagggcgcgtgatcgaccttggatgtggcagaggcgggtggagctactattgcgctggactgaagaaagtgacagaggtccggggctacaccaaagggggacctggccatgaggaacccgttcctatgtccacatacgggtggaatattgtgaaactgatgtctggaaaggatgtgttctatctgcccccggagaaatgtgacaccctgctttgcgatatcggcgaaagctcccctagccccacagtcgaggagtctcgcaccatcagagtgctgaagatggttgaaccctggctcaagaacaatcagttctgtattaaagtgctgaacccttacatgcccacggtcatcgagcacctggaacggctccaacgcaagcacggcgggatgcttgtgagaaatcctctgtcccggaacagcacacatgagatgtattggatttctaatggaaccggcaacatcgttgcctccgtgaatatggtcagccgcctgctcctgaacagatttaccatgacacaccggagaccgacgattgaaaaagacgtggatcttggggctggaacccgccatgtgaacgccgagcccgagacacctaatatggacgtcatcggcgaacggatcaagagaattaaagaggaacacaactctacctggcactacgacgatgagaatccctataagacatgggcgtaccatgggagctatgaagttaaggccaccggatccgcttctagcatgatcaacggcgtggtgaaactgctcacaaagccttgggacgtcgtgcccatggttacccagatggccatgacggataccacaccgttcggccagcaacgcgtgtttaaagagaaggtcgacacccggacacctagatccatgcccgggacccgccgggtgatgggaattacggctgagtggctgtggagaacactgggccgcaataaaaagcctcggctctgcaccagagaagagttcacaaagaaagttcgcaccaacgccgccatgggggcggtgtttacggaagagaatcagtgggatagcgctaaggccgccgtcgaagacgaggatttctggaaactggtggaccgggagagagaacttcacaagctgggaaaatgtggctcctgcgtttacaacatgatggggaagcgcgagaaaaagctcggcgaatttggaaaggctaaaggctctagagccatctggtacatgtggctgggggctcggtatcttgagttcgaggccctgggatttctcaatgaagatcattggttcagccgcgagaactcctactctggcgtggaaggggagggactgcacaagctgggctatattctcagagacatcagcaaaatccccgggggcgcgatgtacgccgatgacaccgctggatgggacacacggattaccgaagatgacctgcataatgaggagaagatcacacagcagatggatcctgaacacagacaacttgccaacgctatttttaaactgacctatcagaataaggtcgtgaaggtccagcggcccacaccgaccggcacggtgatggacatcatttcccgcaaagatcagagagggtctggacaagttggcacatacgggctcaacaccttcaccaatatggaggcccagctgatccggcagatggaaggagagggcgtgcttagcaaggcggacctggaaaaccctcacctccccgagaaaaagatcacacagtggctggagaccaaaggggtcgaacgcctgaagagaatggccatttccggcgatgactgcgtggtgaagcccatcgatgaccggtttgctaacgccctcctggctcttaatgatatgggaaaagttcgcaaggacattcctcaatggcagccgagcaaaggctggcatgattggcaacaggtgcccttctgttctcaccatttccacgagctgatcatgaaggacgggagaaaactcgtcgtgccttgccggccccaagacgaactgattggacgcgccagaatctcccagggcgctgggtggagccttcgggagacagcctgtctgggaaaggcgtatgcccagatgtggtctctcatgtactttcaccgcagagatctgcggctggcttccaacgccatttgcagcgccgttcctgtgcattgggtccccacgtctcgcaccacatggtccatccacgctcatcaccaatggatgaccacagaagacatgctcaccgtgtggaatagagtctggatcgaggataacccttggatggaggacaagacgcccgtgaccacatgggaaaatgttccgtacctgggcaaacgggaggatcagtggtgtgggagccttattggcctgacctccagagccacatgggcgcagaacatccctaccgctattcagcaagtgcgcagcctcatcggaaatgaagagttcctggactatatgccctctatgaagcggtttagaaaagaggaagagagcgaaggcgccatttggtga

SEQ ID NO: 20448 - RNA, 9873 nt, synthetic construct
  misc_feature 1..9873: note = derived and/or modified CDS sequence (opt5) from DENV-3__GU131951__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatgtccaagaataaacccacgctggacattgagctccagaagaccgaagccacacaactggctacccttcgcaaactgtgtatcgagggaaagattacaaacatcaccacggatagcagatgccctacacagggcgaagccgtgctcccggaggaacaggaccagaattatgtgtgtaaacacacctacgtcgatcggggctgggggaacggatgcggcctgttcgggaagggatctcttgtgacctgcgcgaagtttcaatgtctggagcccattgagggcaaagttgtgcagtatgaaaatctcaagtacacagtcatcatcaccgtgcatacaggggaccagcaccaggttggaaacgagacgcaaggcgtgaccgccgaaattacacctcaggcttccaccacagaggccatcctgcccgaatatggcaccctggggctcgagtgcagccctcgcacgggactggacttcaatgagatgattcttctgaccatgaaaaacaaggcttggatggtccatagacagtggtttttcgatctccccctgccgtggacatctggcgccaccacagaaacccctacgtggaatcggaaagagcttctggtgacatttaagaacgcccacgctaaaaagcaagaagtcgtggttctcgggtcccaggagggagcgatgcacaccgccctgacaggcgctaccgaaatccagaatagcgggggcacctctattttcgccggacatctgaagtgtcgcctcaaaatggacaagctggagcttaaaggcatgtcctacgccatgtgcacaaacacgtttgtgctgaagaaagaggtcagcgaaacccagcacgggacaatcctcatcaaggtggagtacaagggagaagatgttccctgtaaaattcctttctccaccgaggacggccaagggaaggctcataacggaagactgatcacagccaatcccgtggtcaccaaaaaggaggaacccgtgaacattgaggcggaacctccgttcggcgagtctaatatcgtgattgggatcggcgataacgctctgaaaatcaattggtataagaagggaagctccattggcaaaatgtttgaagccacggccagaggggctagacgcatggccatccttggagacacagcttgggatttcggcagcgttgggggagtcctcaactctctgggcaagatggtgcaccagatttttgggtccgcctacaccgcgctgttcagcggcgtgtcttgggtcatgaaaatcggaattggcgtgctcctgacctggatcgggcttaatagcaagaacacatccatgtcttttagctgcattgccatcggaatcattaccctgtatctcggcgctgttgtgcaggccgacatggggtgtgtcatcaattggaaaggaaaggagctgaagtgcggctccgggattttcgtgacaaacgaggttcatacgtggaccgaacagtacaaatttcaagctgatagccccaagcggctggccacagcgatcgccggcgcttgggagaatggagtgtgtggcattagatctaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcctggaaaacatgggggaaggctaagatcgtcaccgccgaaacacaaaacagctctttcattatcgatggacctaatacccccgagtgcccgtccgccagcagagcttggaacgtgtgggaagtggaggactatggctttggcgtcttcacaaccaatatctggctcaaactgcgcgaagtttacacgcagctgtgtgaccaccggcttatgtccgcggccgtgaaggatgagagagctgtgcacgccgacatggggtactggattgagtctcagaaaaacggaagctggaagctcgaaaaagcctccctgatcgaggtcaagacatgcacctggcctaagtctcataccctgtggagcaatggcgtgctcgaatccgatatgattatccccaaaagcctggctgggcctatttctcagcacaactatcgccccggataccatacacaaaccgccggcccttggcaccttgggaagctggagctcgactttaattattgcgagggaacgacagttgtgatcaccgaaaactgtggcacacggggcccctccctgagaaccacaaccgtcagcgggaaactgatccacgagtggtgctgtcgctcttgcacgcttccgcctctccggtacatgggagaagatggctgttggtatgggatggagattagacccatctccgaaaaggaggagaatatggtgaaaagcctggtttctgcgggaagcggcgaagtggacaacttcaccatgggggtcctgtgcctcgctattctgtttgaggaagtgatgcggggaaagttcggcaagaaacatatgatcgccggcgttttctttacattcgtgcttctgctctccgggcagattacctggcgcgatatggcccacacactgatcatgattggaagcaatgcttctgacagaatgggcatgggggtcacctacctggcccttatcgcgacgtttaagatccagcccttcctggctctcggatttttcctgcggaaactcacatccagagagaacctgcttctgggcgtggggctcgccatggccaccacactgcaactgcctgaagatattgagcagatggctaatggaatcgcccttggcctgatggctctcaagctgattacccagtttgagacctatcagctctggacagccctgatcagccttacgtgttccaacaccattttcacactgaccgtggcgtggcgcacagccaccctcatcctggctggcgtctctctgcttccggtttgccaaagctcctctatgcggaaaacggactggctgcccatgacagtggccgctatgggggtgcctcccctccctctgtttatcttcagcctcaaggataccctgaagagacgctcctggccccttaatgaaggagtcatggccgtgggcctggtttctattctggccagctccctcctgagaaacgacgtgcctatggctgggccccttgtcgcgggaggcctgctcatcgcctgttacgtgattaccgggacaagcgctgatctgaccgttgagaaagccgccgacgtgacatgggaagaggaagctgagcagacgggagtctctcataacctcatgatcaccgtggacgatgacggcacaatgcggattaaggatgacgagaccgaaaatatcctgacagtccttctgaaaaccgccctgctcatcgtgtccggcatttttccgtacagcatccctgcgacgctgcttgtttggcacacctggcagaagcagacacaacgctctggggtgctgtgggatgtcccctcccctcccgaggctcagaaagccgaactcgaggagggagtgtatagaattaagcagcagggcatcttcgggaaaacccaagttggagtgggcgtccagaaggaaggggtgtttcatacaatgtggcacgtgacccggggagccgttctgacatacaacggcaagcgcctcgagccgaattgggctagcgtcaaaaaggacctgatttcttatggcgggggatggagactttccgcccagtggcaaaaaggcgaagaggtccaggtgatcgcggtcgaacctgggaagaaccccaaaaatttccagacgatgcctggaaccttccagacaaccaccggcgagattggggctatcgccctggattttaagcccggaacaagcggctcccccatcattaaccgggagggcaaggtggttgggctgtacggaaatggcgtggtcacgaaaaacgggggatatgtgagcggcatcgcccaaaccaatgctgaacctgacgggccgacacccgagctcgaagaggaaatgttcaagaaacgcaacctgaccattatggatcttcaccctggctctggaaagacaagaaaatacctgcccgccatcgttcgggaggctattaagcgcagactccggaccctgatcctcgcccctacgagagtggtcgcggccgagatggaagaggctctgaagggccttcccatccgctatcagacaaccgccaccaaaagcgaacatacagggcgggagattgtggacctgatgtgccacgctacctttacaatgagactgctctcccctgttcgcgtgccgaattacaacctgatcattatggatgaagcccatttcaccgaccccgcctctatcgctgcgcggggatacattagcacgagagtcggcatgggggaggccgctgccatctttatgacagccacccctcccggaacagctgatgccttccctcagtccaatgcgcccatccaggacgaggaacgcgacattccggagcggtcttggaacagcggcaatgaatggatcaccgattttgctgggaagacggtgtggttcgtgccttccattaaagccggcaacgacatcgccaactgtcttagaaagaatggcaaaaaggtcattcaactgtctcgcaagacctttgatacagagtatcagaaaaccaagctcaacgactgggatttcgttgtgacaaccgacatcagcgagatgggagctaattttaaagccgatcgggtgattgaccccagacggtgcctgaagcccgtcatcctgacagatgggcctgaacgcgtgatcctcgcgggacccatgcctgttaccgccgcttccgccgctcagagacggggccgcgtggggagaaacccgcagaaagagaatgaccaatacattttcacgggacagccccttaacaatgatgaagaccacgcccattggacagaggctaagatgctgctggacaacatcaatacccctgaaggcattatccccgccctcttcgagcctgagcgggaaaagagcgcggccattgatggggagtatagactgaaaggcgaatctcgcaagacctttgtcgagcttatgcggagaggagacctgcccgtgtggctcgctcacaaagttgcctccgaaggcatcaagtacacagatcgcaaatggtgcttcgacgggcagcggaacaatcagatcctggaggagaacatggatgtggaaatttggaccaaggagggagagaagaagaagctgagaccgcgctggctcgacgctcggacatatagcgatcctcttgccctgaaagagtttaaggacttcgccgctggcagaaaatctatcgcgctggatctcgtcacggaaattgggcgcgtgccctcccacctggcccatagaacccggaatgctcttgacaacctggtcatgctccacacaagcgagcatggaggcaaggcctaccgccacgccgtggaggaactgcctgagaccatggaaacactgctccttctgggcctgatgatcctcctgaccgggggagctatgctttttctgatttccggcaaagggatcggaaagacgtctatcggcctcatttgtgttatcgccagctccgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacaaaacgggacctcggcatgtctaaggaacctggggtggtgtcccccaccagctacctggatgtcgacctgcaccccgcttctgcctggacgctctacgctgtggccacaaccgttatcacacctatgcttcgccataccattgagaatagcaccgctaacgtgtccctggccgcgatcgccaaccaggctgtcgtgctgatgggactcgacaaaggctggccgatttctaagatggatctgggggtcccccttctggccctcggatgctatagccaggtgaatcctctgacactgacggctgccgttctccttctgatcacccactacgccatcattggccccgggctgcaggcgaaagctacaagagaggcccaaaagcggaccgctgccggaatcatgaagaaccctacagtggacggcattatgaccatcgatctcgaccccgtcatttatgattccaaattcgaaaagcagctgggccaggtgatgcttctggttctctgtgccgtgcagctgctgctcatgagaacgtcttgggctctttgcgaggccctgacactggcgaccgggcctatcaccacactctgggaaggaagcccgggcaaattttggaataccacaatcgccgtctccatggctaacattttccgcgggagctacctggccggagctggccttgccttttctatcatgaagtccgtggggacgggaaaacggggcaccggcagccaaggggagacactgggagaaaagtggaagaaaaagctcaatcagctgtccagaaaagagttcgacctgtataagaaatctggcattaccgaggtggatcgcacagaagcgaaggaggggctcaaacggggagaaatcacccatcacgccgttagcagaggctccgctaaacttcagtggtttgtcgagcggaacatggtgacgcccgaagggcgcgtgattgacctgggatgtggcagaggcgggtggtcttactattgcgccggactgaagaaagtcaccgaggttcggggctacacaaaagggggacctggccatgaggaacccgtgcctatgagcacctacgggtggaatatcgtgaaactcatgtccggaaaggatgtcttctatctgcccccggagaaatgtgacacacttctgtgcgatattggcgaaagctctccttcccccatcgtggaggagagccgcaccatcagagttctcaagatggtggaaccctggctgaagaacaatcagttctgtattaaagtcctgaacccttacatgcccacagtgatcgagcacctcgaacggcttcaacgcaagcacggcgggatgctggttagaaatcctctgtctcggaactccacccatgagatgtattggattagcaatggaacgggcaacatcgtggcttctgtcaatatggtgagccgcctcctgcttaacagatttacaatgacccaccggagaccgaccattgaaaaagacgtggatctgggggccggaacacgccatgtcaacgctgagcccgagacgcctaatatggacgttatcggcgaacggatcaagagaattaaagaggaacacaactccacctggcactacgacgatgagaatccctataagacatgggcctaccatgggtcttatgaagtgaaggcgaccggaagcgcctccagcatgatcaacggcgtggtcaaactcctgacaaagccttgggacgtggttcccatggtgacccagatggctatgacagataccacgccgttcggccagcaacgcgtctttaaagagaaggtggacacccggacacctagatccatgcccgggacccgccgggttatgggaattacagccgagtggctgtggagaaccctcggccgcaataaaaagcctcggctgtgcacgagagaagagttcacaaagaaagtgcgcaccaacgctgccatgggggccgtctttacagaagagaatcagtgggattctgcgaaggctgccgtggaagacgaggatttctggaaacttgttgaccgggagagagaactgcacaagctcggaaaatgtggcagctgcgtgtacaacatgatggggaagcgcgagaaaaagctgggcgaatttggaaaggccaaaggctccagagctatctggtacatgtggcttggggcccggtatctggagttcgaggctctcggatttctgaatgaagatcattggttctctcgcgagaacagctactccggcgtcgaaggggagggactgcacaagctcggctatattctgagagacatctctaaaatccccgggggcgccatgtacgcggatgacaccgccggatgggacacgcggattaccgaagatgaccttcataatgaggagaagatcacacagcagatggatcctgaacacagacaactggctaacgccatttttaaactcacctatcagaataaggtggtcaaggtgcagcggcccacaccgaccggcacagttatggacatcattagccgcaaagatcagagagggtccggacaagtgggcacctacgggctgaacacgttcacaaatatggaggctcagcttatccggcagatggaaggagagggcgtcctgagcaaggccgacctcgaaaaccctcatctgcccgagaaaaagatcacccagtggctggagaccaaaggggtggaacgcctcaagagaatggcgatttctggcgatgactgcgtggttaagcccatcgatgaccggtttgccaacgctctgcttgccctgaatgatatgggaaaagtgcgcaaggacattcctcaatggcagccgtccaaaggctggcatgattggcagcaggtccccttctgtagccaccatttccacgagctcatcatgaaggacgggagaaaactggtggttccttgccggccccaagacgaacttattggacgcgctagaatctctcagggcgccgggtggtccctgcgggagacagcttgtctcggaaaggcctatgcgcagatgtggagcctgatgtactttcaccgcagagatctgcggctcgcctctaacgctatttgctccgccgtgcctgtccattgggtgcccaccagccgcacaacgtggtccatccacgcccatcaccaatggatgaccacagaagacatgctgaccgtctggaatagagtgtggatcgaggataacccttggatggaggacaagacacccgttaccacgtgggaaaatgtgccgtaccttggcaaacgggaggatcagtggtgtgggagcctgattggcctcacctctagagctacatgggcccagaacatccctaccgcgattcagcaagtccgcagcctgatcggaaatgaagagttccttgactatatgccctccatgaagcggtttagaaaagaggaagagtctgaaggcgctatttggtga

SEQ ID NO: 20449 - RNA, 9873 nt, synthetic construct
  misc_feature 1..9873: note = derived and/or modified CDS sequence (opt5) from DENV-3__GQ868572__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaggtcgaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacaactggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggttcataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtggatcgcacggaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttacatgcccacggtgatcgagcacctcgaacggcttcaacgcaagcacggcgggatgctggttagaaatcctctgtcccggaacagcacacatgagatgtattggatttctaatggaaccggcaacatcgtggcttccgtcaatatggtgagccgcctcctgcttaacagatttaccatgacacaccggagaccgacgattgaaaaagacgtggatctgggggccggaacccgccatgtcaacgctgagcccgagacacctaatatggacgttatcggcgaacggatcaagagaattaaagaggaacacaactctacctggcactacgacgatgagaatccctataagacatgggcctaccatgggagctatgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaatccccgggggcgccatgtacgcggatgacaccgccggatgggacacacggattaccgaagatgaccttcataatgaggagaagatcacacagcagatggatcctgaacacagacaactggctaacgccatttttaaactcacctatcagaataaggtggtcaaggtgcagcggcccacaccgaccggcacggttatggacatcatttcccgcaaagatcagagagggtctggacaagtgggcacatacgggctgaacaccttcaccaatatggaggctcagcttatccggcagatggaaggagagggcgtcctgagcaaggccgacctcgaaaaccctcatctgcccgagaaaaagatcacacagtggctggagaccaaaggggtggaacgcctcaagagaatggcgatttccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagacagcttgtctcggaaaggcctatgcgcagatgtggtctctgatgtactttcaccgcagagatctgcggctcgcctccaacgctatttgcagcgccgtgcctgtccattgggtgcccacgtctcgcaccacatggtccatccacgcccatcaccaatggatgaccacagaagacatgctgaccgtctggaatagagtgtggatcgaggataacccttggatggaggacaagacgcccgttaccacatgggaaaatgtgccgtaccttggcaaacgggaggatcagtggtgtgggagcctgattggcctcacctccagagctacatgggcccagaacatccctaccgcgattcagcaagtccgcagcctgatcggaaatgaagagttccttgactatatgccctctatgaagcggtttagaaaagaggaagagagcgaaggcgctatttggtga

SEQ ID NO: 20450 - RNA, 9873 nt, synthetic construct
  misc_feature 1..9873: note = derived and/or modified CDS sequence (opt5) from DENV-3__GQ868573__SS-prME
  source 1..9873: mol_type = other RNA
accagcttctgcctgatgatgatcctccccgccgctctggcctttcaccttacatcccgggacggcgaacctcggatgattgtggggaagaacgaacgcggaaagtctctgctgttcaagacggcgagcggcatcaatatgtgtaccctgattgctatggatcttggggaaatgtgcgacgatacagtcacctacaagtgtccgcacatcacagaagttgagcccgaagacattgattgctggtgtaacctgacctccacatgggtgacctatggaacgtgcaatcaggccggcgagcaccggcgggacaagcgctctgtggccctcgctcctcatgtcgggatgggactggataccagaacacagacctggatgagcgccgagggcgcttggagacaggtggaaaaggttgagacatgggccctgcgccaccccggctttaccatcctcgcgctgttccttgcccattacatcgggacgtccctgacacagaaggctgtgatttttatcctcctgatgcttgtcaccccttctatgacaatgagatgtgtgggagttggcaaccgggacttcgtggaagggctgagcggagccacctgggtcgatgtggtgctcgagcacggcgggtgcgtcaccacaatggctaagaataaacccacgctggacattgagctgcagaagaccgaagccacacaactcgcgaccctgcgcaaactttgtatcgagggaaagattacaaacatcaccacggattccagatgccctacacagggcgaagccgttctgccggaggaacaggaccagaattatgtgtgtaaacacacctacgtggatcggggctgggggaacggatgcggcctctttgggaagggaagcctggtgacctgcgctaagttccaatgtcttgagcccattgagggcaaagtggttcagtatgaaaatctgaagtacacagtgatcatcaccgtccatacaggggaccagcaccaggtgggaaacgagacgcaaggcgttaccgccgaaattacacctcaggcttctaccacagaggccatcctccccgaatatggcaccctggggctggagtgctcccctcgcacgggactcgactttaatgagatgattctgcttaccatgaaaaacaaggcctggatggtgcatagacagtggttctttgatctgcccctcccgtggacaagcggcgctaccacagaaacccctacgtggaatcggaaagagctgcttgtcacattcaagaacgcgcacgccaaaaagcaagaagtggtcgtgctggggtctcaggagggagctatgcacaccgccctcacaggcgccaccgaaatccaaaattccgggggcaccagcatttttgctggacatctgaagtgtcgcctgaaaatggacaagctcgagctgaaaggcatgtcttacgccatgtgcacaaacacgttcgttcttaagaaagaggtgtccgaaacccagcacgggacaatcctgatcaaggtcgagtacaagggagaagatgtgccctgtaaaattcctttcagcaccgaggacggccaagggaaggcgcataacggaagactcatcacagctaatcccgttgtgaccaaaaaggaggaacccgtcaacattgaggccgaacctccgtttggcgagtccaatatcgtgattgggatcggcgataacgccctgaaaatcaattggtataagaagggatctagcattggcaaaatgttcgaagctacggccagaggggctagacgcatggccatcctgggagacacagcgtgggattttggctccgtcgggggagttcttaacagcctcggcaagatggtccaccagattttcgggtctgcctacaccgctctgttttccggcgtgagctgggtgatgaaaatcggaattggcgtcctgctcacctggatcgggctcaattctaagaacacaagcatgtccttctcttgcattgccatcggaatcattaccctttatctgggcgctgtggttcaggccgacatggggtgtgtgatcaattggaaaggaaaggagctcaagtgcggcagcgggatttttgtcacaaacgaggtgcatacgtggaccgaacagtacaaattccaagcggattcccccaagcggctggccacagctatcgccggcgcttgggagaatggagtttgtggcattagaagcaccacacgcatggaaaacctgctttggaaacagatcgccaatgagctcaactatatcctgtgggaaaataacattaagctgaccgtggtcgtgggggacatcattggagttctcgagcagggcaaacggacgctgacccctcagcccatggagcttaagtactcttggaaaacatgggggaaggccaagatcgtgaccgctgaaacacaaaactccagctttattatcgatggacctaatacccccgagtgcccgtctgcgtccagagcctggaacgtctgggaagtggaggactatggcttcggcgtgtttacaaccaatatctggctgaaactccgcgaagtctacacgcagctgtgtgaccaccggctgatgagcgctgccgttaaggatgagagagccgtgcacgctgacatggggtactggattgagtcccagaaaaacggatcttggaaacttgaaaaagccagcctcatcgaggtgaagacatgcacctggcctaagtcccataccctgtggtctaatggcgtcctggaaagcgatatgattatccccaaatccctcgcggggcctattagccagcacaactatcgccccggataccatacacaaaccgctggcccttggcacctggggaaacttgagctggacttcaattattgcgagggaacgacagtggttatcaccgaaaactgtggcacacggggcccctctctcagaaccacaaccgtgtccgggaaactgatccacgagtggtgctgtcgcagctgcacgctgccgcctcttcggtacatgggagaagatggctgttggtatgggatggagattagacccatctctgaaaaggaggagaatatggtcaaatccctcgtgagcgccggatctggcgaagttgacaactttaccatgggggtgctgtgcctggccattctcttcgaggaagtcatgcggggaaagttcggcaagaaacatatgatcgctggcgtgtttttcacatttgttctgcttctgagcgggcagattacctggcgcgatatggcccacacactcatcatgattggatccaatgcgagcgacagaatgggcatgggggtgacctacctggctctgatcgccacgttcaagatccagccctttcttgccctgggattctttctccggaaactgacatctagagagaacctcctgcttggcgtcgggctggctatggccaccacactccaactgcctgaagatattgagcagatggctaatggaatcgccctgggccttatggcgctgaagctcattacccagttcgagacctatcagctgtggacagccctcatctccctgacgtgtagcaacaccatttttacacttaccgtggcttggcgcacagccaccctgatcctcgctggcgtgtccctgctgccggtctgccaatctagctccatgcggaaaacggactggcttcccatgacagttgccgccatggggctgcctcccctccctctgttcatcttttctctcaaggataccctgaagagacgcagctggccccttaatgaaggagtgatggctgtgggcctggtctccattctggcgtctagcctcctgagaaacgacgtgcctatggccgggccccttgttgctggaggcctgctcatcgcctgttacgtgattaccgggacatccgccgatctgaccgtcgagaaagctgccgacgtgacatgggaagaggaagcggagcagacgggagttagccataacctcatgatcaccgtggacgatgacggcacaatgcggattaaggatgacgagaccgaaaatatcctgacagtccttctgaaaaccgctctgctcatcgtgtctggcattttcccgtactccatccctgccacgctgcttgtctggcacacctggcagaagcagacacaacgcagcggggtgctgtgggatgttccctctcctcccgagacccagaaagccgaactcgaggagggagtgtatagaattaagcagcagggcatctttgggaaaacacaagtcggagtgggcgttcagaaggaaggggtgttccataccatgtggcacgtcacacggggagctgtgctgacgtacaacggcaagcgcctcgagccgaattgggcctccgtgaaaaaggacctgattagctatggcgggggatggagactttctgcgcagtggcaaaaaggcgaagaggttcaggtcatcgctgtggaacctgggaagaaccccaaaaatttccagaccatgcctggaacatttcagaccaccacaggcgagattggggccatcgccctggatttcaagcccggaacgtccggcagccccatcattaaccgggagggcaaggtggtcgggctgtacggaaatggcgtggttaccaaaaacgggggatatgtgtccggcatcgctcaaacaaatgccgaacctgacgggccgacccccgagctcgaagaggaaatgtttaagaaacgcaacctgacaattatggatcttcaccctggcagcggaaagaccagaaaatacctgcccgctatcgtccgggaggccattaagcgcagactccggacgctgatcctcgcgcctacaagagtggttgccgctgagatggaagaggccctgaagggccttcccatccgctatcagaccaccgctacaaaatctgaacataccgggcgggagattgtggacctgatgtgccacgccacattcaccatgagactgctcagccctgtccgcgtgccgaattacaacctgatcattatggatgaagcccattttacggaccccgcttccatcgcggcccggggatacatttctacaagagttggcatgggggaggctgccgccatcttcatgaccgctacacctcccggaaccgccgatgcgtttcctcagagcaatgctcccatccaggacgaggaacgcgacattccggagcggtcctggaactctggcaatgaatggatcacggatttcgccgggaagaccgtgtggtttgtccctagcattaaagccggcaacgacatcgctaactgtcttagaaagaatggaaagaaggtgattcaactgtcccgcaagacattcgataccgagtatcagaaaacaaagctcaacgactgggattttgtggtcaccacagacatctctgagatgggcgccaatttcaaagcggatcgggttattgaccccagacggtgcctgaagcccgtgatcctgaccgatgggcctgaacgcgtgatcctcgccggacccatgcctgtcacggctgccagcgctgcccagagacggggccgcgtggggagaaacccgcagaaagagaatgaccaatacattttcacaggacagccccttaacaatgatgaagaccacgctcattggaccgaggccaagatgctgctggacaacatcaatacccctgaaggcattatccccgcgctctttgagcctgagcgggaaaagtccgccgctattgatggggagtatagactgaaaggcgaaagccgcaagacattcgttgagcttatgcggagaggagacctgcccgtgtggctcgcccacaaagtcgcttctgaaggcatcaagtacaccgatcgcaaatggtgctttgacgggcagcggaacaatcagatcctggaggagaacatggatgtggaaatttggacaaaggagggagagaagaagaagctgagaccgcgctggctcgacgcccggacgtattccgatcctcttgccctgaaagagttcaaggactttgctgcgggcagaaaaagcatcgccctggatctcgttaccgaaattgggcgcgtgcccacacacctggctcatagaacccggaatgcccttgacaacctggtcatgctccacacatctgagcatggaggcaaggcctaccgccacgctgtggaggaactgcctgagaccatggaaacgctgctccttctgggcctgatgatcctcctgaccgggggagccatgcttttcctgatttccggcaaagggatcggaaagacaagcatcggcctcatttgtgtcatcgcgtcctctgggatgctgtggatggccgagattcccctgcaatggatcgctagcgccattgtgctcgagtttttcatgatggttcttctgatccctgaacccgagaagcagagaaccccgcaggataatcaactggcttatgtggtgattggaatcctcacactggccgcgatcattgccgctaacgaaatgggccttctggagaccacgaaacgggacctcggcatgtccaaggaacctggggtcgttagccccacatcttacctggatgtggacctgcaccccgcctccgcttggaccctctacgccgtggctacaaccgtcatcacccctatgcttcgccatacaattgagaatagcacggccaacgtgtctctggcggccatcgctaaccaggccgttgtgctgatgggactcgacaaaggctggccgattagcaagatggatctgggggtcccccttctggctctcggatgctattcccaggtgaatcctctgaccctgacagccgccgtcctccttctgatcacccactacgcgatcattggccccgggctgcaggctaaagccacaagagaggctcaaaagcggaccgccgccggaatcatgaagaaccctacggtggacggcattatgacaatcgatctcgaccccgttatttatgattctaaatttgaaaagcagctgggccaggtgatgcttctggtcctctgtgctgtgcagctgctgctcatgagaaccagctgggccctttgcgaggcgctgaccctggccacagggcctatcaccacactctgggaaggatccccgggcaaattctggaatacgaccatcgctgtttctatggccaacatttttcgcgggagctacctggctggagccggccttgcgttctccatcatgaaaagcgtggggacaggaaaacggggcaccggctctcaaggggagacactgggagaaaagtggaagaaaaagctcaatcagctgtccagaaaagagtttgacctgtataagaaaagcggcattaccgaggtcgatcgcacggaagccaaggaggggctcaaacggggagaaatcacccatcacgctgtgtccagaggctctgccaaacttcagtggttcgtggagcggaacatggttattcccgaagggcgcgtcatcgacctgggatgtggcagaggcgggtggagctactattgcgctggactgaagaaagtgacagaggtgcggggctacaccaaagggggacctggccatgaggaacccgtccctatgtccacatacgggtggaatattgttaaactcatgtctggaaaggatgtgttctatctgcccccggagaaatgtgacacccttctgtgcgatatcggcgaaagctcccctagccccacagtggaggagtctcgcaccatcagagtcctcaagatggtggaaccctggctgaagaacaatcagttttgtattaaagttctgaacccttacatgcccacggtgatcgagcacctcgaacggcttcaacgcaagcacggcgggatgctggtcagaaatcctctgtcccggaacagcacacatgagatgtattggatttctaatggaaccggcaacatcgtggcctccgttaatatggtgagccgcctcctgcttaacagattcaccatgacacaccggagaccgacgattgaaaaagacgtcgatctgggggctggaacccgccatgtgaacgccgagcccgagacacctaatatggacgtgatcggcgaacggatcaagagaattaaagaggaacacaactctacctggcactacgacgatgagaatccctataagacatgggcgtaccatgggagctatgaagtcaaggccaccggatccgcttctagcatgatcaacggcgttgtgaaactcctgacaaagccttgggacgtggtccccatggtgacccagatggccatgacggataccacaccgtttggccagcaacgcgttttcaaagagaaggtggacacccggacacctagatccatgcccgggacccgccgggtcatgggaattacggctgagtggctgtggagaacactcggccgcaataaaaagcctcggctgtgcaccagagaagagtttacaaagaaagtgcgcaccaacgccgccatgggggcggttttcacggaagagaatcagtgggatagcgctaaggccgccgtggaagacgaggatttttggaaacttgtcgaccgggagagagaactgcacaagctcggaaaatgtggctcctgcgtgtacaacatgatggggaagcgcgagaaaaagctgggcgagttcggaaaggctaaaggctctagagccatctggtacatgtggcttggggctcggtatctggagtttgaggccctcggattcctgaatgaagatcattggtttagccgcgagaactcctactctggcgttgaaggggagggactgcacaagctcggctatattctgagagacatcagcaaaatccccgggggcgcgatgtacgccgatgacaccgctggatgggacacacggattaccgaagatgaccttcataatgaggagaagatcacacagcagatggatcctgaacacagacaactggccaacgctattttcaaactcacctatcagaataaggtggtcaaggtgcagcggcccacaccgaccggcacggtcatggacatcatttcccgcaaagatcagagagggtctggacaagtgggcacatacgggctgaacacctttaccaatatggaggcccagcttatccggcagatggaaggagagggcgttctgagcaaggcggacctcgaaaaccctcatctgcccgagaaaaagatcacacagtggctggagaccaaaggggtggaacgcctcaagagaatggccatttccggcgatgactgcgtcgtgaagcccatcgatgaccggttcgctaacgccctgcttgctctgaatgatatgggaaaagtgcgcaaggacattcctcaatggcagccgagcaaaggctggcatgattggcagcaggttcccttctgttctcaccattttcacgagctcatcatgaaggacgggagaaaactggtggtcccttgccggccccaagacgaacttattggacgcgccagaatctcccagggcgctgggtggagcctgcgggagacagcctgtctcggaaaggcgtatgcccagatgtggtctctgatgtacttccaccgcagagatctgcggctcgcttccaacgccatttgcagcgccgtgcctgttcattgggtgcccacgtctcgcaccacatggtccatccacgctcatcaccaatggatgaccacagaagacatgctgaccgtctggaatagagtgtggatcgaggataacccttggatggaggacaagacgcccgtcaccacatgggaaaatgtgccgtaccttggcaaacgggaggatcagtggtgtgggagcctgattggcctcacctccagagccacatgggcgcagaacatccctaccgctattcagcaagttcgcagcctgatcggaaatgaagagtttcttgactatatgccctctatgaagcggttcagaaaagaggaagagagcgaaggcgccatttggtga

SEQ ID NO: 20451 - RNA, 9873 nt, synthetic construct
  misc_feature 1..9873: note = derived and/or modified CDS sequence (opt5) from DENV-3__GQ868574__SS-prME
  source 1..9873: mol_type = other RNA
accagcctctgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacaactggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgacttttcttattgcgagggaacgacagtggttatcaccgaaaattgtggcacacggggcccctccctgagaaccacaaccgtgagcgggaaactgatccacgagtggtgctgtcgctcttgcacgcttccgcctctccggtacatgggagaagatggctgttggtatgggatggagattagacccatctccgaaaaggaggagaacatggtcaaaagcctggtgtctgccggaagcggcgaagttgacaatttcaccatgggggtgctgtgcctcgccattctgtttgaggaagtcatgcggggaaagttcggcaagaaacatatgatcgctggcgtgttctttacattcgttcttctgctctccgggcagattacctggcgcgatatggcccacacactgatcatgattggaagcaacgcgtctgacagaatgggcatgggggtgacctacctggctcttatcgccacgtttaagatccagcccttcctggccctcggatttttcctgcggaaactcacatccagagagaatctgcttctgggcgtcgggctcgctatggccaccacactgcaactgcctgaagatattgagcagatggctaacggaatcgcccttggcctgatggcgctcaagctgattacccagtttgagacctatcagctctggacagccctgatcagccttacgtgttccaataccattttcacactgaccgtggcttggcgcacagccaccctcatcctggctggcgtgtctctgcttccggtctgccaaagctcctctatgcggaaaacggactggctgcccatgacagttgccgccatgggggtgcctcccctccctctgtttatcttcagcctcaaggataccctgaagagacgctcctggccccttaacgaaggagtgatggctgtcggcctggtgtctattctggcgagctccctcctgagaaatgacgttcctatggccgggccccttgtggctggaggcctgctcatcgcctgttacgtcattaccgggacaagcgccgatctgaccgtggagaaagctgccgacgttacatgggaagaggaagcggagcagacgggagtgtctcataacctcatgatcaccgtcgacgatgacggcacaatgcggattaaggatgacgagaccgaaaacatcctgacagtgcttctgaaaaccgctctgctcatcgtctccggcatttttccgtacagcatccctgccacgctgcttgtgtggcacacctggcagaagcagacacaacgctctggggttctgtgggatgtgccctcccctcccgagacccagaaagccgaactcgaggagggagtctatagaattaagcagcagggcatcttcgggaaaacacaagtgggagttggcgtgcagaaggaaggggtctttcataccatgtggcacgtgacacggggagctgtgctgacgtacaatggcaagcgcctcgagccgaactgggccagcgttaaaaaggacctgatttcttatggcgggggatggagactttccgcgcagtggcaaaaaggcgaagaggtccaggtgatcgctgtggaacctgggaagaatcccaaaaacttccagaccatgcctggaacattccagaccaccacaggcgagattggggccatcgccctggattttaagcccggaacgagcggctcccccatcattaatcgggagggcaaggtcgtggggctgtacggaaacggcgttgtgaccaaaaatgggggatatgtcagcggcatcgctcaaacaaacgccgaacctgacgggccgacccccgagctcgaagaggaaatgttcaagaaacgcaatctgacaattatggatcttcaccctggctctggaaagaccagaaaatacctgcccgctatcgtgcgggaggccattaagcgcagactccggacgctgatcctcgcgcctacaagagttgtggccgctgagatggaagaggccctgaagggccttcccatccgctatcagaccaccgctacaaaaagcgaacataccgggcgggagattgtcgacctgatgtgccacgccacatttaccatgagactgctctcccctgtgcgcgttccgaactacaatctgatcattatggatgaagcccatttcacggaccccgcttctatcgcggcccggggatacattagcacaagagtgggcatgggggaggctgccgccatctttatgaccgctacacctcccggaaccgccgatgcgttccctcagtccaacgctcccatccaggacgaggaacgcgacattccggagcggtcttggaatagcggcaacgaatggatcacggattttgccgggaagaccgtctggttcgtgccttccattaaagccggcaatgacatcgctaactgtcttagaaagaacggcaaaaaggtgattcaactgtctcgcaagacatttgataccgagtatcagaaaacaaagctcaatgactgggatttcgtcgttaccacagacatcagcgagatgggagccaactttaaagcggatcgggtgattgaccccagacggtgcctgaagcccgtgatcctgaccgatgggcctgaacgcgtcatcctcgccggacccatgcctgtgacggctgcctccgctgcccagagacggggccgcgttgggagaaatccgcagaaagagaacgaccaatacattttcacaggacagccccttaataacgatgaagaccacgctcattggaccgaggccaagatgctgctggacaatatcaacacccctgaaggcattatccccgccctcttcgagcctgagcgggaaaagagcgccgctattgatggggagtatagactgaaaggcgaatctcgcaagacatttgtggagcttatgcggagaggagacctgcccgtctggctcgcccacaaagtggcttccgaaggcatcaagtacaccgatcgcaaatggtgcttcgacgggcagcggaataaccagatcctggaggagaatatggatgttgaaatttggacaaaggagggagagaagaagaagctgagaccgcgctggctcgacgcccggacgtatagcgatcctcttgccctgaaagagtttaaggacttcgctgcgggcagaaaatctatcgccctggatctcgtgaccgaaattgggcgcgtccccacacacctggctcatagaacccggaacgcccttgacaatctggtgatgctccacacatccgagcatggaggcaaggcctaccgccacgctgtcgaggaactgcctgagaccatggaaacgctgctccttctgggcctgatgatcctcctgaccgggggagccatgctttttctgattagcggcaaagggatcggaaagacatccatcggcctcatttgtgtgatcgcgtctagcgggatgctgtggatggccgagattcccctgcaatggatcgcttccgccattgttctcgagttctttatgatggtgcttctgatccctgaacccgagaagcagagaaccccgcaggataaccaactggcttatgtggtcattggaatcctcacactggccgcgatcattgccgctaatgaaatgggcatgcttgagaccacgaaacgggacctgggcatgagcaaggaacctggggttgcctctcccacatcctacctcgatgtggacctgcaccccgctagcgcctggaccctgtacgctgtggccacaaccgtcatcacccctatgctccgccatacaattgagaactctacggcgaatgtgagccttgccgctatcgccaaccaggctgttgtgctgatgggactggacaaaggctggccgatttccaagatggatctcggggtccccctgcttgccctgggatgctattctcaggtgaaccctctcaccctgacagccgcggtcctgctccttatcacccactacgctatcattggccccgggctgcaggccaaagctacaagagaggcccaaaagcggaccgccgctggaatcatgaagaatcctacggtggacggcattatgacaatcgatctggaccccgttatttatgatagcaaattcgaaaagcagctcggccaggtgatgctgcttgtcctgtgtgccgtgcagctcctgctgatgagaacctcctgggcgctctgcgaggcccttaccctggctacagggcctatcaccacactgtgggaaggatctccgggcaaattttggaacacgaccatcgccgttagcatggctaatattttccgcgggtcctacctcgccggagcgggcctggcctttagcatcatgaagtctgtggggacaggaaaacggggcaccggctcccaaggggagacacttggagaaaagtggaagaaaaagctgaaccagctcagcagaaaagagttcgacctgtataagaaatccggcattaccgaggtcgatcgcacggaagctaaggaggggctgaaacggggagaaatcacccatcacgccgtgtctagaggcagcgctaagctccagtggtttgtggagcggaatatggttattcccgaagggcgcgtcatcgaccttggatgtggcagaggcgggtggtcctactattgcgccggactgaagaaagtgacagaggtgcggggctacaccaaagggggacctggccatgaggaacccgtccctatgtctacatacgggtggaacattgttaaactgatgagcggaaaggatgtgttctatctgcccccggagaaatgtgacaccctgctttgcgatatcggcgaatccagcccttctcccacagtggaggagtcccgcaccatcagagtcctgaagatggtggaaccctggctcaagaataaccagttctgtattaaagttctgaatccttacatgcccacggtgatcgagcacctggaacggctccaacgcaagcacggcgggatgcttgtcagaaaccctctgagcagaaattctacacatgagatgtattggatttccaacggaaccggcaatatcgtggctagcgttaacatggtgtctcgcctgctcctgaatagatttaccatgacacaccggagaccgacgattgaaaaagacgtcgatcttggggccggaacccgccatgtgaacgcggagcccgagacacctaacatggacgtgatcggcgaacggatcaagagaattaaagaggaacacaatagcacctggcactacgacgatgagaacccctataagacatgggcctaccatgggtcctatgaagtcaaggctaccggatctgccagctccatgatcaatggcgttgtgaaactgctcacaaagccttgggacgtggtccccatggtgacccagatggctatgacggataccacaccgttcggccagcaacgcgtttttaaagagaaggtggacacccggacacctagaagcatgcccgggacccgccgggtcatgggaattacggccgagtggctgtggagaacactgggccgcaacaaaaagcctcggctctgcaccagagaagagttcacaaagaaagtgcgcaccaatgccgcgatgggggctgtttttacggaagagaaccagtgggattccgccaaggccgctgtggaagacgaggatttctggaaactggtcgaccgggagagagaacttcacaagctgggaaaatgtggctcttgcgtgtacaatatgatggggaagcgcgagaaaaagctcggcgaatttggaaaggccaaaggcagcagagctatctggtacatgtggctgggggcccggtatcttgagttcgaggcgctgggatttctcaacgaagatcattggttctcccgcgaaaattcttacagcggcgttgagggggagggactgcacaagctgggctatattctcagagacatctccaaaatccccgggggcgccatgtacgctgatgacaccgccggatgggacacacggattaccgaagatgacctgcataacgaggagaagatcacacagcagatggatcctgaacacagacaacttgctaatgccatttttaaactgacctatcagaacaaggtggtcaaggtgcagcggcccacaccgaccggcacggtcatggacatcatttctcgcaaagatcagagagggagcggacaagtgggcacatacgggctcaataccttcaccaacatggaggcgcagctgatccggcagatggaaggagagggcgttctttccaaggccgacctggaaaatcctcacctccccgagaaaaagatcacacagtggctggagaccaaaggggtggaacgcctgaagagaatggctattagcggcgatgactgcgtcgtgaagcccatcgatgaccggtttgccaacgctctcctggcccttaacgatatgggaaaagtgcgcaaggacattcctcaatggcagccgtctaaaggctggcatgattggcagcaggttcccttctgttcccaccatttccacgagctgatcatgaaggacgggagaaaactcgtggtcccttgccggccccaagacgaactgattggacgcgctagaatcagccagggcgccgggtggtctcttcgggagacagcgtgtctgggaaaggcctatgctcagatgtggtccctcatgtactttcaccgcagagatctgcggctggccagcaatgccatttgctctgctgtgcctgttcattgggtgcccacgtcccgcaccacatggagcatccacgcccatcaccaatggatgaccacagaagacatgctcaccgtctggaacagagtgtggatcgaggataatccttggatggaggacaagacgcccgtcaccacatgggaaaacgtgccgtacctgggcaaacgggaggatcagtggtgtgggtcccttattggcctgaccagcagagcgacatgggctcagaatatccctaccgccattcagcaagttcgctctctcatcggaaacgaagagttcctggactatatgcccagcatgaagcggtttagaaaagaggaagagtccgaaggcgccatttggtga

SEQ ID NO: 20452 - RNA, 9873 nt, synthetic construct
  misc_feature 1..9873: note = derived and/or modified CDS sequence (opt5) from DENV-3__GQ868575__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacaactggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtcacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccagaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaacttctcctttattatcgatggacctaatacccccgagtgcccgagcgcgtctagagcctggaacgtctgggaagtggaggactatggcttcggcgtgtttacaaccaatatctggctcaaactgcgcgaagtctacacgcagctgtgtgaccaccggcttatgtccgctgccgttaaggatgagagagccgtgcacgctgacatggggtactggattgagagccagaaaaacggatcctggaagctcgaaaaagcctctctgatcgaggtgaagacatgcacctggcctaagagccataccctgtggtccaatggcgtcctcgaatctgatatgattatccccaaaagcctggcggggcctatttcccagcacaactatcgccccggataccatacacaaaccgctggcccttggcaccttgggaagctggagctcgacttcaattattgcgagggaacgacagtggttatcaccgaaaactgtggcacacggggccccagcctgagaaccacaaccgtgtctgggaaactgatccacgagtggtgctgtcgctcctgcacgcttccgcctctccggtacatgggagaagatggctgttggtatgggatggagattagacccatcagcgaaaaggaggagaatatggtcaaatctctggtgtccgccggaagcggcgaagttgacaactttaccatgggggtgctgtgcctcgccattctgttcgaggaagtcatgcggggaaagttcggcaagaaacatatgatcgctggcgtgtttttcacatttgttcttctgctctctgggcagattacctggcgcgatatggcccacacactgatcatgattggaagcaatgcgtccgacaagatgggcatgggggtgacctacctggctcttatcgccacgttcaaaatccagccctttctggccctcggattctttctgagaaagctcacaagccgggagaacctgcttctgggcgtcgggctcgctatggccaccacactgcaactgcctgaagatattgagcagatggctaatggaatcgcccttggcctgatggcgctcaaactgattacccagttcgagacctatcagctctggacagccctgatctctcttacgtgttccaacaccatttttacactgaccgtggcttggagaacagccaccctcatcctggctggcgtgagcctgcttccggtctgccaatcctctagcatgcgcaagacggactggctgcccatgacagttgccgccatgggggtgcctcccctccctctgttcatctttggactcaaggataccctgaaacggagatcctggccccttaatgaaggcgtgatggctgtcgggctggtgtctattctggcgagctccctcctgcgcaacgacgttcctatggccggaccccttgtggctggcgggctgctcatcgcctgttacgtcattaccggaacatctgccgatctgaccgtggagaaggctgccgacgttacatgggaagaggaagcggagcagacgggcgtgagccataacctcatgatcaccgtcgacgatgacggcacaatgagaattaaagatgacgagaccgaaaatatcctgacagtgcttctgaagaccgctctgctcatcgtctccgggattttcccgtacagcatccctgccacgctgcttgtgtggcacacctggcagaaacagacacaacggtctggagttctgtgggatgtgccctcccctcccgagacccagaaggccgaactcgaggagggcgtctatcgcattaaacagcaggggatctttggaaagacacaagtgggcgttggggtgcagaaggaaggagtcttccataccatgtggcacgtgacaagaggcgctgtgctgacgtacaacggcaaacggctcgagccgaattgggccagcgttaagaaagacctgatttcttatgggggaggctggcgcctttccgcgcagtggcaaaagggggaagaggtccaggtgatcgctgtggaacctggaaaaaaccccaagaatttccagaccatgcctggcacatttcagaccaccacaggggagattggagccatcgccctggatttcaagcccggcacgagcggctctcccatcattaacagagaggggaaagtcgtgggactgtacggcaatggggttgtgaccaagaacggaggctatgtctccgggatcgctcaaacaaatgccgaacctgacggcccgacccccgagctcgaagaggaaatgtttaaaaagcggaacctgacaattatggatcttcaccctggaagcggcaaaacccgcaagtacctgcccgctatcgtgagagaggccattaagcggcgcctcagaacgctgatcctcgcgcctacacgggttgtggccgctgagatggaagaggccctgaaagggcttcccatcagatatcagaccaccgctacaaagtccgaacataccggacgcgagattgtcgacctgatgtgccacgccacattcaccatgcggctgctcagccctgtgagagttccgaattacaacctgatcattatggatgaagcccattttacggaccccgcttctatcgcggcccgcggctacattagcacacgggtggggatgggagaggctgccgccatcttcatgaccgctacacctcccggcaccgccgatgcgtttcctcagtccaatgctcccatccaggacgaggaaagagacattccggagcgctcttggaacagcgggaatgaatggatcacggatttcgccggcaaaaccgtctggtttgtgccttccattaaggccggaaacgacatcgctaactgtcttcggaaaaatggcaagaaggtgattcaactgtctagaaaaacattcgataccgagtatcagaagacaaaactcaacgactgggattttgtcgttaccacagacatcagcgagatgggggccaatttcaaggcggatcgcgtgattgacccccggagatgcctgaaacccgtgatcctgaccgatggacctgaacgggtcatcctcgccggccccatgcctgtgacggctgcctccgctgcccagcgcagagggcgggttggacgcaacccgcagaaggagaatgaccaatacattttcacaggccagccccttaacaatgatgaagaccacgctcattggaccgaggccaagatgctgctggacaacatcaatacccctgaagggattatccccgcgctctttgagcctgagagagaaaaatctgccgctattgatggcgagtatcggctgaagggagaaagcagaaaaacattcgtggagcttatgcgccggggcgacctgcccgtctggctcgcccacaaggtggcttccgaagggatcaaatacaccgatagaaagtggtgctttgacggacagcgcaacaatcagatcctggaggagaacatggatgttgaaatttggacaaaagagggcgaaaagaagaaactgcggccgagatggctcgacgcccgcacgtatagcgatcctcttgccctgaaggagttcaaagactttgctgcggggcggaagtctatcgccctggatctcgtgaccgaaattggaagagtccccacacacctggctcatcgcaccagaaatgcccttgacaacctggtgatgctccacacatccgagcatggcggcaaagcctaccggcacgctgtcgaggaactgcctgagaccatggaaacgctgctccttctggggctgatgatcctcctgaccggaggcgccatgcttttcctgattagcgggaagggaatcggcaagacatctatcgggctcatttgtgtgatcgcgtccagcggaatgctgtggatggccgagattcccctgcaatggatcgcttccgccattgttctcgagtttttcatgatggtgcttctgatccctgaacccgagaaacagcgcaccccgcaggataatcaactggcttatgtggtcattggcatcctcacactggccgcgatcattgccgctaacgaaatgggccttctggagaccacgaagagagacctcgggatgtctcgggaacctggagttgtgagccccacatcctacctggatgtggacctgcaccccgccagcgcttggaccctctacgccgtcgctacaaccgtgatcacccctatgcttcgccatacaattgagaattctacggccaacgtttccctggcggccatcgctaaccaggccgtggtcctgatgggcctcgacaaagggtggccgattagcaagatggatctgggagtgccccttctggctctcggctgctattctcaggtcaatcctctgaccctgacagccgccgtgctccttctgatcacccactacgcgatcattgggcccggactgcaggctaaagccacaagagaggctcaaaagcggaccgccgccggcatcatgaagaaccctacggttgacggcattatgacaatcgatctcgaccccgtgatttatgatagcaaatttgaaaagcagctggggcaggtcatgcttctggtgctctgtgctgttcagctgctgctcatgagaacctcctgggccctttgcgaggcgctgaccctggccacaggacctatcaccacactctgggaaggctctccggggaaattctggaatacgaccatcgctgtgagcatggccaacatttttcgcggatcctacctggctggcgccgggcttgcgttctctatcatgaagagcgtcggaacaggcaaacggggcaccgggtcccaaggagagacactgggcgaaaagtggaagaaaaagctcaatcagctgagcagaaaagagtttgacctgtataagaaatctgggattaccgaggtggatcgcacggaagccaaggagggactcaaacggggcgaaatcacccatcacgctgtgtccagagggagcgccaagcttcagtggttcgttgagcggaacatggtcattcccgaaggacgcgtgatcgacctgggctgtggcagagggggatggtcctactattgcgctggcctgaagaaagtgacagaggtccgggggtacaccaagggaggccctgggcatgaggaacccgttcctatgtctacatacggatggaatattgtgaaactcatgagcggcaaggatgtgttctatctgcccccggagaaatgtgacacccttctgtgcgatatcggcgaatcctctcctagccccacagtcgaggagtcccgcaccatcagagtgctcaagatggttgaaccctggctgaagaacaatcagttttgtattaaagtgctgaacccttacatgcccacggtcatcgagcacctcgaacggcttcaacgcaagcacgggggaatgctggtgagaaatcctctgagccggaactctacacatgagatgtattggatttccaatggcaccgggaacatcgttgccagcgtgaatatggtctctcgcctcctgcttaacagattcaccatgacacaccggagaccgacgattgaaaaagacgtggatctgggagctggcacccgccatgtgaacgccgagcccgagatccctaatatggacgtcatcggggaacggattaagagaatcaaagaggaacacaactccacatggcactacgacgatgagaatccctataagacctgggcgtaccatggaagctatgaagttaaggccacaggctctgctagctccatgattaacggcgtggtgaaactcctgaccaagccttgggacgtcgtgcccatggttacacagatggccatgaccgatacgaccccgtttgggcagcaacgcgtgttcaaagagaaggtcgacacacggacccctagatctatgcccggaacacgccgggtgatgggcatcaccgctgagtggctgtggagaacgctcgggcgcaataaaaagcctcggctgtgcacaagagaagagtttaccaagaaagttcgcacaaacgccgccatgggagcggtgttcaccgaagagaatcagtgggatagcgctaaggccgccgtcgaagacgaggatttttggaaacttgtggaccgggagagagaactgcacaagctcggcaaatgtgggtcctgcgtttacaacatgatgggcaagcgcgagaaaaagctgggagaattcggcaaggctaaagggagcagagccatttggtacatgtggcttggagctcggtatctggagtttgaggccctcggcttcctgaatgaagatcattggttttcccgcgagaactcttacagcggggtggaaggagagggcctgcacaagctcgggtatatcctgagagacatctccaaaattcccggcggagcgatgtacgccgatgacacggctggctgggacacccggatcacagaagatgaccttcataatgaggagaagattacccagcagatggatcctgaacacagacaactggccaacgctatcttcaaactcacatatcagaataaggtcgtgaaggtccagcggcccaccccgacagggaccgtgatggacattatctctcgcaaagatcagagaggaagcggccaagttgggacgtacggactgaacacatttaccaatatggaggcccagcttatccggcagatggaaggcgagggggtgctgtccaaggcggacctcgaaaaccctcacctgcccgagaaaaagattacccagtggctggagacaaaaggcgtcgaacgcctcaagagaatggccatctctggagatgactgcgtggtgaagcccattgatgaccggttcgctaacgccctgcttgctctgaatgatatgggcaaagttcgcaaggacatccctcaatggcagccgagcaaagggtggcatgattggcagcaggtgcccttctgttcccaccattttcacgagctcattatgaaggacggaagaaaactggtcgtgccttgccggccccaagacgaacttatcggccgcgccagaattagccagggggctggatggtctctgcgggagaccgcctgtctcggcaaggcgtatgcccagatgtggtccctgatgtacttccaccgcagagatctgcggctcgctagcaacgccatctgctctgccgttcctgtgcattgggtccccacatcccgcacgacctggagcatccacgctcatcaccaatggatgacaaccgaagacatgctgacagtgtggaatagagtctggattgaggataacccttggatggaggacaagacccccgtgacgacctgggaaaatgttccgtaccttgggaaacgggaggatcagtggtgtggctctctgatcggactcacatccagagccacctgggcgcagaacattcctacagctatccagcaagtgcgcagcctgattggcaatgaagagtttcttgactatatgccctccatgaagcggttcagaaaagaggaagagagcgaaggggccatctggtga

SEQ ID NO: 20453 - RNA, 9873 nt, synthetic construct
  misc_feature 1..9873: note = derived and/or modified CDS sequence (opt5) from DENV-3__GU131953__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacaactggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtcacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccagaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatgcggtcctcgaaagcgatatgattatccccaaatccctggctggccctattagccagcacaactatcgccccgggtaccatacacaaaccgccggaccttggcaccttggcaagctggagctcgactttaattattgcgaggggacgacagtggttatcaccgaaaactgtggaacacggggcccctctctgagaaccacaaccgtgtccggcaaactgatccacgagtggtgctgtcgcagctgcacgcttccgcctctccggtacatgggggaagatggatgttggtatggcatggagattagacccatctctgaaaaggaggagaatatggtcaaatccctggtgagcgccgggtctggagaagttgacaacttcaccatgggcgtgctgtgcctcgctattctgtttgaggaagtcatgcgggggaagttcggaaagaaacatatgatcgccggcgtgttctttacattcgttcttctgctcagcggccagattacctggcgcgatatggcgcacacactgatcatgattgggtccaatgctagcgacagaatgggaatgggcgtgacctacctggcccttatcgccacgtttaagatccagcccttcctggctctcgggtttttcctgcggaaactcacatctagagagaacctgcttctgggagtcggcctcgccatggctaccacactgcaactgcctgaagatattgagcagatggccaatgggatcgcgcttggactgatggccctcaagctgattacccagtttgagacctatcagctctggacagctctgatctcccttacgtgtagcaacaccattttcacactgaccgtggcctggcgcacagctaccctcatcctggccggcgtgtccctgcttccggtctgccaatctagctccatgcggaaaacggactggctgcccatgacagttgccgctatgggcgtgcctcccctccctctgtttatcttctctctcaaggataccctgaagagacgcagctggccccttaatgaaggggtgatggcggtcggactggtgtccattctggcctctagcctcctgagaaacgacgttcctatggctggcccccttgtggccgggggactgctcatcgcctgttacgtcattaccggcacatccgctgatctgaccgtggagaaagccgcggacgttacatgggaagaggaagctgagcagacgggggtgagccataacctcatgatcaccgtcgacgatgacggaacaatgcggattaaggatgacgagaccgaaaatatcctgacagtgcttctgaaaaccgccctgctcatcgtctctggcatttttccgtactccatccctgccacgctgcttgtgtggcacacctggcagaagcagacacaacgcagcggcgttctgtgggatgtgccctctcctcccgagacccagaaagctgaactcgaggagggggtctatagaattaagcagcagggaatcttcggcaaaacacaagtgggggttggagtgcagaaggaaggcgtctttcataccatgtggcacgtgacacggggggccgtgctgacgtacaacggaaagcgcctcgagccgaattgggcgtccgttaaaaaggacctgattagctatggcggcgggtggagactttctgctcagtggcaaaaaggagaagaggtccaggtgatcgccgtggaacctggcaagaaccccaaaaatttccagaccatgcctgggacattccagaccaccacaggagagattggcgccatcgctctggattttaagcccgggacgtccggaagccccatcattaaccgggagggcaaggtcgtgggcctgtacgggaatggagttgtgaccaaaaacggcgggtatgtctccggaatcgcccaaacaaatgctgaacctgacggcccgacccccgagctcgaagaggaaatgttcaagaaacgcaacctgacaattatggatcttcaccctgggagcggcaagaccagaaaatacctgcccgccatcgtgcgggaggcgattaagcgcagactccggacgctgatcctcgcccctacaagagttgtggctgccgagatggaagaggctctgaagggacttcccatccgctatcagaccaccgccacaaaatctgaacataccggccgggagattgtcgacctgatgtgccacgccacatttaccatgagactgctcagccctgtgcgcgttccgaattacaacctgatcattatggatgaagctcatttcacggaccccgcgtccatcgccgctcgggggtacatttctacaagagtgggaatgggcgaggccgccgctatctttatgaccgccacacctcccgggaccgcggatgctttccctcagagcaatgcccccatccaggacgaggaacgcgacattccggagcggtcctggaactctggaaatgaatggatcacggattttgccggcaagaccgtctggttcgtgcctagcattaaagctgggaacgacatcgccaactgtcttagaaagaatggcaaaaaggtgattcaactgtcccgcaagacatttgataccgagtatcagaaaacaaagctcaacgactgggatttcgtcgttaccacagacatctctgagatgggagcgaattttaaagccgatcgggtgattgaccccagacggtgcctgaagcccgtgatcctgaccgatggccctgaacgcgtcatcctcgctgggcccatgcctgtgacggccgctagcgccgctcagagacggggacgcgttggcagaaacccgcagaaagagaatgaccaatacattttcacagggcagccccttaacaatgatgaagaccacgcccattggaccgaggcgaagatgctgctggacaacatcaatacccctgaaggaattatccccgccctcttcgagcctgagcgggaaaagtccgctgccattgatggcgagtatagactgaaaggggaaagccgcaagacatttgtggagcttatgcggagaggcgacctgcccgtctggctcgctcacaaagtggcctctgaaggaatcaagtacaccgatcgcaaatggtgcttcgacggccagcggaacaatcagatcctggaggagaacatggatgttgaaatttggacaaaggagggggaaaaaaagaagctgagaccgcgctggctcgacgcccggacgtattccgatcctcttgctctgaaagagtttaaggacttcgcggccggaagaaaaagcatcgctctggatctcgtgaccgaaattggccgcgtccccacacacctggcccatagaacccggaatgcccttgacaacctggtgatgctccacacatctgagcatgggggaaaggcttaccgccacgccgtcgaggaactgcctgagaccatggaaacgctgctccttctgggcctgatgatcctcctgaccggcggggcgatgctttttctgatttccggaaaaggcatcgggaagacaagcatcggactcatttgtgtgatcgcctcctctggcatgctgtggatggctgagattcccctgcaatggatcgccagcgctattgttctcgagttctttatgatggtgcttctgatccctgaacccgagaagcagagaaccccgcaggataatcaactggcctatgtggtcattgggatcctcacactggcggccatcattgctgccaacgaaatgggacttctggagaccacgaaacgggacctcggcatgtccaaggaacctggcgttgtgagccccacatcttacctggatgtggacctgcaccccgcttccgcctggaccctctacgctgtcgccacaaccgtgatcacccctatgcttcgccatacaattgagaatagcacggcgaacgtttctctggccgctatcgccaaccaggctgtggtcctgatggggctcgacaaaggatggccgattagcaagatggatctgggcgtgccccttctggccctcgggtgctattcccaggtcaatcctctgaccctgacagccgcggtgctccttctgatcacccactacgctatcattggacccggcctgcaggccaaagctacaagagaggcccaaaagcggaccgccgctgggatcatgaagaaccctacggttgacggaattatgacaatcgatctcgaccccgtgatttatgattctaaattcgaaaagcagctgggccaggtcatgcttctggtgctctgtgccgttcagctgctgctcatgagaaccagctgggcgctttgcgaggccctgaccctggctacaggccctatcaccacactctgggaagggtccccgggaaaattttggaatacgaccatcgccgtgtctatggctaacattttccgcggcagctacctggccggggcgggacttgccttttccatcatgaagagcgtcggcacagggaaacggggaaccggctctcaaggcgagacactgggggaaaagtggaagaaaaagctcaatcagctgtccagaaaagagttcgacctgtataagaaaagcggaattaccgaggtggatcgcacggaagctaaggagggcctcaaacggggggaaatcacccatcacgccgtgtccagaggatctgctaagcttcagtggtttgttgagcggaacatggtcattcccgaaggccgcgtgatcgacctggggtgtggaagaggcggctggagctactattgcgccgggctgaagaaagtgacagaggtccggggatacaccaagggcgggcctggacatgaggaacccgttcctatgtccacatacggctggaatattgtgaaactcatgtctgggaaggatgtgttctatctgcccccggagaaatgtgacacccttctgtgcgatatcggagaaagctcccctagccccacagtcgaggagtctcgcaccatcagagtgctcaagatggttgaaccctggctgaagaacaatcagttctgtattaaagtgctgaacccttacatgcccacggtcatcgagcacctcgaacggcttcaacgcaagcacggcggcatgctggtgagaaatcctctgtcccggaacagcacacatgagatgtattggatttctaatgggaccggaaacatcgttgcttccgtgaatatggtcagccgcctcctgcttaacagatttaccatgacacaccggagaccgacgattgaaaaagacgtggatctgggcgccgggacccgccatgtgaacgcggagcccgagacacctaatatggacgtcatcggagaacggatcaagagaattaaagaggaacacaactctacctggcactacgacgatgagaatccctataagacatgggcctaccatggcagctatgaagttaaggctaccgggtccgcctctagcatgatcaacggagtggtgaaactcctgacaaagccttgggacgtcgtgcccatggttacccagatggctatgacggataccacaccgttcggccagcaacgcgtgtttaaagagaaggtcgacacccggacacctagatccatgcccggcacccgccgggtgatggagattacggccgaatggctgtggagaacactcgggcgcaataaaaagcctcggctgtgcaccagagaggaattcacaaagaaagttcgcaccaacgccgcgatgggagctgtgtttacggaggaaaatcagtgggatagcgccaaggccgctgtcgaggacgaggatttctggaaacttgtggaccgggaaagagagctgcacaagctcggcaaatgtgggtcctgcgtttacaacatgatgggaaagcgcgaaaaaaagctgggcgagtttgggaaggccaaaggctctagagctatctggtacatgtggcttggagcccggtatctggagttcgaagcgctcggctttctgaatgaggatcattggttcagccgcgaaaactcctactctggggtggagggagaaggcctgcacaagctcgggtatattctgagagacatcagcaaaatccccggaggcgccatgtacgctgatgacaccgccgggtgggacacacggattaccgaggatgaccttcataatgaggaaaagatcacacagcagatggatcctgagcacagactgctcgctaacgccatttttaaactgacctatcaaaataaggtcgtgaaggtccagcggcccacaccgaccggcacggtgatggacatcatttcccgcaaagatcagagaggatctggccaggttgggacatacggacttaacaccttcaccaatatggaagcgcaactgatccggcagatggagggcgaaggggtgctcagcaaggccgacctggagaaccctcacctgtccgagaaaaaggtcacacagtggctcgaaaccaaaggagtggagcgcctgaagagaatggctatcagcggcgatgactgcgtggttaagcccattgatgaccggtttgccaacgctcttctggccctcaatgatatggggaaagtgcgcaaggacatcccccagtggcaaccttctaaaggctggcatgattggcagcaggtcccgttctgttcccaccatttccacgaactgattatgaaggacggaagaaaacttgtggttccctgccggcctcaggacgagctgatcggccgcgctagaattagccaaggggccggatggtctctccgggaaacagcgtgtctgggcaaggcctatgctcagatgtggtccctgatgtactttcaccgcagagatctccggctggccagcaacgccatctgctctgctgtgcccgtccattgggtgcctacgtcccgcaccacatggagcattcacgcccatcaccagtggatgaccacagaggacatgcttaccgtctggaatagagtgtggatcgaggataacccctggatggaagacaagacgcctgttaccacatgggagaatgtgccctacctggggaaacgggaagatcaatggtgtggatccctcatcggcctgaccagcagagcgacatgggctcagaacattccgaccgccatccagcaggtccgctctcttattgggaatgaggagttcctggactatatgcctagcatgaagcggtttagaaaagaagaggaatccgagggcgccatctggtga

SEQ ID NO: 20454 - RNA, 9873 nt, synthetic construct
  misc_feature 1..9873: note = derived and/or modified CDS sequence (opt5) from DENV-3__GQ868577__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaagatcgtggggctgtacggaaatggcgttgtgaccaaaaacgggggatatgtctccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgatcctcgcccctacaagagttgtggcggccgagatggaagaggctctgaagggccttcccattcgctatcagaccaccgccacaaaatctgaacataccgggcgggagatcgtcgacctgatgtgccacgctacatttaccatgagactgctcagccctgtgcgcgttccgaattacaacctgattatcatggatgaagcccatttcacggaccccgcctccattgctgcgcggggatacatctctacaagagtgggcatgggggaggccgctgccatctttatgaccgccacacctcccggaaccgctgatgccttccctcagagcaatgcgcccattcaggacgaggaacgcgacatcccggagcggtcctggaactctggcaatgaatggattacggattttgctgggaagaccgtctggttcgtgcctagcatcaaagccggcaacgacattgccaactgtcttagaaagaatggcaaaaaggtgatccaactgtcccgcaagacatttgataccgagtatcagaaaacaaagctcaacgactgggatttcgtcgttaccacagacatttctgagatgggagctaattttaaagccgatcgggtgatcgaccccagacggtgcctgaagcccgtgatcctgaccgatgggcctgaacgcgtcattctcgcgggacccatgcctgtgacggccgctagcgccgctcagagacggggccgcgttgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtctggctcgcttacaaagtggcctctgaaggcatcaagtataccgatcgcaaatggtgcttcgacgggcagcggaacaatcagattctggaggagaacatggatgttgaaatctggacaaaggagggagagaagaagaagctgagaccgcgctggctcgacgctcggacgtactccgatcctcttgccctgaaagagtttaaggacttcgccgctggcagaaaaagcattgcgctggatctcgtgaccgaaatcgggcgcgtccccacacacctggcccacagaacccggaatgctcttgacaacctggtgatgctccatacatctgagcacggaggcaaggcctatcgccatgccgtcgaggaactgcctgagaccatggaaacgctgctccttctgggcctgatgattctcctgaccgggggagctatgctttttctgatctccggcaaagggatcggaaagacaagcattggcctcatctgtgtgattgcctcctctgggatgctgtggatggcggagatccccctgcaatggattgccagcgctatcgttctcgagttctttatgatggtgcttctgattcctgaacccgagaagcagagaaccccgcaggataatcaactggcctacgtggtcatcggaatcctcacactggctgccattatcgcggccaacgaaatgggccttctggagaccacgaaacgggacctcggcatgtccaaggaacctggggttgtgagccccacatcttacctggatgtggacctgcaccccgcttccgcctggaccctctatgctgtcgccacaaccgtgattacccctatgcttcgccacacaatcgagaatagcacggctaacgtttctctggccgcgattgccaaccaggctgtggtcctgatgggactcgacaaaggctggccgatcagcaagatggatctgggggtgccccttctggccctcggatgctactcccaggtcaatcctctgaccctgacagctgccgtgctccttctgatcacccattatgccattatcggccccgggctgcaggcgaaagctacaagagaggcccaaaagcggaccgctgccggaattatgaagaaccctacggttgacggcatcatgacaattgatctcgaccccgtgatctacgattctaaattcgaaaagcagctgggccaggtcatgcttctggtgctctgtgccgttcagctgctgctcatgagaaccagctgggctctttgcgaggccctgaccctggcgacagggcctatcaccacactctgggaaggatccccgggcaaattttggaatacgaccattgccgtgtctatggctaacatcttccgcgggagctatctggccggagctggccttgccttttccattatgaaaagcgtcgggacaggaaaacggggcaccggctctcaaggggagacactgggagaaaagtggaagaaaaagctcaatcagctgtccagaaaagagttcgacctgtacaagaaaagcggcatcaccgaggtggatcgcacggaagcgaaggaggggctcaaacggggagaaattacccaccatgccgtgtccagaggctctgctaaacttcagtggtttgttgagcggaacatggtcatccccgaagggcgcgtgattgacctgggatgtggcagaggcgggtggagctattactgcgccggactgaagaaagtgacagaggtccggggctacaccaaagggggacctggccacgaggaacccgttcctatgtccacatatgggtggaatatcgtgaaactcatgtctggaaaggatgtgttctacctgcccccggagaaatgtgacacccttctgtgcgatatcggcgaaagctcccctagccccacagtcgaggagtctcgcaccattagagtgctcaagatggttgaaccctggctgaagaacaatcagttctgtatcaaagtgctgaacccttatatgcccacggtcattgagcatctcgaacggcttcaacgcaagcacggcgggatgctggtgagaaatcctctgtcccggaacagcacacacgagatgtactggatctctaatggaaccggcaacattgttgcttccgtgaatatggtcagccgcctcctgcttaacagatttaccatgacacatcggagaccgacgatcgaaaaagacgtggatctgggggccggaacccgccacgtgaacgctgagcccgagacacctaatatggacgtcatcggcgaacggattaagagaatcaaagaggaacataactctacctggcactatgacgatgagaatccctacaagacatgggcctatcacgggagctacgaagttaaggcgaccggatccgcctctagcatgattaacggcgtggtgaaactcctgacaaagccttgggacgtcgtgcccatggttacccagatggctatgacggataccacaccgttcggccagcaacgcgtgtttaaagagaaggtcgacacccggacacctagatccatgcccgggacccgccgggtgatgggaatcacggccgagtggctgtggagaacactcggccgcaataaaaagcctcggctgtgcaccagagaagagttcacaaagaaagttcgcaccaacgctgccatgggggccgtgtttacggaagagaatcagtgggatagcgcgaaggctgccgtcgaagacgaggatttctggaaacttgtggaccgggagagagaactgcataagctcggaaaatgtggctcctgcgtttacaacatgatggggaagcgcgagaaaaagctgggcgaatttggaaaggccaaaggctctagagctatttggtatatgtggcttggggcccggtacctggagttcgaggctctcggatttctgaatgaagatcactggttcagccgcgagaactcctattctggcgtggaaggggagggactgcataagctcggctacatcctgagagacatcagcaaaattcccgggggcgccatgtatgcggatgacaccgccggatgggacacacggatcaccgaagatgaccttcacaatgaggagaagattacacagcagatggatcctgaacatagacaactggctaacgccatctttaaactcacctaccagaataaggtcgtgaaggtccagcggcccacaccgaccggcacggtgatggacattatctcccgcaaagatcagagagggtctggacaagttggcacatatgggctgaacaccttcaccaatatggaggctcagcttatccggcagatggaaggagagggcgtgctgagcaaggccgacctcgaaaaccctcatctgcccgagaaaaagattgcgcagtggctggagacaaaaggggtcgaacgcctcaagagaatggccatctccggcgatgactgcgtggtgaagcccattgatgaccggtttgctaacgccctgcttgctctgaatgatatgggaaaagttcgcaaggacatccctcaatggcagccgagcaaaggctggcacgattggcaacaggtgcccttctgttctcatcacttccatgagctcattatgaaggacgggagaaaactggtcgtgccttgccggccccaagacgaacttatcggacgcgccagaatttcccagggcgctgggtggagcctgcgggagaccgcctgtctcggaaaggcgtacgcccagatgtggtctctgatgtactttcaccgcagagatctgcggctcgcttccaacgccatctgcagcgccgttcctgtgcactgggtccccacatctcgcacgacctggtccatccatgctcaccatcaatggatgacaaccgaagacatgctgacagtgtggaatagagtctggattgaggataacccttggatggagaataagacccccgtgacgacctgggaaaacgttccgtatcttggcaaacgggaggaccagtggtgtgggagcctgatcggcctcacatccagagccacctgggcgcagaatattcctacagctatccagcaagtgcgcagcctgattggaaacgaagagttccttgattacatgccctctatgaagcggtttagaaaagaggaagagagcgaaggcgccatctggtga

SEQ ID NO: 20455 - RNA, 9873 nt, synthetic construct
  misc_feature 1..9873: note = derived and/or modified CDS sequence (opt5) from DENV-3__GU131954__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgcttacaaagttgcctctgaaggcatcaagtataccgatcgcaaatggtgcttcgacgggcagcggaacaatcagatcctggaggagaacatggatgtggaaatttggacaaaggagggagagaagaagaagctgagaccgcgctggctcgacgctcggacgtactccgatcctcttgccctgaaagagtttaaggacttcgccgctggcagaaaaagcatcgcgctggatctcgtcaccgaaattgggcgcgtgcccacacacctggcccacagaacccggaatgctcttgacaacctggtcatgctccatacatctgagcacggaggcaaggcctatcgccatgccgtggaggaactgcctgagaccatggaaacgctgctccttctgggcctgatgatcctcctgaccgggggagttatgctttttctgatttccggcaaagggatcggaaagacaagcatcggcctcatttgtgtgatcgcttcctctgggatgctgtggatggccgagattcccctgcaatggatcgcgagcgccattgtgctcgagttctttatgatggtccttctgatccctgaacccgagaagcagagaaccccgcaggataatcaactggcttacgttgtgattggaatcctcacactggccgctatcattgccgcgaacgaaatgggccttctggagaccacgaaacgggacctcggcatgacaaaggaacctggggccgtgtcccccaccagctacctggatgtcgacctgcaccccgcttctgcctggacactctatgctgtggccaccaccgttatcacacctatgcttcgccacacgattgaaaattccaccgctaacgtgagcctggccgcgatcgccaaccaggctgtcgtgctgatgggactcgacaaaggctggccgatttctaagatggatctgggggtcccccttctggccctcggatgctacagccaggtgaatcctctgacactgaccgctgccgttctccttctgatcacacattatgccatcattggccccgggctgcaggcgaaagctaccagagaggcccaaaagcggacggctgccggaatcatgaagaaccctacagtggacggcattatgaccatcgatctcgaccccgtcatttacgattccaaattcgagaagcagctgggccaggtgatgcttctggttctctgtgccgtgcagctgctgctcatgagaacctcttgggctctttgcgaggccctgacactggcgaccgggcctatcacaacgctctgggaaggaagcccgggcaaattttggaataccacaatcgccgtctccatggctaacattttccgcgggtcttatctggccggagctggccttgcctttagcatcatgaagtccgtggggaccggaaaacggggcacaggcagccaaggggagaccctgggagaaaagtggaagaaaaagctcaatcagctgtctagaaaagagttcgacctgtacaagaaatccggcattacggaggtggatcgcaccgaagcgaaggaggggctcaaacggggagaaatcacacaccatgccgttagcagaggctccgctaaacttcagtggtttgtcgagcggaacatggtgattcccgaagggcgcgtgatcgacctgggatgtggcagaggcgggtggtcttattactgcgccggactgaagaaagtcaccgaggttcggggctacacaaaagggggacctggccacgaggaacccgtgcctatgagcacctatgggtggaatattgtgaaactcatgtccggaaaggatgtcttctacctgcccccggagaaatgtgacacacttctgtgcgatatcggcgaatctagcccttcccccaccgtggaggagagccgcacgatcagagttctcaagatggtggaaccctggctgaagaacaatcagttctgtattaaagtcctgaacccttatatgcccacagtgatcgagcatctcgaacggcttcaacgcaagcacggcgggatgctggttagaaatcctctgtctcggaactccacccacgagatgtactggattagcaatggaaccggcaacatcgtggcttctgtcaatatggtgtcccgcctcctgcttaacagatttacaatgacgcatcggagaccgaccattgaaaaagacgtggatctgggggccggaacacgccacgtcaacgctgagcccgagacccctaatatggacgttatcggcgaacggatcaagagaattaaagaggaacataacagcacatggcactatgacgatgagaatccctacaagacctgggcctatcacgggtcttacgaagtgaaggcgacaggaagcgcctcctctatgatcaacggcgtggtcaaactcctgaccaagccttgggacgtggttcccatggtgacgcagatggctatgaccgatacaaccccgttcggccagcaacgcgtctttaaagagaaggtggacacacggacccctagaagcatgcccgggacgcgccgggttatgggaattacagccgagtggctgtggagaaccctcggccgcaataaaaagcctcggctgtgcacaagagaagagttcaccaagaaagtgcgcacgaacgctgccatgggggccgtctttaccgaagagaatcagtgggattccgcgaaggctgccgtggaagacgaggatttctggaaacttgttgaccgggagagagaactgcataagctcggaaaatgtggcagctgcgtgtacaacatgatggggaagcgcgagaaaaagctgggcgaatttggaaaggccaaaggctccagagctatctggtatatgtggcttggggcccggtacctggagttcgaggctctcggatttctgaatgaagatcactggttctctcgcgagaacagctattccggcgtcgaaggggagggactgcataagctcggctacattctgagagacatctctaaaatccccgggggcgccatgtatgcggatgacacagccggatgggacacccggattacagaagatgaccttcacaatgaggagaagatcacccagcagatggatcctgaacatagacaactggctaacgccatttttaaactcacataccagaataaggtggtcaaggtgcagcggcccaccccgacgggcacagttatggacatcattagccgcaaagatcagagagggtccggacaagtgggcacctatgggctgaacaccttcacaaatatggaggctcagcttatccggcagatggaaggagagggcgtcctgtctaaggccgacctcgaaaaccctcatctgcccgagaaaaaggtgacccagtggctggagacaaaaggggtggaacgcctcaagagaatggcgatcagcggcgatgactgcgttgtgaagcccattgatgaccggtttgccaacgctctgcttgccctgaatgatatgggaaaagtccgcaaggacatccctcaatggcagccgtccaaaggctggcacgattggcaacaggtgcccttctgtagccatcacttccatgagctcattatgaaggacgggagaaaactggttgtgccttgccggccccaagacgaacttatcggacgcgctagaatttctcagggcgccgggtggtccctgcgggagacggcttgtctcggaaaggcctacgcgcagatgtggagcctgatgtactttcaccgcagagatctgcggctcgcctctaacgctatctgctccgccgtccctgtgcactgggtccccaccagccgcacaacctggtctattcatgcccaccatcaatggatgacaaccgaagacatgctgacggtgtggaatagagtttggatcgaggataacccttggatggaggacaagacccccgtgacaacctgggaaaatgtcccgtatcttggcaaacgggaggatcagtggtgtgggtccctgatcggcctcacaagcagagctacctgggcccagaacattcctacggcgatccagcaagtgcgctccctgattggaaatgaagagttccttgactacatgcccagcatgaagcggtttagaaaagaggaagagtctgaaggcgctatctggtga

SEQ ID NO: 20456 - RNA, 9873 nt, synthetic construct
  misc_feature 1..9873: note = derived and/or modified CDS sequence (opt5) from DENV-3__GQ868578__SS-prME
  source 1..9873: mol_type = other RNA
accagcctgtgcctcatgatgatcctgcccgccgctcttgccttccacctgacctcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcatacaggggaccagcaccaggttggaaacgagacgcaaggcgtgaccgctgaaattacaccccaggcctccaccacagaggctatcctgcctgaatatggcaccctggggctcgagtgcagcccccgcacgggactggacttcaatgagatgattcttctgaccatgaaaaacaaggcctggatggtccatagacagtggtttttcgatctccctctgccctggacatctggcgccaccacagaaaccccgacgtggaatcggaaagagcttctggtgacatttaagaacgctcacgcgaaaaagcaagaagtcgtggttctcgggtcccaggagggagccatgcacaccgctctgacaggcgccaccgaaatccagaatagcgggggcacctctattttcgccggacatctgaagtgtcgcctcaaaatggacaagctggagcttaaaggcatgtcctacgctatgtgcacaaacacgtttgtgctgaagaaagaggtcagcgaaacccagcacgggacaatcctcatcaaggtggagtacaagggagaagatgttccttgtaaaattcccttctccaccgaggacggccaagggaaggcccataacggaagactgatcacagcgaatcctgtggtcaccaaaaaggaggaacccgtgaacattgaggctgaaccccctttcggcgagtctaatatcgtgattgggatcggcgataacgccctgaaaatcaattggtataagaagggaagctccattggcaaaatgtttgaagccacggctagaggggccagacgcatggctatccttggagacacagcctgggatttcggcagcgttgggggagtcctcaactctctgggcaagatggtgcaccagatttttgggtccgcgtacaccgccctgttcagcggcgtgtcttgggtcatgaaaatcggaattggcgtgctcctgacctggatcgggcttaatagcaagaacacatccatgtcttttagctgcattgctatcggaatcattaccctgtatctcggcgccgttgtgcaggctgacatggggtgtgtcatcaattggaaaggaaaggagctgaagtgcggctccgggattttcgtgacaaacgaggttcatacgtggaccgaacagtacaaatttcaagccgatagcccgaagcggctggcgacagccatcgctggcgcctgggagaatggagtgtgtggcattagatctaccacacgcatggaaaaccttctctggaaacagatcgctaatgagctgaactatatcctgtgggaaaataacattaagctcaccgtcgtggttggggacatcattggagtgctggagcagggcaaacggacgcttacaccccagcctatggagctgaagtactcctggaaaacatgggggaaggccaagatcgtcaccgccgaaacacaaaacagctctttcattatcgatggacccaatacccctgagtgcccctccgctagcagagcgtggaacgtgtgggaagtggaggactatggctttggcgtcttcacaaccaatatctggctcaaactgcgcgaagtttacacgcagctgtgtgaccaccggcttatgtccgccgctgtgaaggatgagagagccgtgcacgccgacatggggtactggattgagtctcagaaaaacggaagctggaagctcgaaaaggcttccctgatcgaggtcaagacatgcaagtggccgaaatctcataccctgtggagcaatggcgtgctcgaatccgatatgattatccctaagagcctggccgggcccatttctcagcacaactatcgccctggataccatacccaaacagcgggcccctggcaccttgggaaactggagctcgactttaattattgcgagggaaccacggttgtgatcacagaaaactgtggcacccggggcccttccctgagaacaaccacagtcagcgggaagctgatccacgagtggtgctgtcgctcttgcacccttcccccgctccggtacatgggagaagatggctgttggtatgggatggagattagacctacgtccgaaaaagaggagaatatggtgaaaagcctggtttctgctggaagcggcgaagtggacaacttcaccatgggggtcctgtgcctcgccatcctgtttgaggaagtgatgcggggaaagttcggcaaaaagcatatgattgccggcgttcttttcacatttgtgctgctcctgtccgggcagatcacctggcgcgatatggctcacacactgattatgatcggaagcaatgcctctgacagaatgggcatgggggtcacctaccttgcgctgattgctacgttcaaaatccagccctttctcgccctgggattctttctccggaagctgacatccagagagaaccttctgctcggcgtggggctggccatggctaccacactgcaacttcccgaagatatcgagcagatggccaatggaattgctctgggcctcatggccctgaaactcatcacccagttcgagacctatcagctgtggacagcgcttattagcctgacgtgttccaacaccatctttacactcaccgtggcctggcgcacagctaccctgattctggccggcgtctctcttctgcctgtttgccaaagctcctctatgcggaagacggactggctcccgatgacagtggctgccatgggggtgccccctctgcccctcttcatctttagcctgaaggatacccttaaaagacgctcctggcctctgaatgaaggagtcatggccgtgggcctggtttctatcctcgctagctccctgcttagaaacgacgtgcccatggcggggcctctggtcgccggaggcctcctgattgcttgttacgtgatcaccgggacaagcgccgatctcaccgttgagaaggccgctgacgtgacatgggaagaggaagccgagcagacgggagtctctcataacctgatgattaccgtggacgatgacggcacaatgcggatcaaagatgacgagaccgaaaatattcttacagtcctgctgaagaccgcgctcctgatcgtgtccggcatcttcccctacagcattccggctacgcttctggtttggcacacctggcagaaacagacacaacgctctggggtgctctgggatgtcccttctccccctgagacccagaaggccgaactggaggagggagtgtatagaatcaaacagcagggcatttttgggaagacacaagttggagtgggcgtccagaaggaaggggtgttccataccatgtggcacgtgacacggggagccgttctcacgtacaacggcaaacgcctggagcccaattgggctagcgtcaagaaagaccttatcagctatggcgggggatggagactgtccgcccagtggcaaaagggcgaagaggtccaggtgattgcggtcgaaccggggaaaaaccctaagaattttcagaccatgcccggaacattccagaccaccacaggcgagatcggggctattgccctggatttcaagcctggaacgagcggctcccccatcatcaaccgggagggcaaaattgtggggctctacggaaatggcgttgtgaccaagaacgggggatatgtcagcggcatcgcccaaacaaatgctgaacccgacgggcctaccccggagctggaagaggaaatgtttaaaaagcgcaaccttacaattatggatctgcaccccggctctggaaaaaccagaaagtacctccctgccatcgtgcgggaggctattaagcgcagactgcggacgctcatcctggcccccacaagagttgtggcggccgagatggaagaggctcttaaaggcctgcctatccgctatcagaccaccgccacaaagagcgaacataccgggcgggagattgtcgacctgatgtgccacgctacattcaccatgagactcctgtcccccgtgcgcgttcctaattacaaccttatcattatggatgaagcccattttacggacccggcctctatcgctgcgcggggatacattagcacaagagtgggcatgggggaggccgctgccatcttcatgaccgccacaccccctggaaccgctgatgcctttccccagtccaatgcgcctatccaggacgaggaacgcgacattcccgagcggtcttggaacagcggcaatgaatggatcacggatttcgctgggaaaaccgtctggtttgtgccgtccattaaggccggcaacgacatcgccaactgtctgcgcaaaaatggaaagaaggtgattcaactctctagaaaaacattcgataccgagtatcagaagacaaaactgaacgactgggattttgtcgttaccacagacatcagcgagatgggcgctaatttcaaggccgatcgggtgattgaccctagacggtgcctgaaacccgtgatcctcaccgatgggcccgaacgcgtcatccttgcgggacctatgcccgtgacggccgcttccgccgctcagagacggggccgcgttgggagaaaccctcagaaggagaatgaccaatacatttttacaggacagccgctgaacaatgatgaagaccacgcccattggaccgaggctaagatgctgctcgacaacatcaatacccccgaaggcattatccctgccctgttcgagcccgagcgggagaagtccgcggccattgatggggagtatagacttaagggcgaatctcgcaaaacattcgtggagctgatgcggagaggagacctccctgtctggctggcttacaaggtggcctccgaaggcatcaaatataccgatcgcaagtggtgctttgacgggcagcggaacaatcagatcctggaggagaacatggatgttgaaatttggacaaaagagggagaaaagaagaaactcagaccccgctggcttgacgctcggacgtacagcgatccgctggccctgaaggagttcaaagactttgccgctggcagaaagtctatcgcgctcgatctggtgaccgaaattgggcgcgtccctacacaccttgcccacagaacccggaatgctctggacaacctcgtgatgctgcatacatccgagcacggaggcaaagcctatcgccatgccgtcgaggaactgcccgagaccatggaaacgctccttctgctgggcctcatgatcctgcttaccgggggagctatgctgttcctcattagcggcaaggggatcggaaagacatccatcggcctgatttgtgtgatcgcctctagcgggatgctgtggatggcggagattcctctccaatggatcgcctccgctattgttcttgagtttttcatgatggtgctgctgatccccgaacctgagaaacagagaacaccccaggataatcaactcgcctacgtggtcattggaatcctgacacttgctgccatcattgcggccaacgaaatgggcctgctcgagaccacgaagcgggacctgggcatgagcaaagaaccgggggttgtgtctcctacatcctacctggatgtggacctccaccccgctagcgcctggaccctttatgctgtcgccacaaccgtgatcacccccatgctgcgccacacaattgaaaattctacggctaacgttagcctggccgcgatcgccaaccaggctgtggtcctcatgggactggacaagggctggcctatttccaaaatggatcttggggtgccgctgctcgccctgggatgctactctcaggtcaatcccctgaccctcacagctgccgtgcttctgctgatcacccattatgccatcattggccctgggctccaggcgaaggctacaagagaggcccaaaagcggaccgctgccggaatcatgaaaaaccccacggttgacggcattatgacaatcgatctggaccctgtgatttacgatagcaagtttgaaaaacagcttggccaggtcatgctgctcgtgctgtgtgccgttcagctgctccttatgagaacctcctgggctctgtgcgaggccctgaccctcgcgacagggcccatcaccacactgtgggaaggatctcctggcaagttctggaatacgaccatcgccgtgagcatggctaacatttttcgcgggtcctatcttgccggagctggcctggccttcagcatcatgaaatctgtcgggacaggaaagcggggcaccggctcccaaggggagacactcggagaaaagtggaaaaagaaactgaatcagctgagcagaaaggagtttgacctctacaaaaagtccggcattaccgaggtggatcgcacggaagcgaaagaggggcttaagcggggagaaatcacccaccatgccgtgtctagaggcagcgctaagctgcagtggttcgttgagcggaacatggtcattccggaagggcgcgtgatcgacctgggatgtggcagaggcgggtggtcctattactgcgccggactcaaaaaggtgacagaggtccggggctacaccaaagggggacccggccacgaggaacctgttcccatgtctacatatgggtggaatattgtgaagctgatgagcggaaaagatgtgttttaccttcctcccgagaagtgtgacaccctgctctgcgatatcggcgaatccagcccgtctcctacagtcgaggagtcccgcaccatcagagtgctgaagatggttgaaccctggctgaaaaacaatcagttctgtattaaggtgctcaacccctatatgcctacggtcatcgagcatcttgaacggctgcaacgcaaacacggcgggatgctggtgagaaatcccctcagccggaactctacacacgagatgtactggatttccaatggaaccggcaacatcgttgctagcgtgaatatggtctctcgcctgcttctgaacagattcaccatgacacatcggagacctacgattgaaaaggacgtggatctcggggccggaacccgccacgtgaacgctgagccggagacacccaatatggacgtcatcggcgaacggatcaaaagaattaaggaggaacataacagcacctggcactatgacgatgagaatccttacaagacatgggcctatcacgggtcctacgaagttaaagcgaccggatctgccagctccatgatcaacggcgtggtgaagctgctgacaaaaccctgggacgtcgtgcctatggttacccagatggctatgacggataccacaccctttggccagcaacgcgtgttcaaggagaaagtcgacacccggacaccgagaagcatgcctgggacccgccgggtgatgggaattacggccgagtggctctggagaacactgggccgcaataagaagccccggctttgcaccagagaagagtttaccaagaaggttcgcaccaacgctgccatgggggccgtgttcacggaagagaatcagtgggattccgcgaaagctgccgtcgaagacgaggatttttggaagctggtggaccgggagagagaactccataaactgggaaagtgtggctcttgcgtttacaacatgatggggaaacgcgagaagaaacttggcgagttcggaaaagccaagggcagcagagctatctggtatatgtggctgggggcccggtacctcgagtttgaggctctgggattcctgaatgaagatcactggttttcccgcgagaactcttatagcggcgtggaaggggagggactccataaactgggctacattcttagagacatctccaagatccctgggggcgccatgtatgcggatgacaccgccggatgggacacacggattaccgaagatgacctgcacaatgaggagaaaatcacacagcagatggatcccgaacatagacaactcgctaacgccattttcaagctgacctaccagaataaggtcgtgaaagtccagcggcctacacccaccggcacggtgatggacatcatttctcgcaaggatcagagagggagcggacaagttggcacatatgggcttaacacctttaccaatatggaggctcagctgatccggcagatggaaggagagggcgtgctctccaaagccgacctggaaaacccgcatctgcctgagaagaaaatcgcgcagtggctcgagacaaagggggtcgaacgcctgaagagaatggccattagcggcgatgactgcgtggtgaaacccatcgatgaccggttcgctaacgcccttctggctctcaatgatatgggaaaggttcgcaaagacattccccaatggcagccttctaagggctggcacgattggcaacaggtgccgttttgttcccatcacttccatgagctgatcatgaaagacgggagaaaacttgtcgtgccctgccggcctcaagacgaactgattggacgcgccagaatcagccagggcgctgggtggtctctccgggagaccgcctgtctgggaaaggcgtacgcccagatgtggtccctgatgtacttccaccgcagagatctccggctggctagcaacgccatttgctctgccgttcccgtgcactgggtccctacatcccgcacgacctggagcatccatgctcaccatcaatggatgacaaccgaagacatgcttacagtgtggaatagagtctggatcgaggataacccctggatggaggacaaaacccctgtgacgacctgggaaaatgttccctatctgggcaagcgggaggatcagtggtgtgggtccctcattggcctgacaagcagagccacctgggcgcagaacatcccgacagctattcagcaagtgcgctctcttatgggaaatgaagagtttctggactacatgcctagcatgaaacggttcagaaaggaggaagagtccgaaggcgccatctggtga

SEQ ID NO: 20457 - RNA, 9873 nt, synthetic construct
  misc_feature 1..9873: note = derived and/or modified CDS sequence (opt5) from DENV-3__FJ898457__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagcatgaaaatctcaagtatacagtcatcatcaccgtgcacacaggggaccagcatcaggttggaaacgagacgcaaggcgtgaccgctgaaattacacctcaggcctctaccacagaggctatcctgcccgaatacggcaccctggggctcgagtgctcccctcgcacgggactggacttcaatgagatgattcttctgaccatgaaaaacaaggcctggatggtccacagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcataccgctctgacaggcgccaccgaaatccaaaattccgggggcaccagcattttcgccggacacctgaagtgtcgcctcaaaatggacaagctggagcttaaaggcatgtcttatgctatgtgcacaaacacgtttgtgctgaagaaagaggtctccgaaacccagcatgggacaatcctcatcaaggtggagtacaagggagaagatgccccctgtaaaattcctttcagcaccgaggacggccaagggaaggcgcacaacggaagactgatcacagctaatcccgttgtgaccaaaaaggaggaacccgtcaacattgaggccgaacctccgttcggcgagtccaatatcgtgattgggatcggcgataacgccctgaaaatcaattggtacaagaagggatctagcattggcaaaatgtttgaagctacggccagaggggctagacgcatggccatccttggagacacagcgtgggatttcggctccgtcgggggagttctcaacagcctgggcaagatggtccatcagatttttgggtctgcctataccgctctgttctccggcgtgagctggatcatgaaaattggaatcggcgtgctcctgacctggattgggcttaattctaagaacacaagcatgtccttttcttgcatcgccatcggaattatcaccctgtacctcggcgctgtcgtgcaggccgacatggggtgtgttattaattggaaaggaaaggagctgaagtgcggcagcgggatcttcgtgacaaacgaggtccacacgtggaccgaacagtataaatttcaagcggattcccccaagcggctggccacagctattgccggcgcttgggagaatggagtgtgtggcatcagaagcaccacacgcatggaaaaccttctctggaaacagatcgccaatgagctgaactacattctgtgggaaaataacatcaagctcaccgttgtggtcggggacattatcggagtgctggagcagggcaaacggacgcttacccctcagcccatggagctgaagtattcttggaaaacatgggggaaggccaagattgttaccgctgaaacacaaaactccagcttcatcatcgatggacctaatacccccgagtgcccgtctgcgtccagagcctggaacgtgtgggaagtcgaggactacggctttggcgtgttcacaaccaatatttggctcaaactgcgcgaagtgtatacgcagctgtgtgaccaccggcttatgagcgctgccgtcaaggatgagagagccgttcatgctgacatggggtactggatcgagtcccagaaaaacggatcttggaagctcgaaaaagccagcctgattgaggtgaagacatgcacctggcctaagtcccacaccctgtggtctaatggcgtgctcgaaagcgatatgatcattcccaaatccctggcggggcctatcagccagcataaccaccgccccggataccacacacaaaccgctggcccttggcatcttgggaagctggagctcgactttaattattgcgagggaacgacagtcgtgatcaccgaaaactgtggcacacggggcccctctctgagaaccacaaccgtttccgggaaactgattcacgagtggtgctgtcgcagctgcacgcttccgcctctccggtacatgggagaagatggctgttggtatgggatggagatcagacccatttctgaaaaggaggagaatatggtgaaatccctggtcagcgccggatctggcaaggtggacaacttcaccatgggggttctgtgcctcgccatcctgtttgaagaggtgatgcggggaaagttcggcaaaaagcatatgattgctggcgtcttctttacattcgtgcttctgctcagcgggcagatcacctggcgcgatatggcccacacactgattatgatcggatccaatgcgagcgacagaatgggcatgggggttacctacctggctcttatcgccacgtttaaaattcagcccttcctggccctcggatttttcctgcggaagctcacatctagagaaaacctgcttctgggcgtggggctcgctatggccaccacactgcaactgcctgaggatatcgaacagatggctaatggaattgcccttggcctgatggcgctcaaactgatcacccagtttgagacctatcagctctggacagccctgatttcccttacgtgtagcaacaccatcttcacactgaccgtcgcttggcgcacagccaccctcatcctggctggcgtgtccctgcttccggtgtgccaatctagctccatgcggaagacggactggctgcccatggccgtcgccgctatgggggttcctcccctccctctgtttattttctctctcaaggatacactgaaaagacgcagctggccccttaatgagggagtgatggcggtgggcctggtctccatcctggcctctagcctcctgagaaacgacgtgcctatggctgggccccttgttgccggaggcctgctcattgcctgttacgtgatcaccgggacctccgctgatctgacagtcgaaaaggccgcggacattacctgggaggaagaggctgaacagacaggagtgagccataacctcatgatcacggttgacgatgacggcaccatgcggatcaaagatgacgagacagagaatattctgaccgtgcttctgaagacagccctgctcatcgtctctggcatttttccgtattccatccctgccaccctgcttgtgtggcacacgtggcagaaacagacccaacgcagcggggtcctgtgggatgtgccctctcctcccgaaacacagaaggctgagctcgaagagggagtttacagaattaaacagcagggcatcttcgggaagacccaagtgggagtcggcgtgcagaaggagggggtttttcacacaatgtggcatgtgacccggggagccgtcctgacatacaacggcaaacgcctcgaaccgaattgggcgtccgtgaagaaagacctgattagctatggcgggggatggagactttctgctcagtggcaaaagggcgaggaagtgcaggttatcgccgtcgagcctgggaaaaaccccaagaatttccagacgatgcctggaaccttccagacaaccaccggcgaaatcggggccattgctctggattttaagcccggaacatccggcagccccatcattaaccgggagggcaaagtggtggggctgtacggaaatggcgtcgtgacgaagaacgggggatatgtttccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtgcgggaagcgatcaagcgcagactccggaccctgattctcgcccctacgagagtcgtggctgccgagatggaggaagctctgaaaggccttcccatccgctatcagacaaccgccaccaagtctgagcatacagggcgggaaattgttgacctgatgtgccacgccacctttacaatgagactgctcagccctgtgcgcgtcccgaattacaacctgatcattatggatgaggctcatttcaccgaccccgcgtccatcgccgctcggggatatatctctacgagagtgggcatgggggaagccgccgctatttttatgacagccacccctcccggaacagcggatgctttccctcagagcaatgcccccatccaggacgaggagcgcgacattccggaacggtcctggaactctggcaatgagtggatcaccgattttgccgggaaaacggtttggttcgtgcctagcattaaggctggcaacgacatcgccaactgtcttcgcaaaaatggaaagaaggtcattcaactgtccagaaaaacctttgatacagaataccagaagaccaaactcaacgactgggatttcgtggtgacaaccgacatctctgagatgggcgcgaattttaaggccgatcgggtcatcgaccccagacggtgcctgaaacccgttattctgacagatgggcctgagcgcgtgatcctcgctggacccatgcctgtgaccgccgctagcgccgctcagagacggggccgcgtcgggagaaacccgcagaaggaaaatgaccaatacattttcacgggacagccccttaacaatgatgaggaccacgcccactggacagaagcgaagatgctgctggacaacatcaatacccctgagggcattatccccgccctcttcgaacctgagcgggagaaatccgctgccatcgatggggaatatagactgaagggcgagagccgcaaaacctttgtggaacttatgcggagaggagacctgcccgtttggctcgctcataaggtggcctctgagggcattaaatacacagatcgcaagtggtgcttcgacgggcagcggaacaatcagatcctggaagagaacatggatgtcgagatttggaccaaagaaggagagaagaagaaactgagaccgcgctggctcgacgcccggacatattccgatcctcttgctctgaaggaatttaaagacttcgcggccggcagaaagagcatcgctctggatctcgtgacggagattgggcgcgttccctctcacctggcccatagaacccggaatgcccttgacaacctggtgatgctccacacatccgaacacggaggccgcgcttacagacatgccgtcgaggagctgcctgaaaccatggagacactgctccttctgggcctgatgatcctcctgaccgggggagcgatgctttttctgatcagcggcaaagggattggaaagacgtccatcggcctcatttgtgtgatcgcctctagcgggatgctgtggatggctgaaattcccctgcaatggatcgcctccgctattgtcctcgagttctttatgatggtgcttctgatccctgagcccgaaaagcagcggaccccgcaggataatcaactggcctatgttgtgatcggcattctcacactggcggccatcattgctgccaacgagatgggccttctggaaaccacaaaacgcgacctcggcatgagcaaggagcctggggtggtctctcccacctcctacctggatgttgacctgcaccccgctagcgcctggacgctctatgctgtggccacaaccgtgatcacacctatgcttagacataccattgaaaattctaccgcgaacgtcagcctggccgctatcgccaaccaggctgtggttctgatgggactcgacaaaggctggccgatctccaagatggatctgggggtgccccttctggccctcggatgctactctcaggtcaatcctctgacactgacggccgcggtgctccttctgattacccactacgctatcattggccccgggctgcaggccaaagctacacgggaggcccaaaagagaaccgccgctggaatcatgaagaaccctacagtcgacggcattatgaccatcgatctcgaccccgtgatctatgatagcaaattcgagaagcagctgggccaggttatgcttctggtgctctgtgccgtccagctgctgctcatgcgcacgtcctgggcgctttgcgaagccctgacactggctaccgggcctattaccacactctgggagggatctccgggcaaattttggaataccacaatcgccgtgagcatggctaacattttccgggggtcctacctggccggagcgggccttgcctttagcatcatgaagacggttgggaccggaaaaagaggcacaggctctcaaggggaaaccctgggagagaagtggaagaaaaagctcaatcagctgtcccgcaaagagttcgacctgtataagaaaagcggcattacagaggtggatcggaccgaggctaaggaagggctcaaaagaggagagatcacgcatcacgccgtctcccggggctctgctaaacttcagtggtttgtggaacgcaacatggtgattcccgaggggagagttatcgacctgggatgtggccggggcgggtggagctactattgcgccggactgaagaaagtcaccgaagtgcgcggctacacaaaagggggacctggccacgaggagcccgtgcctatgtccacctatgggtggaatatcgtcaaactcatgtctggaaaggatgttttctacctgcccccggaaaaatgtgacacacttctgtgcgatattggcgagagctcccctagccccaccgtggaagagtctagaacaatccgggtgctcaagatggtcgagccctggctgaagaacaatcagttctgtattaaagtgctgaacccttacatgcccaccgttatcgaacatctcgagcgccttcaaagaaagcacggcgggatgctggtgcggaatcctctgtcccgcaacagcacgcatgaaatgtattggatttctaatggaacaggcaacatcgtcgcttccgtgaatatggttagcagactcctgcttaaccggtttaccatgacccacagacgcccgacaatcgagaaagacgtggatctgggggccggaacgcggcacgtcaacgcggaacccgagacccctaatatggacgtgattggcgagagaatcaagcgcattaaagaagaacacaactctacatggcactacgacgatgaaaatccctataagacctgggcctaccatgggagctatgaggtgaaggctacaggatccgcctctagcatgatcaacggcgtcgttaaactcctgaccaagccttgggacgtggtgcccatggtcacacagatggctatgaccgatacgaccccgttcggccagcaacgggtgtttaaagaaaaggttgacacaagaacccctcgctccatgcccgggacacggagagtgatgggaattaccgccgagtggctgtggcgcacgctcggccggaataaaaagcctagactgtgcacacgcgaggagttcaccaagaaagtccggacaaacgccgcgatgggggctgtgtttaccgaggaaaatcagtgggatagcgccaaggccgctgttgaggacgaagatttctggaaacttgtggacagagagcgcgagctgcacaagctcggaaaatgtggctcctgcgtctacaacatgatggggaagagagagaagaagctgggcgagtttggaaaggccaaaggctctcgggctatctggtatatgtggcttggggcccgctacctggagttcgaggcgctcggatttctgaatgaggatcattggttcagcagagaaaactcctactctggcgtggagggggaaggactgcacaagctcggctatatcctgcgggacattagcaaaatccccgggggcgccatgtacgctgatgacacggccggatgggacaccagaattacagaggatgaccttcacaatgaagagaagatcacccagcagatggatcctgagcatcggcaactggctaacgccatttttaaactcacatatcagaataaggttgtgaaggtccagcgccccaccccgacaggcaccgtgatggacatcatctccagaaaagatcagcgggggtctggacaagtcggcacgtacgggctgaacacattcaccaatatggaagcgcagcttattcgccagatggagggagaaggcgtgctgagcaaggccgacctcgagaaccctcatctgcccgagaagaagatcacccagtggctggagacaaaaggggttgagagactcaagcggatggctatttccggcgatgactgcgtggtcaagcccatcgatgaccgctttgccaacgctctgcttgccctgaatgatatgggaaaagtgagaaaggacattcctcaatggcagccgagcaaaggctggcatgattggcaacaggtgcccttctgttctcaccacttccatgaactcatcatgaaggacgggcggaaactggttgtgccttgccgcccccaagacgagcttattggacgggctcggatctcccagggcgccgggtggagcctgcgcgaaaccgcgtgtctcggaaaggcctatgctcagatgtggtctctgatgtactttcacagacgggatctgcgcctcgcctccaacgccatctgcagcgctgtccctgtgcattgggttcccacatctagaacgacctggtccattcacgcccatcaccaatggatgacaaccgaggacatgctgacagtgtggaatcgggtctggatcgaagataacccttggatggaggacaagacccccgtgacgacctgggagaatgtcccgtatcttggcaaaagagaagatcagtggtgtgggagcctgattggcctcacatcccgcgcgacctgggctcagaacatccctacagccattcagcaagtgcggagcctgatcggaaatgaggagttccttgactacatgccctctatgaagagatttcgcaaagaggaggaaagcgagggcgccatctggtga

SEQ ID NO: 20458 - RNA, 9873 nt, synthetic construct
  misc_feature 1..9873: note = derived and/or modified CDS sequence (opt5) from DENV-3__KF955505__SS-prME
  source 1..9873: mol_type = other RNA
accagcctgtgcctcatgatgatcctgcccgccgctcttgccttccacctgacatcccggaatggagaacctcggatgattgtggggaagaatgaacgcggaaaatctctcctgtttaagacggcgagcggcatcaacatgtgtacccttattgctatggacctgggggaaatgtgcgatgacacagtgacctacaaatgtccgcatatcacagaagttgaacccgaagatattgactgctggtgtaatctcacctccacatgggtgacctatggaacgtgcaaccaggccggcgaacacagacgggataagcgctctgtggccctggctcctcatgtcgggatgggactggacaccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaatcgggattttgtcgaagggctcagcggagctacctgggtggacgtggtcctggagcacggcgggtgcgttaccacaatggccaagaacaaacccacgctggatattgagctccagaagaccgaagctacacaactggccacccttcgcaaactgtgtatcgagggaaagattacaaatatcaccacggactccagatgccctacacagggcgaagcggtgctcccggaggaacaggatcagaactatgtgtgtaaacacacctacgtcgaccggggctgggggaatggatgcggcctgttcgggaagggaagccttgtgacctgcgccaagtttcaatgtctggagcccattgagggcaaagttgtgcagtatgaaaacctcaagtacacagtcatcatcaccgtgcatacaggggatcagcaccaggttggaaatgagacgcaaggcgtgaccgctgaaattacacctcaggcctctaccacagaggctatcctgcccgaatatggcaccctggggctcgagtgctcccctcgcacgggactggacttcaacgagatgattcttctgaccatgaaaaataaggcctggatggtccatagacagtggtttttcgacctccccctgccgtggacaagcggcgccaccacagaaacccctacgtggaaccggaaagagcttctggtgacatttaagaatgctcacgcgaaaaagcaagaagtcgtggttctcgggtctcaggagggagccatgcacaccgctctgacaggcgccaccgaaatccagaactccgggggcaccagcattttcgccggacatctgaagtgtcgcctcaaaatggataagctggagcttaaaggcatgtcttacgctatgtgcacaaacacgtttgtgctgaagaaagaggtctccgaaacccagcacgggacaatcctcatcaaggtggagtacaagggagaagacgccccctgtaaaattcctttcagcaccgaggatggccaagggaaggcgcataatggaagactgatcacagctaaccccgttgtgaccaaaaaggaggaacccgtcaatattgaggccgaacctccgttcggcgagtccaacatcgtgattgggatcggcgacaatgccctgaaaatcaactggtataagaagggatctagcattggcaaaatgtttgaagctacggccagaggggctagacgcatggccatccttggagatacagcgtgggacttcggctccgtcgggggagttctcaatagcctgggcaagatggtccaccagatttttgggtctgcctacaccgctctgttctccggcgtgagctgggtgatgaaaatcggaattggcgtcctcctgacctggatcgggcttaactctaagaatacaagcatgtccttttcttgcattgccatcggaatcattaccctgtatctcggcgctgtggttcaggccgatatggggtgtgtgatcaactggaaaggaaaggagctgaagtgcggcagcgggattttcgtcacaaatgaggtgcatacgtggaccgaacagtacaaatttcaagcggactcccccaagcggctggccacagctatcgccggcgcttgggagaacggagtttgtggcattagaagcaccacacgcatggaaaatcttctctggaaacagatcgccaacgagctgaattatatcctgtgggaaaacaacattaagctcaccgtggtcgtgggggatatcattggagttctggagcagggcaaacggacgcttacccctcagcccatggagctgaagtactcttggaaaacatgggggaaggccaagatcgtgaccgctgaaacacaaaattccagcttcattatcgacggacctaacacccccgagtgcccgtctgcgtccagagcctggaatgtctgggaagtggaggattatggctttggcgtgttcacaaccaacatctggctcaaactgcgcgaagtctacacgcagctgtgtgaccaccggcttatgagcgctgccgttaaggacgagagagccgtgcacgctgatatggggtactggattgagtcccagaaaaatggatcttggaagctcgaaaaagccagcctgatcgaggtgaagacatgcacctggcctaagtcccataccctgtggtctaacggcgtcctcgaaagcgacatgattatccccaaatccctggcggggcctattagccagcacaatcatcgccccggatatcacacacaaaccgctggcccttggcaccttgggaagctggagctcgattttaactactgcgagggaacgacagtggttatcaccgaaaattgtggcacacggggcccctctctgagaaccacaaccgtgtccgggaaactgatccatgagtggtgctgtcgcagctgcacgcttccgcctctccggtatatgggagaagacggctgttggtacgggatggagattagacccatctctgaaaaggaggagaacatggtcaaatccctggtgagcgccggatctggcaaggttgataatttcaccatgggggtgctgtgcctcgccattctgtttgaagaggtcatgcggggaaagttcggcaaaaagcacatgatcgctggcgtgttctttacattcgttcttctgctcagcgggcagattacctggcgcgacatggcccatacactgatcatgattggatccaacgcgagcgatagaatgggcatgggggtgacctatctggctcttatcgccacgtttaaaatccagcccttcctggccctcggatttttcctgcggaagctcacatctagagaaaatctgcttctgggcgtcgggctcgctatggccaccacactgcaactgcctgaggacattgaacagatggctaacggaatcgcccttggcctgatggcgctcaaactgattacccagtttgagacctaccagctctggacagccctgatctcccttacgtgtagcaataccatgttcacactgaccgtggcttggcgcacagccaccctcattctggctggcgtgtccctgcttccggtctgccaatctagctccatgcggaagacggattggctgcccatggccgttgccgctatgggggtgcctcccctccctctgtttatcttctctctcaaggacacactgaaaagacgcagctggccccttaacgagggagtgatggcggtcggcctggtgtccatcctggcctctagcctcctgagaaacgatgttcctatggctgggccccttgtggccggaggcctgctcattgcctgttatgtcatcaccgggacctccgctgacctgacagtggaaaaggccgcggatattacctgggaggaagaggctgaacagacaggagttagccacaatctcatgatcacggtggacgacgatggcaccatgcggattaaagacgatgagacagagaacatcctgaccgtccttctgaagacagccctgctcatcgtgtctggcgtctttccgtactccattcctgccaccctgcttgtgtggcatacgtggcagaaacagacccaacgcagcggggttctgtgggacgtgccctctcctcccgaaacacagaaggctgagctcgaagagggagtctacagaatcaaacagcagggcattttcgggaagacccaagtgggagttggcgtgcagaaggagggggtctttcacacaatgtggcacgtgacccggggagccgtgctgacatataatggcaaacgcctcgaaccgaactgggcgtccgttaagaaagatctgatcagctacggcgggggatggagactttctgctcagtggcaaaagggcgaggaagtccaggtgattgccgtggagcctgggaaaaatcccaagaacttccagacgatgcctggaaccttccagacaaccaccggcgaaatcggggccattgctctggactttaagcccggaacatccggcagccccatcatcaatcgggagggcaaagtcgtggggctgtatggaaacggcgttgtgacgaagaatgggggatacgtctccggcattgcccaaaccaacgctgagcctgatgggccgacacccgaactcgaggaagagatgttcaaaaagcgcaatctgaccatcatggaccttcatcctggcagcggaaaaacaagaaagtatctgcccgccattgtgcgggaagcgatcaagcgcagactccggaccctgattctcgcccctacgagagttgtggctgccgagatggaggaagctctgaaaggccttcccatccgctaccagacaaccgccaccaagtctgagcacacagggcgggaaatcgtcgatctgatgtgccatgccacctttacaatgagactgctcagccctgtgcgcgttccgaactataatctgattatcatggacgaggctcacttcaccgatcccgcgtccattgccgctcggggatacatctctacgagagtgggcatgggggaagccgccgctatttttatgacagccacccctcccggaacagcggacgctttccctcagagcaacgcccccatccaggatgaggagcgcgacatcccggaacggtcctggaactctggcaacgagtggattaccgactttgccgggaaaacggtctggttcgtgcctagcatcaaggctggcaacgatattgccaattgtcttcgcaaaaacggaaagaaggtgatccaactgtccagaaaaacctttgacacagaataccagaagaccaaactcaatgattgggacttcgtcgttacaaccgatatttctgagatgggcgcgaactttaaggccgaccgggtgatcgatcccagacggtgcctgaaacccgtgattctgacagacgggcctgagcgcgtcatcctcgctggacccatgcctgtgaccgccgctagcgccgctcagagacggggccgcgttgggagaaatccgcagaaggaaaacgatcaatatatcttcacgggacagccccttaataacgacgaggatcatgcccactggacagaagcgaagatgctgctggacaatattaacacccctgagggcatcattcccgccctcttcgaacctgagcgggagaaatccgctgccatcgacggggaatacagactgaagggcgagagccgcaaaacctttgtggaacttatgcggagaggagatctgcccgtctggctcgctcacaaggtggcctctgagggcattaaatatacagaccgcaagtggtgcttcgatgggcagcggaataaccagatcctggaagagaatatggacgttgagatctggaccaaagaaggagagaagaagaaactgagaccgcgctggctcgatgcccggacatactccgaccctcttgctctgaaggaatttaaagatttcgcggccggcagaaagagcattgctctggacctcgtgacggagatcgggcgcgtcccctctcatctggcccacagaacccggaacgcccttgataatctggtgatgctccatacatccgaacacggaggccgcgcttatagacacgccgtcgaggagctgcctgaaaccatggagacactgctccttctgggcctgatgattctcctgaccgggggagcgatgctttttctgatcagcggcaaagggattggaaagacgtccatcggcctcatctgtgtgattgcctctagcgggatgctgtggatggctgaaatccccctgcaatggattgcctccgctatcgttctcgagttctttatgatggtgcttctgattcctgagcccgaaaagcagcggaccccgcaggacaaccaactggcctacgtggtcatcggcattctcacactggcggccatcatcgctgccaatgagatgggccttctggaaaccacaaaacgcgatctcggcatgagcaaggagcctggggttgtgtctcccacctcctatctggacgtggatctgcatcccgctagcgcctggacgctctacgctgtcgccacaaccgtgattacacctatgcttagacacaccatcgaaaactctaccgcgaacgttagcctggccgctattgccaatcaggctgtggtcctgatgggactcgacaaaggctggccgatctccaagatggacctgggggtgccccttctggccctcggatgctactctcaggtcaaccctctgacactgacggccgcggtgctccttctgattacccattatgctatcatcggccccgggctgcaggccaaagctacacgggaggcccaaaagagaaccgccgctggaattatgaagaatcctacagttgatggcatcatgaccattgacctcgatcccgtgatctacgacagcaaattcgagaagcagctgggccaggtcatgcttctggtgctctgtgccgttcagctgctgctcatgcgcacgtcctgggcgctttgcgaagccctgacactggctaccgggcctattaccacactctgggagggatctccgggcaaattttggaacaccacaatcgccgtgagcatggctaatatcttccgggggtcctatctggccggagcgggccttgcctttagcattatgaagtctgtcgggacgggaaaaagaggcaccggctcccaaggggaaacactgggagagaagtggaagaaaaagctcaaccagctgagccgcaaagagttcgatctgtacaagaaatccggcatcaccgaggtggaccggacagaggctaaggaagggctcaaaagaggagagaccacgcaccatgccgtgtctcggggcagcgctaaacttcagtggtttgttgaacgcaatatggtcattcccgaggggagagtgatcgatctgggatgtggccggggcgggtggtcctattactgcgccggactgaagaaagtgaccgaagtccgcggctatacaaaagggggacctggccacgaggagcccgttcctatgtctacctacgggtggaacattgtgaaactcatgagcggaaaggacgtgttctacctgcccccggaaaaatgtgatacacttctgtgcgacatcggcgagtccagcccttctcccaccgtcgaagagtccagaacaattcgggtgctcaagatggttgagccctggctgaagaataaccagttctgtatcaaagtgctgaatccttatatgcccaccgtcatcgaacacctcgagcgccttcaaagaaagcatggcgggatgctggtgcggaaccctctgagccgcaattctacgcacgaaatgtactggatttccaacggaacaggcaatatcgttgctagcgtgaacatggtctctagactcctgcttaaccggtttaccatgacccatagacgcccgacaattgagaaagatgtggacctgggggccggaacgcggcacgtgaatgcggaacccgagacccctaacatggatgtcatcggcgagagaattaagcgcatcaaagaagaacacaatagcacatggcattatgacgacgaaaacccctacaagacctgggcctatcacgggtcctacgaggttaaggctacaggatctgccagctccatgatcaatggcgtggtgaaactcctgaccaagccttgggatgtcgtgcccatggttacacagatggctatgaccgacacgaccccgttcggccagcaacgggtgtttaaagaaaaggtcgatacaagaacccctcgcagcatgcccgggacacggagagtgatgggaattaccgccgagtggctgtggcgcacgctcggccggaacaaaaagcctagactgtgcccccgcgaggagttcacaaagaaagttcggaccaatgccgcgatgggggctgtgtttacagaggaaaaccagtgggactccgccaaggccgctgtcgaggatgaagacttctggaaacttgtggatagagagcgcgagctgcataagctcggaaaatgtggctcttgcgtttataatatgatggggaagagagagaagaagctgggcgagtttggaaaggccaaaggcagccgggctatctggtacatgtggcttggggcccgctacctggagttcgaggcgctcggatttctgaacgaggaccactggttctccagagaaaattcttatagcggcgtggagggggaaggactgcctaagctcggctacattctgcgggatatctccaaaattcccgggggcgccatgtatgctgacgataccgccggatgggacacgagaatcaccgaggacgatcttcataacgaagagaagatcccgcaccagatggaccctgagcactctcggctggctaatgccatttttaaactcacataccagaacaaggtcgtgaaggtccaacgccccacccccacaggcaccgtgatggatatcattagcagaaaagcgcagcgggggtccggacaggttggcacatatgggctgaataccttcacgaacatggaagcccagcttatccgccaaatggagggagaaggcgtgctgagcaaggctgacctcgagaaccctcatctgccggagaagaagattacacagtggctggagaccaaaggggtcgagagactcaagcggatggccatcaccggcgatgactgcgtggtgaagcccatcgatgaccgctttgctaatgccctgcttgctctgaacgatatgggaaaagttagaaaggacattcctcagtggcagccctctaaaggctggcacgattggcaacaggtgcctttctgttcccatcacttccacgaactcatcatgaaggacgggcggaaactggtcgtgccctgccgccctcaggatgagcttattggacgggcccggatcagccagggcgcggggtggtctctgcgcgaaacagcctgtctcggaaaggcttacgcccaaatgtggtccctgatgtattttcatagacgggacctgcgcctcgccagcaatgctatttgctctgccgttcccgtgcactgggtcccgacctccagaacaacgtggagcatccatgcgcaccatcagtggatgaccacagaggacatgctgaccgtgtggaaccgggtctggattgaagataatccttggatggaggacaagacacccgtgaccacgtgggagaacgttccttaccttggcaaaagagaagatcagtggtgtgggtccctgatcggcctcaccagccgcgctacatgggcccaaaatatccccaccgccattcaacaggtgcggtctctgatcggaaacgaggagttccttgactacatgccgagcatgaagagatttcgcaaagaggaggaatccgagggcgctatttggtga

SEQ ID NO: 20459 - RNA, 9873 nt, synthetic construct
  misc_feature 1..9873: note = derived and/or modified CDS sequence (opt5) from DENV-3__FJ898464__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccatgttcacactgaccgtggcttggcgcacagccaccctcattctggctggcgtgtccctgcttccggtctgccaatctagctccatgcggaagacggactggctgcccatggccgttgccgctatgggggtgcctcccctccctctgtttatcttctctctcaaggatacactgaaaagacgcagctggccccttaatgagggagtgatggcggtcggcctggtgtccatcctggcctctagcctcctgagaaacgacgttcctatggctgggccccttgtggccggaggcctgctcattgcctgttatgtcatcaccgggacctccgctgatctgacagtggaaaaggccgcggacattacctgggaggaagaggctgaacagacaggagttagccacaacctcatgatcacggtggacgatgacggcaccatgcggattaaagatgacgagacagagaatatcctgaccgtccttctgaagacagccctgctcatcgtgtctggcgtctttccgtactccattcctgccaccctgcttgtgtggcatacgtggcagaaacagacccaacgcagcggggttctgtgggatgtgccctctcctcccgaaacacagaaggctgagctcgaagagggagtctacagaatcaaacagcagggcattttcgggaagacccaagtgggagttggcgtgcagaaggagggggtctttcacacaatgtggcacgtgacccggggagccgtgctgacatataacggcaaacgcctcgaaccgaattgggcgtccgttaagaaagacctgatcagctacggcgggggatggagactttctgctcagtggcaaaagggcgaggaagtccaggtgattgccgtggagcctgggaaaaaccccaagaatttccagacgatgcctggaaccttccagacaaccaccggcgaaatcggggccattgctctggattttaagcccggaacatccggcagccccatcatcaaccgggagggcaaagtcgtggggctgtatggaaatggcgttgtgacgaagaacgggggatacgtctccggcattgcccaaaccaatgctgagcctgacgggccgacacccgaactcgaggaagagatgttcaaaaagcgcaacctgaccatcatggatcttcatcctggcagcggaaaaacaagaaagtatctgcccgccattgtgcgggaagcgatcaagcgcagactccggaccctgattctcgcccctacgagagttgtggctgccgagatggaggaagctctgaaaggccttcccatccgctaccagacaaccgccaccaagtctgagcacacagggcgggaaatcgtcgacctgatgtgccatgccacctttacaatgagactgctcagccctgtgcgcgttccgaattataacctgattatcatggatgaggctcacttcaccgaccccgcgtccattgccgctcggggatacatctctacgagagtgggcatgggggaagccgccgctatttttatgacagccacccctcccggaacagcggatgctttccctcagagcaatgcccccatccaggacgaggagcgcgacatcccggaacggtcctggaactctggcaatgagtggattaccgattttgccgggaaaacggtctggttcgtgcctagcatcaaggctggcaacgacattgccaactgtcttcgcaaaaatggaaagaaggtgatccaactgtccagaaaaacctttgatacagaataccagaagaccaaactcaacgactgggatttcgtcgttacaaccgacatttctgagatgggcgcgaattttaaggccgatcgggtgatcgaccccagacggtgcctgaaacccgtgattctgacagatgggcctgagcgcgtcatcctcgctggacccatgcctgtgaccgccgctagcgccgctcagagacggggccgcgttgggagaaacccgcagaaggaaaatgaccaatatatcttcacgggacagccccttaacaatgatgaggaccatgcccactggacagaagcgaagatgctgctggacaacattaatacccctgagggcatcattcccgccctcttcgaacctgagcgggagaaatccgctgccatcgatggggaatacagactgaagggcgagagccgcaaaacctttgtggaacttatgcggagaggagacctgcccgtctggctcgctcacaaggtggcctctgagggcattaaatatacagatcgcaagtggtgcttcgacgggcagcggaacaatcagatcctggaagagaacatggatgttgagatctggaccaaagaaggagagaagaagaaactgagaccgcgctggctcgacgcccggacatactccgatcctcttgctctgaaggaatttaaagacttcgcggccggcagaaagagcattgctctggatctcgtgacggagatcgggcgcgtcccctctcatctggcccacagaacccggaatgcccttgacaacctggtgatgctccatacatccgaacacggaggccgcgcttatagacacgccgtcgaggagctgcctgaaaccatggagacactgctccttctgggcctgatgattctcctgaccgggggagcgatgctttttctgatcagcggcaaagggattggaaagacgtccatcggcctcatctgtgtgattgcctctagcgggatgctgtggatggctgaaatccccctgcaatggattgcctccgctatcgttctcgagttctttatgatggtgcttctgattcctgagcccgaaaagcagcggaccccgcaggataatcaactggcctacgtggtcatcggcattctcacactggcggccatcatcgctgccaacgagatgggccttctggaaaccacaaaacgcgacctcggcatgagcaaggagcctggggttgtgtctcccacctcctatctggatgtggacctgcatcccgctagcgcctggacgctctacgctgtcgccacaaccgtgattacacctatgcttagacacaccatcgaaaattctaccgcgaacgttagcctggccgctattgccaaccaggctgtggtcctgatgggactcgacaaaggctggccgatctccaagatggatctgggggtgccccttctggccctcggatgctactctcaggtcaatcctctgacactgacggccgcggtgctccttctgattacccattatgctatcatcggccccgggctgcaggccaaagctacacgggaggcccaaaagagaaccgccgctggaattatgaagaaccctacagttgacggcatcatgaccattgatctcgaccccgtgatctacgatagcaaattcgagaagcagctgggccaggtcatgcttctggtgctctgtgccgttcagctgctgctcatgcgcacgtcctgggcgctttgcgaagccctgacactggctaccgggcctattaccacactctgggagggatctccgggcaaattttggaataccacaatcgccgtgagcatggctaacatcttccgggggtcctatctggccggagcgggccttgcctttagcattatgaagtctgtcgggacgggaaaaagaggcaccggctcccaaggggaaacactgggagagaagtggaagaaaaagctcaatcagctgagccgcaaagagttcgacctgtacaagaaatccggcatcaccgaggtggatcggacagaggctaaggaagggctcaaaagaggagagaccacgcaccatgccgtgtctcggggcagcgctaaacttcagtggtttgttgaacgcaacatggtcattcccgaggggagagtgatcgacctgggatgtggccggggcgggtggtcctattactgcgccggactgaagaaagtgaccgaagtccgcggctatacaaaagggggacctggccacgaggagcccgttcctatgtctacctacgggtggaatattgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttatatgcccaccgtcatcgaacacctcgagcgccttcaaagaaagcatggcgggatgctggtgcggaatcctctgagccgcaactctacgcacgaaatgtactggatttccaatggaacaggcaacatcgttgctagcgtgaatatggtctctagactcctgcttaaccggtttaccatgacccatagacgcccgacaattgagaaagacgtggatctgggggccggaacgcggcacgtgaacgcggaacccgagacccctaatatggacgtcatcggcgagagaattaagcgcatcaaagaagaacacaacagcacatggcattatgacgatgaaaatccctacaagacctgggcctatcacgggtcctacgaggttaaggctacaggatctgccagctccatgatcaacggcgtggtgaaactcctgaccaagccttgggacgtcgtgcccatggttacacagatggctatgaccgatacgaccccgttcggccagcaacgggtgtttaaagaaaaggtcgacacaagaacccctcgcagcatgcccgggacacggagagtgatgggaattaccgccgagtggctgtggcgcacgctcggccggaataaaaagcctagactgtgcacacgcgaggagttcaccaagaaagttcggacaaacgccgcgatgggggctgtgtttaccgaggaaaatcagtgggattccgccaaggccgctgtcgaggacgaagatttctggaaacttgtggacagagagcgcgagctgcataagctcggaaaatgtggctcttgcgtttataacatgatggggaagagagagaagaagctgggcgagtttggaaaggccaaaggcagccgggctatctggtacatgtggcttggggcccgctacctggagttcgaggcgctcggatttctgaatgaggatcactggttctccagagaaaactcttatagcggcgtggagggggaaggactgcataagctcggctacattctgcgggacatctccaaaattcccgggggcgccatgtatgctgatgacacggccggatgggacaccagaatcacagaggatgaccttcacaatgaagagaagatcacccagcagatggatcctgagcaccggcaactggctaacgccatttttaaactcacataccagaataaggtcgtgaaggtccagcgccccaccccgacaggcaccgtgatggacatcatttctagaaaagatcagcgggggagcggacaagttggcacgtatgggctgaacacattcaccaatatggaagcgcagcttatccgccagatggagggagaaggcgtgctgtccaaggccgacctcgagaaccctcatctgcccgagaagaagattacccagtggctggagacaaaaggggtcgagagactcaagcggatggctatcagcggcgatgactgcgtggtgaagcccatcgatgaccgctttgccaacgctctgcttgccctgaatgatatgggaaaagttagaaaggacattcctcaatggcagccgtctaaaggctggcacgattggcaacaggtgcccttctgttcccatcacttccacgaactcatcatgaaggacgggcggaaactggtcgtgccttgccgcccccaagacgagcttattggacgggctcggatcagccagggcgccgggtggtctctgcgcgaaaccgcgtgtctcggaaaggcctacgctcagatgtggtccctgatgtattttcatagacgggatctgcgcctcgccagcaacgccatttgctctgctgttcctgtgcactgggtccccacatccagaacgacctggagcatccatgcccaccatcaatggatgacaaccgaggacatgctgacagtgtggaatcgggtctggattgaagataacccttggatggaggacaagacccccgtgacgacctgggagaatgttccgtaccttggcaaaagagaagatcagtggtgtgggtccctgatcggcctcacaagccgcgcgacctgggctcagaacatccctacagccattcagcaagtgcggtctctgatcggaaatgaggagttccttgactacatgcccagcatgaagagatttcgcaaagaggaggaatccgagggcgccatttggtga

SEQ ID NO: 20460 - RNA, 9873 nt, synthetic construct
  misc_feature 1..9873: note = derived and/or modified CDS sequence (opt5) from DENV-3__JQ922556__SS-prME
  source 1..9873: mol_type = other RNA
accagcctgtgcctcatgatgatcctgcccgccgctcttgccttccacctgacctcccgggacggcgaacctcggatgattgtggggaagaacgaacgcggaaagtctctcctgtttaagacggcgagcggcatcaatatgtgtacccttattgctatggatctgggggaaatgtgcgacgataccgtgacctacaaatgtccccatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctcccgccagaggggctagacgcatggccatccttggagacacggcgtgggtgttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgatatggggtgtgtcatcaattggaaaggaaaggagctgaagtgcggcagcgggattttcgtgaccaacgaggttcatacatggacggaacagtacaaatttcaagcggactcccctaagcggctggccaccgctatcgccggcgcttgggagaatggagtgtgtggcattagaagcacaacccgcatggaaaaccttctctggaaacagatcgccaatgagctgaactatatcctgtgggaaaataacattaagctcacagtcgtggttggggataccatcggagtgctggagcagggcaaacggacgcttacaccccagcctatggagctgaagtactcttggaaaacatgggggaaggccaagattgtcaccgctgaaacacaaaactccagcttcatcattgacggaccctctaccccggagtgcccttccgcgagcagagcctggaatgtgtgggaagtggaggattatggctttggcgtcttcacaaccaacatctggctcaaactgcgcgaagtttacacgcagatgtgtgaccaccggctgatgtcccccgctgtgaaggacgagagagccgtgcacgccgatatggggtactggatcgagtctcagaaaaatggaagctggaaacttgaaaaggcttccctcattgaggtcaagacatgcacctggcctaagtctcataccctgtggagcaacggcgtgctggaatccgacatgatcattcccaaaagcctcgccgggcctatctctcagcacaattatcgccccggataccatacacaaaccgcgggcccgtggcacctggggaaacttgagctggattttaactattgcgagggaacgacagttgtgattaccgaaaattgtggcacacggggcccttccctcagaaccacaaccgtcagcgggaaactgatccacgagtggtgctgtcgctcttgcacgctgccgccccttcggtacatgggagaagacggctgttggtatgggatggagatcagacctatttccgaaaaggaggagaacatggtgaaaagcctcgtttctgctggaagcggcaaggtggataatttcaccatgggggtcctgtgcctggccatcctctttgaagaggtgatgcggggaaagttcggcaaaaagcatatgattgccggcgttttctttacattcgtgctgcttctgtccgggcagatcacctggcgcgacatggctcacacactcattatgatcggaagcaacgcctctgatagaatgggcatgggggtcacctacctggcgctgattgctacgtttaaaatccagccgttccttgccctgggatttttcctccggaagctgacatccagagaaaatctcctgcttggcgtggggctggccatggctaccacactccaactgcccgaggacatcgaacagatggccaacggaattgctctgggccttatggcctttaaactgatcacccagttcgagacctatcagctctggacagcgctgattagcctcacgtgttccaataccatctttacactgaccgtggcctggcgcacagctacccttattctggccggcgtctctctcctgcctgtttgccaaagctcctctatgcggaagacggattggctgcccatgacagtggctgccatgggggtgcctccccttcctctgttcatctttagcctcaaggacaccctgaaaagacgctcctggcccctcaacgagggagtcatggccgtgggcctggtttctatccttgctagctccctgctgagaaatgatgtgccgatggcggggcctctcgtcgccggaggcctgcttattgcttgttacgtggggaccggaacaagcgccgacctgaccgttgaacaggccgctgatgtgacatgggaggaagaggccgaacagacgggcgtctctcataacctcatgatcaccgtggacgacgatggcacaatgcggattaaggacgatgagaccgagaacatcctgacagtcctcctgaaaaccgcgcttctgattgtgtccgggatcttcccctacagcatccctgctacgctgctcgtttggcacacctggcagaagcaaacacagcgctctggagtgctgtgggacgtcccctccccgcctgaaacccagaaagccgagcttgaagagggcgtgtatagaattaagcagcaagggatcctgggaaaaacacaggttggcgtgggggtccagaaggagggagtgtttcataccatgtggcacgtgacacggggcgccgttctcacgcacaatggcaagcgcctggaacccaactgggctagcgtcaaaaaggatctcatttcttacgggggaggctggagactgtcccctcaatggcagaaaggggaggaagtccaggtgatcaccgtcgagcccggaaagaatcccaaaaacttccagacaatgcctggcaccttccaaaccacaacgggggaaattggagccatcgcgcttgactttaagccgggcaccagcggctcccccattatcaatcgggaggggaaggtggttggactgtatggcaacggggtggtcaccaagaatggaggctacgtgagcgggatcgctcagaccaacgccgagcctgatggccccacacctgaactggaggaagagatgttcaagaaacgcaatctcaccattatggacctgcatcccggatctggcaagacgagaaaatatcttcctgccatcgttcgggaagctattaaccgcagactgcggacactcatcctggccccgaccagagtggtcgctgccgagatggaggaagcgctcaaggggctgcccattcgctaccagaccacagccaccaagagcgagcacacaggacgggaaatcgtggatcttatgtgccatgctacctttacgatgagactgctgtcccctgttcgcgtgcccaattataacctcatcattatggacgaggcccacttcacagatcctgcttctatcgccgcccggggctacattagcaccagagtcgggatgggagaagctgcggccatctttatgacagctacacctcccggcacggccgacgccttcccccagtccaatgctcccattcaagatgaggagcgcgacatccccgaacggtcttggaacagcgggaatgagtggatcaccgactttgccggcaaaacagtgtggttcgtgccttccattaaggcgggaaacgatatcgctaactgtctgcgcaaaaatggcaagaaagtcattcagctttctagaaagacctttgaaacagagtaccagaagaccaaactgaacgactgggatttcgttgggacaaccgacatcagcgagatgggagccaattttaaggccgatcgggtgattgaccccagacggtgcctcaaacctggcatcctgacggatgggccggaaggagtgattctggctggccccatgcctgtcacagccgcgtccgccgctcagcgcagagggcgggtgggccgcaacccccaaaaggagaatgaccagtatatcttcaccggacagcctctcaacaatgatgaagaccatgcccactggaccgaggctaaaatgcttctggataacatcaatacacccgaaggcattatcccggccctgttcgagcctgagagagaaaagagcgctgccattgacggggagtaccggctcaagggagaatctagaaaaacctttgttgagctgatgcgccggggcgaccttcccgtgtggctggcgcacaaggtcgcctccgaagggatcaaatatacagatagaaagtggtgcttcgacggacagcgcaacaatcaaattctcgaggagaacatggatgtggaaatctggacgaaagagggcgaaaagatcaaactgcggcctagatggctggacgctcgcacctacagcgatcccctcgcccttaaggagtttaaggacttcgctgccggccggaaatctattgccctggatctggttacagaaatcgggagagtgccttcccatctcgctcaccgcaccagaaatgcgctggacaaccttgtcatgctgcatacaagcgagcacggaggccgggcctatcgccacgctgtggaggaactccccgagaccatggaaacgctgctgctccttgggctgatgattctgctcaccggaggcgccatgctgtttcttatctccgggaagggaattggcaaaacatctatcggcctgatctgtgtcattgccagctccgggatgctctggatggctgagatcccgctgcagtggattgccagcgcgatcgtgctggagttctttatgatggttctccttattcctgaacccgagaagcagagaacaccccaggataatcagctggcctacgtggtgatcgggattctgacactcgctgccatcatcgctgccaacgaaatgggcctgcttgagaccacgaaacgggacctgggggtctctaaggaacctggagttgtgtccccgacaagctatctcgatgtggacctgcatcccgcgtctgcctggaccctgtacgctgtcgccacaaccgtgattacccctatgctccgccacacaatcgagaatagcacggctaacgtttcccttgccgctattgccaaccaggcggtggtcctgatgggcctggataaggggtggcccatctctaaaatggacctcggagtgcctctgcttgccctgggctgctacagccaggtcaatcccctcaccctgacagctgccgtgctgctccttattacccattatgctatcatcggccctgggctgcaagccaaggccacaagagaggcgcagaaacggaccgctgccggaattatgaagaacccgacggttgacggcatcattacaatcgatctggaccccgtgatttacgattccaaattcgaaaagcagctcgggcaggtcatgctgcttgtgctgtgtgctgttcaactcctgctgatgagaacctcttgggccctctgcgaggcccttaccctggctacaggacctatcaccacactgtgggaaggcagccccgggaagttttggaatacgaccatcgccgtgtccatggcgaacattttccgcggaagctatctcgccggcgctggcctggccttttctatcatgaaatccgtcgggacaggaaagcggggcaccgggagccagggagagacacttggcgaaaaatggaagaaaaagctgaatcagctctccagaaaggagttcgacctgtacaaaaagtctgggattaccgaggtggatcgcacggaagctaaagagggactgaagcggggcgaactcacccaccatgccgtgagcagaggctccgcgaaacttcagtggtttgttgagcggaacatggtcatccctgaagggcgcgtgattgacctgggatgtggcagagggggatggtcttattactgcgccggcctgaagaaagtgacagaggtccgggggtataccaagggaggccccggccacgaggaaccggttcctatgagcacatacgggtggaatatcgtgaagctcatgtccggaaaagatgtgttctacctgccgcccgagaagtgtgacacccttctgtgcgatattggcgaaagctctccttcccccacagtcgaggagagccgcaccatcagagtgctcaaaatggttgaaccttggctgaagaacaatcaattctgtatcaaagtgctgaacccgtatatgcccgctgtcattgagcacctcgaacggcttcagcgcaagcatgggggaatgctggtgagaaatcctctgtctcggaactccacgcacgagatgtactggatcagcaatggcacagggaacattgtttctagcgtgaatatggtctcccgcctcctgcttaacagatttaccatgacccatcggagacccacaatcgaaaaggacgtggatctgggagccggcacgcgccacgtgaacgctgagcctgagacccccaatatggacgtcattggcgaacggatcaaaagaatcaaggaggaacacaactctacatggcattatgatgacgagaatccgtacaaaacctgggcctatcacgggagctacgaagttaaggctacaggatccggcagctccatgattaacggggtggtgaaactcctgaccaagccttgggacgtcgtgcccatggttacacagatggccatgaccgatacgacccctttcggacaacagcgcgtgtttaaggagaaagtcgacacacggacccccagacctatgcccggcacacgcaaggtgatggagatcaccgcggaatggctgtggcggacgctcgggagaaataaacgcccgcggctgtgcacaagagaggagttcaccaagaaagttcgcacaaacgccgctatgggcgccgtgtttaccgaggaaaatcagtgggattctgctaaggccgccgtcgaggacgaggagttctggaaacttgtggatcgggagagagaactgcataaactcggaaagtgtggcagctgcgtttataacatgatgggaggacgcgagaaaaagctgggcgagtttgggaaagcgaagggatccagagctatttggtacatgtggcttggcgcccggtacctggagttcgaggccctcgggtttctgaatgaagaccactggttctctcgcgagaacagctattccggcgtggaaggagagggcctgcataaactcgggtacatcctgagagatatttctaagatccctggaggcgctatgtatgccgacgatacggctgggtgggacacccggatcacagaggatgaccttcacaatgaagagaagattacccagcaaatggaccccgaacacagactgctcgccaacgcgatctttaaactgacataccagaataaggtcgtgaaagtccagcggcccacccctacaggaaccgtgatggatattatcagccgcaaggaccagagaggctccgggcaagttggcacgtatggacttaacacattcaccaatatggaggcccagctggtgcggcagatggaaggcgagggggtcctcagcaaagctgatctggagaacccgcatctgcccgaaaagaagattacccagtggctcgagacaaaaggagtggaacgcctgaagagaatggccatctctggcgacgattgcgtggttaaacctatcgacgatcggtttgctaacgcccttctggcgctcaatgacatggggaaggtgcgcaaagatattccccaatggcagccttccaagggatggcacgactggcagcaggtccccttctgtagccatcacttccacgagctgatcatgaaggatggcagaaaacttgtggttccttgccggccccaagacgaactgattgggcgcgccagaatctctcagggcgctggatggtccctccgggagaccgcctgtctgggcaaggcttacgcccagatgtggagcctgatgtattttcatcgcagagatctccggctggcttctaacgccatttgctccgcggtgccggtccactgggtgacaacgagccgcaccacatggtccatccatgcccaccatcaatggatgaccacagaggacatgcttaccgtctggaatagagtgtggattgaagacaacccttggatggaggataaaacgcccgttaccacatgggaaaatgtgccttacctggggaagcgggaggaccagtggtgtggaagcctcatcggcctgacctctagagctacatgggcccagaacatccccaccgccattcagcaagtccgcagccttatcgggaatgaggagttcctggattacatgccgtccatgaaacggtttagaaaggaggaagagtctgaaggagctatttggtga

SEQ ID NO: 20461 - RNA, 9873 nt, synthetic construct
  misc_feature 1..9873: note = derived and/or modified CDS sequence (opt5) from DENV-3__JQ922557__SS-prME
  source 1..9873: mol_type = other RNA
accagcctgtgcctcatgatgatcctgcccgccgctcttgccttccacctgacatccagagacggagagcctcggatgattgtggggaagaacgaacgcggaaagtctctcctgtttaagacggcgagcggaatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaacgcctcagcggggctacctgggtggatgtggtcctggagcacggaggctgcgttaccacaatggccaagaataagcccacgctggacattgagctccagaagaccgaagctacacaactggccacccttagaaaactgtgtatcgaggggaagattacaaacatcaccacggattcccggtgccctacacagggagaagcggtgctcccggaggaacaggaccagaattatgtgtgtaaacacacctacgtcgatcgcggctggggcaacgggtgcggactgttcggcaaggggagccttgtgacctgcgccaagtttcaatgtctggagcccattgagggaaaagttgtgcagtatgaaaatctcaagtacacagtcatcatcaccgtgcatacaggcgaccagcaccaggttgggaacgagacgcaaggagtgaccgctgaaattacacctcaggcctctaccacagaggctatcctgcccgaatatggcaccctgggcctcgagtgctcccctagaacggggctggacttcaatgagatgattcttctgaccatgaaaaacaaggcctggatggtccatcggcagtggtttttcgatctccccctgccgtggacaagcggagccaccacagaaacccctacgtggaatcgcaaagagcttctggtgacatttaagaacgctcacgcgaaaaagcaagaagtcgtggttctcggctctcaggagggggccatgcacaccgctctgacaggagccaccgaaatccaaaattccggcgggaccagcattttcgccggccatctgaagtgtagactcaaaatggacaagctggagcttaaaggaatgtcttacgctatgtgcacaaacacgtttgtgctgaagaaagaggtctccgaaacccagcacggcacaatcctcatcaaggtggagtacaagggggaagatgccccctgtaaaattcctttcagcaccgaggacggacaaggcaaggcgcataacgggcggctgatcacagctaatcccgttgtgaccaaaaaggaggaacccgtcaacattgaggccgaacctccgttcggagagtccaatatcgtgattggcatcggggataacgccctgaaaatcaattggtataagaagggctctagcattggaaaaatgtttgaagctacggccagaggcgctcgccggatggccatccttggggacacagcgtgggatttcggatccgtgggcggggttctcaacagcctgggaaagatggtccaccagatttttggctctgcctacaccgctctgttctccggggtgagctgggtgatgaaaatcggcattggagtcctcctgacctggatcggccttaattctaagaacacaagcatgtccttttcttgcattgccatcgggatcattaccctgtatctcggagctgtggttcaggccgacatgggctgtgtgatcaattggaaagggaaggagctgaagtgcggaagcggcattttcgtcacaaacgaggtgcatacgtggaccgaacagtacaaatttcaagcggattcccccaagagactggccacagctatcgccggggcttgggagaatggcgtttgtggcattcgcagcaccacacggatggaaaaccttctctggaaacagatcgccaatgagctgaactatatcctgtgggaaaataacattaagctcaccgtggtcgtgggcgacacgatcggggttctggagcagggaaaaagaacccttacacctcagcccatggagctgaagtactcttggaaaacctggggcaaggccaagattgtgacagctgaaacccaaaactccagcttcatcattgatgggcctaatacacccgagtgcccgtctgcgtcccgcgcctggaacgtctgggaagtggaggactatggatttggcgtgttcaccacgaatatctggctcaaactgcgggaagtctacacacagatgtgtgaccacagactgatgagcgctgccgttaaggatgagcgcgccgtgcacgctgacatgggctactggatcgagtcccagaaaaacgggtcttggaaacttgaaaaagccagcctcattgaggtgaagacctgcacctggcctaagtcccatacactgtggtctaatggagtcctggaaagcgatatgatcattcccaaatccctcgcgggccctatcagccagcacaactatcggcccgggtaccatacccaaacggctggaccttggcacctgggcaaacttgagctggactttaattattgcgaggggacaaccgtggttattacagaaaactgtggaaccagaggcccctctctccgcacaaccacggtgtccggcaaactgatccacgagtggtgctgtcggagctgcaccctgccgcctcttagatacatgggggaagatggatgttggtatggcatggagatccggcccatttctgaaaaggaggagaatatggtcaaatccctcgtgagcgccgggaagtctaagcgcgacaacagcacaatgggagttctgtgcctggccatcctcttcgaagaggtgatgagaggcaaatttgggaagaaacatatgattgctggagtcttcttcacctttgtgctgcttctgtccggccagatcacatggcgggatatggcccacaccctcattatgatcggcagcaatgcgtctgacagaatggggatgggagttacgtacctggctctgattgccacattcaagatccagccctttcttgccctgggcttctttctccgcaaactgacctcccgggaaaacctcatgctgggggtgggacttgctatggccacaaccctgcaactccctgaggatatcgaacagatggctaatggcattgccctggggctgatggcgcttaagctgatcacccagttcgagacatatcagctctggacggccctgattagcctcacctgttccaacacaatctttaccctgacagtcgcttggagaaccgccacgcttattctggctggagtgtctctcctgccggtgtgccaaagctcctctatgcgcaagacagactggctgcccatgaccgtcgccgccatgggcgttcctccccttcctctgttcatctttagcctcaaagataccctgaagagacggtcctggcccctcaatgagggcgtgatggctgtggggctggtctctatccttgcgagctccctgctgcgcaacgacgtgcctatggccggacccctcgttgctggcgggctgcttattgcctgttacgtgatcacaggaaccagcgccgatctgacagtcgaaaaagctgccgacgtgacgtgggaggaagaggcggaacagaccggcgtttctcataacctcctgattacagtggacgataatgggaccatgagaatcaaggacgatgagacagagattatcctcaccgtcctgcttaaaacggctctgcagatcgtgtccggaattttcccgtacagcatccctgccaccctgctcgtctggcacacatggcagaagcaaacccagcggtctggcgtgctgtgggacgttccctcccctcccgaaacacagaaagccgagcttgaagagggcgtgtatcgcattaagcagcaagggatcctgggaaagacccaggtcggcgtgggggttcagaaagagggagtgtttcatacaatgtggcacgtcacgagaggcgctgtgctcacccacaacgggaagcggctggaaccgaattgggccagcgtgaaaaaggatctcatttcttacggaggcggctggcgcctgtccgcgcaatggcagaaaggggaggaagttcaggtcatcgctgtggagcctggaaagaaccccaagaatttccagacaatgcctggcacctttcaaaccacaacgggggaaattggagccatcgcccttgacttcaaacccggcaccagcgggtcccccatcattaacagagagggaaaggtggtcggcctgtatggcaatggggtggttaccaagaatggagattacctgagcggcatcgctcagaccaatgccgagccttatgggccgtctcccgacctcgaagaggaaatgttcaagaaacggaagctgacaattatggatcttcatcctggaagcggccagaccctgaagtacctccccgctatcgtgcgcgacgccattaaaagacggctgagaatcctcatcctggcgcctacgcgcgtcgtggccgctgagatggaagaggcccttaaggggctgcccattcggtatcagacaaccgctaccaaatccgagcacacaggcagagaaatcgttgatctgatgtgccatgccacctttacaatgcgcctcctgtctcctgtgcgggtcccgaactacaatcttattatcatggacgaggcccacttcaccgatcccgctagcattgcggccagaggatacatctccacgcgcgtgggcatgggggaagctgccgccatctttatgacagctacccctcccggaacagccgacgcgttccctcaatctaacgctcccattcaggacgccgagcgggatatcccggaaagaagctggaactccggcaacgagtggattaccgactttgccgggaagacggtttggttcgtgccttctatcaaagctggaaatgatattgccaactgtctgcgcaagaacggcaagaaagtcatccagctcagccggaagacctttgagacagaatatcagaaaaccaagctgaatgactgggatttcgtggtgacaaccgacatttccgagatgggggcgaactttaaagccgatagagtcatcgacccccggcgctgcctgaagcccgttatcctcacagatggccctaagagagtgattcttgctggacccatgcctgacaccgccgctagcgccgctcaacggcgcggcagagtggggcggaatccgcagaaagaaaacgatcagtacatcttccccggacagcctctgaatacggacgaggaccatgcccactggcccgagacaaagctgctcatggatctgtttaccacccctgaaggcattcttccctctcacttcgacccgcatggggagaacttccctgaaatctccggagagtatagactgaaaggcgaaagccgcaagacatttgtcgagctcatgcggagaggggatctgcccgtgtggctggcgcacaaagttgcctctgagggcattaagtacaccgaccgcaaatggtgcttcgatggacaacggaataaccagatcctcgaagagaatatggacgtggaaatctggacaaaggagggcgaaaagaagaaacttagacctcgctggctggatgctcggacgtattccgaccccctggccctcaaagagtttaaagatttcgctgccgggagaaaaagcattgccctggaccttgtcaccgagatcggacgcgtgccttcccatctggctcacagaacacggaacgcgctcgataatctggttatgctgcacacctctgaacatggcgggcgcgcctacagacacgctgtggaggaactccccgagacaatggaaacccttctgctgctcggactgatgattcttctgacgggcggcgccatgctctttctgatcagcgggaagggaattggcaagacctccatcgggctgatctgtgtcattgccagctctggaatgctctggatggctgagatcccgcttcagtggattgcctccgcgatcgtgctggagttctttatgatggtcctgctcattcctgaacccgagaaacaacggacaccccaggacaaccagctggcctatgtggttatcggcattcttaccctggctgccatcatcgctgccaatgaaatggggctcctggagacaaccaagcgcgatctgggaatgagcaaagagcctggcgtggtgtctccgacgagctacctcgacgtcgactcccatcccgcgtctgcctggacactttacgctgttgccaccacagtgattacccctatgctgagacacaccatcgaaaacagcacagctaatgtgtccctggccgctattgccaaccaggcggtcgtgctcatgggcctggataaggggtggcccatctctaaaatggaccttggagttcctctgctcgccctgggctgctatagccaagtgaatcccctgacgctcaccgctgccgtccttctgctgattacacattacgctatcatcgggcctggactccaggccaaggccacccgggaggcgcagaagagaacagctgccggcattatgaaaaacccgaccgtggatgggatcattacgatcgacctggatcccgtcatttatgactccaagttcgaaaaacagcttggacaagtgatgctgctcgttctgtgtgctgtgcagctgctccttatgcgcacaagctgggccctgtgcgaggccctgaccctcgctaccggccctatgacaaccctgtgggaaggctctcccgggaagatctggaacacaacgatcgccgtctccatggcgaatatttttcggggaagctaccttgccggcgctgggctggccttctccatcatgaaatctgtgggaaccggcaagagagggacaggaagccagggcgagaccctcggcgagaagtggaaaaagaaactgaaccagctgtcccgcaaggaatttgatctctataaaaagtctgggattacagaggttgaccggaccgaagctaaagagggacttaagagaggcgaaacgacccaccacgccgtgagccgggggtccgcgaagctgcaatggttcgtcgagcgcaatatggtgatccctgagggaagagtgattgatctgggctgtgggcggggaggctggagctactattgcgccggcctcaaaaaggttacagaagtccgcgggtacaccaaaggaggccccgggcatgaggaaccggtgcctatgtctacatacggatggaacatcgtgaagctgatgtccggcaaagacgtcttttatcttccgcccgagaagtgtgataccctgctctgcgacattggggaaagctctccttcccccacagttgaggagagcagaaccatccgggtgctgaagatggtggaaccttggctgaaaaataaccagttctgtatcaaggtcctcaatccgtacatgcccgctgtgattgagcaccttgaacgcctgcagagaaaacatggaggcatgctggttcggaaccctctctctcgcaatagcacgcacgagatgcactggatctccaacggcacagggaatattgtgtctagcgtcaacatggtgtccagactgcttctgaatcggttcaccatgacccatagacgccccacaatcgagaaggatgttgacctcggagccggcacgcggcacgtgaacgctgaacctgagacccccaatatggacgtcattggggaaagaatcaaacgcatcaaggaggaacataacagcacatggcactatgatgacgagaacccgtacaagacctgggcctatcatggatcctacgaggtgaaagctacaggctctgccagctccatgattaatggggtggtcaagctgctgaccaaaccttgggatgttgtgcccatggtgacacaaatggcgatgaccgacacgaccccttttggacagcagcgggtcttcaaggaaaaagtggatacaagaacaccccgccctatgcccggcacacggaaggttatggagatcaccgccgaatggctctggagaacgctgggccgcaacaagcggccgagactttgcacacgcgaggaatttaccaaaaaggtgcggacaaatgctgccatgggggctgtcttcaccgaggagaaccagtgggactctgccaaagccgcggtggaagatgaggaattttggaagctggttgacagagagcgcgaactccacaaactgggaaagtgtggcagctgcgtgtataatatgatggggaaaagagagaagaaacttggagagttcggcaaagctaaggggtcccgggccatttggtacatgtggctgggcgcccgctacctcgaatttgaggctctgggattcctgaacgaagatcactggttttctagagagaatagctattccggcgtcgagggggaaggactccataaactgggctacatccttcgggacattagcaagatccctgggggagccatgtatgctgatgacacggccggctgggacaccagaatcacagaggatgacctgcacaacgaagagaaaattacccaacagatggatcccgaacatcggctcctggcgaatgccatcttcaaacttacataccagaacaaggtggttaaagtgcagcgccccacccctacagggaccgtcatggacattatctctagaaaggatcaacggggctccggacaggtgggcacgtatgggctgaatacatttaccaacatggaggctcagctcgtccgccagatggagggagaaggcgtgctgagcaaagccgacctggagaatccgcacctccccgaaaagaaaattacccaatggctggagacaaagggggttgaaagacttaagcggatggctatctctggagatgactgcgtggtcaaacctatcgatgaccgcttcgccaacgcgctgctcgccctgaatgatatgggcaaggtgagaaaagacattccccagtggcagccttccaaggggtggcacgattggcagcaagtgcccttttgtagccatcacttccatgagcttatcatgaaagacggccggaagctggttgtgccttgccgcccccaggacgagctcattggccgggctcggatctctcagggcgccgggtggtccctgcgcgaaaccgcttgtctgggaaaggcctacgctcaaatgtggagcctcatgtatttccacagacgggatctgcgccttgcctccaacgcgatttgcagcgccgtcccggtgcattgggttcctacatctagaacgacctggagcatccacgctcaccatcagtggatgacaaccgaggacatgctgacagtgtggaaccgggtctggattgaagataatccctggatggaggacaaaacccctgtgacgacctgggaaaaccctccctacctcggcaagagagaggatcagtggtgtgggtccatcatcggactgtctagccgcgccacatgggcccagaatattcccaccgctatccaacaggtccggtcccttattggcaacgaggaatttctggactacatgccctctatgaaaagattccgcaaggaggaagagagcgagggggccatctggtga

SEQ ID NO: 20462 - RNA, 9873 nt, synthetic construct
  misc_feature 1..9873: note = derived and/or modified CDS sequence (opt5) from DENV-3__JQ922555__SS-prME
  source 1..9873: mol_type = other RNA
accagcctctgcctcatgatgatcctgcccgccgctcttgccttccacctgacatcccgggacggcgaacctcggatgattgtggggaagaatgaacgcggaaaatctctcctgtttaagacggcgagcggcatcaatatgtgtacccttattgctatggatctgggggagatgtgcgacgataccgtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcatacaggggaccagcaccaggttggaaacgagacgcaaggcgtgaccgctgaaattacaccccaggcctccaccgctgaggccatcctgcctgaatatggcacactggggctcgagtgcagcccccgcaccggactggacttcaatgagatgattcttctgacgatgaaaaacaaggcctggatgggccatagacagatgctctttgatctgcctaccccctggacatctgggaccacaaccgaaacgtccgcttggaatcggaaagagccgttcgtcacatttaagaacgcgcacaccaaaaagcaagaagtggtcgtgcttggaagccaggagggcgccatgcacacagctctgaccggggccaccgaaatccaaaattctggcggaacatccattttcgccggccatctcaagtgtcgcctgaaaatggacaagctggagctcaaagggatgagctacgctatgtgcacgaacacctttgttctgaagaaagaggtgtccgaaacacagcacggaaccatccttgtcaaggtggagtacaagggcgaagatgccccttgtaaaatccccttctctacagaggacgggcaaggaaaggcgcataacggcagactgattaccgctaatcctgttgtgacgaaaaaggaggaacccgtcaacatcgaggccgaaccccctttcggggagagcaatattgtgatcggcattggagataaagccctcaagatcaactggtatcggaagggctccagcatcgggaaaatgtttgaagctacatctagaggagcccgccggatggctattctgggcgacaccgcctgggatttcgggtccgtgggaggcgttctgaatagccttgggaagatggtccaccagatctttggctctgcgtacaccgccctcttcagcggagtgtcctgggtgatgaaaattggcatcggggtcctgctgacatggattggactcaactctaagaataccagcatgtcctttagctgcatcgctattggcatcatcacactgtatcttggggccgtggttcaggctgacatgggatgtgtgattaactggaaaggcaaggagctgaagtgcgggtctggcatcttcgtcacgaatgaggtgcatacctggacagaacagtacaaatttcaagccgattccccgaagagactcgcgaccgccattgctggagcctgggagaacggcgtttgtgggatccgcagcacaacccggatggaaaatctgctgtggaaacagattgctaacgagcttaattatatcctctgggaaaacaatatcaagctgacggtggtcgtgggagacaccattggcgttctggagcaggggaaaagaacactcacaccccagcctatggagctgaagtactcttggaaaacatggggaaaggccaagatcgtgaccgccgaaacacaaaactccagcttcattatcgatggccccaacacccctgagtgcccctccgcttctcgcgcgtggaatgtctgggaagtggaggactatggctttggggtgttcacgacaaacatttggcttaaactgcgggaagtctacacccagatctgtgaccacagactcatgagcgccgctgttaaggatgagcgcgccgtgcacgccgacatgggatactggatcgagtcccagaaaaatggctcttggaagctggaaaaagctagcctgattgaggtgaagacctccacatggcccaagagccataccctttggtctaacggggtccaggaatccgatatgatcattcctaaaagcctcgccggacccatctctcaacacaattatcggcctggctaccatacgcagacagcggggccctggcacctgggaaagctggagctcgactttaactattgcgagggcaccacagtggttattaccgaaaattgcggcacaagagggccttccctgcgcaccacgaccgtgagcggaaaacttatccacgagtggtgttgccggtcttgtacactgcccccgctcagatacatgggcgaagatgggtgctggtatggaatggagatccggcctattagcgaaaaggaggagaacatggtcaaatccctggctagcgccggctctgggaaggtggacaatttcaccatgggagttctgtgtcttgccatcctctttgaagaggtgatgcgcggcaagttcggcaaaaagcatatgattgctggggtcctgttcacatttgtgctgctcctgtccggacagatcacctggagagatatggcccggacgcttattatgatcggcagcaacgcgtccgacagaatggggatgggagttacatacctggctctcattgccaccttcaaaatccaaccctttctggccctgggcttctttcttcgcaagctgacatctcgggaaaatctcctgctcggggtgggactggctatggccaccacccttcagctgcccgaggatatcgaacagatggctaacggcattgccctcggcctgatggcgctgaaacttatcacacagttcgagacgtatcaactgtggaccgccctcgtcagcctgacatgctccaataccatttttacactcaccgtggcttggagaacggccacactgatccttgctggggtgtctctgctccctgtctgtcagagctcctctatgcgcaagaccgactggctgccgatgaccgttgccgccatgggagtgccccctctgccccttttcatttttagcctgaaggatacactcaaaagacggtcctggcctctgaacgagggcgtgatggctgtcgggctcgtgagcatcctggcgtcttcccttctgcgcaatggagttcccatggccggccctctggtggctgggggactcctgatcgcctgctacgtcattaccggcacaagcgccgaccttacggtggaaaaggctgccgatgttacctgggaggaagaggcggaacagacaggcgtgtctcacaacctgatgatcaccgtcgacgacgatgggacaatgagaattaaagacgatgagaccgagaacatcctcacggtgctgctcaagaccgctctgcttattgtctccggaatcttcccctacagcatcccggccacactgctggtgtggcatacctggcagaaacaaacacagcggtctggcgttctctgggacgtgcctagcccgcctgaaacccagaaggccgagctggaagagggggtctatcgcattaaacagcaaggaatctttggcaagacacaggtgggggttggagtgcagaaggagggcgtcttccacacgatgtggcatgtgaccagaggcgctgtgcttacacacaatgggaaacggctggaacccaactgggccagcgttaagaaagatctcatttcctacggaggcgggtggcgcctgagcgcgcaatggcagaagggagaggaagtccaggtgatcgctgtggagccgggcaaaaatcctaagaactttcagaccatgcccgggaccttccaaacaacgtctggagaaattggcgccatcgccctcgacttcaagcctggcaccagcgggtcccccattatcaatagagagggaaaagtcgtgggcctgtatgggaacggagttgtgacaaagaatggcgggtacgtctctggcatcgctcagaccaacgccgagcccgatggacctacaccggaacttgaggaagagatgtttaaaaagcggaatctgaccattatggacctgcaccccggcagcgggaaaacgcgcaagtatctccctgctatcgtgagagaagccattaagcggagactgcgcacacttatcctggcgcccacccgggttgtggccgctgagatggaggaagccctcaaaggactgcctattagataccagaccacagctaccaagtccgagcatacaggccgcgaaatcgtcgatctcatgtgtcacgccaccttcacgatgcggctgctttctcccgtgagagttcctaactataatctgatcattatggacgaggcccattttacagatccggctagcatcgcggcccgcgggtacatttccacccgggtgggaatgggcgaagctgccgccatcttcatgacagctacaccccctgggacggccgacgcgtttccccagtctaacgctcctattcaagatgaggagagagacatccccgaacgcagctggaactccggcaacgagtggatcaccgacttcgccggaaaaacagtctggtttgtgccgagcattaaggccggcaatgatatcgctaactgcctgcggaaaaacgggaagaaggtgattcagctctctagaaaaaccttcgacacagaataccagaagaccaaactgaatgattgggactttgtcgttacaaccgatatctccgagatgggagccaacttcaaggcggaccgggtgattgatcctcgcagatgtcttaaacccgtgatcctgacggacggccccgagcgggtcattctcgccgggcctatgcccgtgacagctgccagcgctgcccagcgcagaggacgggttggcagaaatcctcaaaaggaaaacgatcagtatatctttaccgggcagccgctgaataacgacgaggatcacgctcattggaccgacgccaagatgctgctcgaaaatatcaacacacccgagggcattatccctgcgcttttcgaacccgagcgcgagaaatctgccggactggacggcgaataccggctgaagggggagtccagaaaaaccttcgtggaactcatgcgccggggagatctgcctgtctggcttgctcacaaggtggccagcgagggcattctgtatacagacagaaaatggtgctttgatgggcagcgcaataaccaaatcctcgaagagaatatggacgttgagatttggacgaaggaaggagagaaaaagaagctgcggcccagatggctggatgctcgcacctactccgacccgctcgcccttaaagagttcaaggattttgccgctggcagaaaatctatcgcgctggacctggtgacagagatcggccgggtcagctcccacctcgcccatcgcaccagaaacgctctggataataagatgatgcttcacacaagcgaatatgggggacgggcctaccgccatgccgtggaggagctgcctgaaaccatggagacgctcctgctgctcggccttatgattctgctgaccgggggagctatgctgttcctgatctctggcaaagggattggaaagacatccatcggccttatttgcgtcatcgccagctctggcatgctgtggatggcggacgtgcccctccagtggatcgccagcgctattgttctggaatttttcatgatggtgctgctcatccctgagcccgagaagcagagaacccctcaagataaccagcttgcctatgtggtcattgggatcctgacactggctgccattatcgcggccaatgaaatgggactcctggagaccacgaaacgggaccttggcgtttccaaggaacccggggtggtgtctccgacaagctacctggatgtcgacctccaccctgcttccgcctggaccctgtacgctgtggccacaaccgttattgctcccatgctgagacacaccatcgagaactctacagccaatgtgagcatggcggccatcgctaaccaggccgtcgtgctcatgggacttgacaaaggctggcccatttccaagatggatctgggggtccctctgctcgctctgggatgttatttttacgtgaacccgcttacgctgaccgccgccgttttcctcctggtgacacattatgcgatcattggccccggcctgcaggctaaagccacccgcgaagctcacaagaagacagccgccgggatcatgaatcctccccctggagacggcattatgaccatcgatctcgaccccgtcatctacgatagcaaatttgagaagcaacttggacaggtgatgctgctggttctctgcgctgtgcagctgcttctgatgcggacgtcttgggccctctgtgaggcgctgacactggccaccggacctaccacaaccctctgggaaggctccccggggaaattctggaacacaacgattgctgtcagcatggccaatatctttagaggatcctatcttgctggcgccggcctggcgttctctattatgaagtccgtggggaccggaaaacgcggcacagggtcccagggagagaccctgggcgaaaagtggaagaaaaagctcaaccaactgtctcggaaagagtttgacctttacaagaaaagcgggatcacagaagtggatagaaccgaggccaaggagggactgaaacggggcgaaattacgcatcacgctgtttcccgcggcagcgccaagctccagtggttcgtcgagagaaatatggtgatccccgaagggcgggtgatcgacctgggatgcggcaaaggcgggtggtcttattactgtgctgggctgaaaaaggtcaccgaggttcgcgggtacacaaaaggaggccctggccatgaagaacccgtgcctatgtccacctatgggtggaacattgtgaagctcatgagcggaaaagatgtcttctaccttcccccggagaagtgcgacacactgctgtgtgatatcggcgaatcttcccctagccccaccgtggaggaatctagaacaattcgggttctcaagatggtggagccctggctgaaaaataaccagttttgcatcaaggtccttaatccttatatgcccaccgtgattgagcacctggaacgcctccagagaaaacacgggggaatgctggttcggaaccctctgagccgcaattccagaaacgagatgtactggatctctaatggcacggggaacattgtgagctccgtcaatatggtgagccggctccttctgaacagattcacaatgacccatcgccggccgaccatcgaaaaggacgtggatctgggagccggcacaagacacgtcaacgctgagcccgaaacgcctaatatggacgttatcggcgagcgcattaaacggatcaaggaggaacataactccacctggcactatgacgatgagaatccctacaagacatgggcctatcacgggtcttacgaagtgaaagcgaccggaagcgcctcctctatgattaacggcgtggtcaagctcctgacaaaaccttgggacgtggttcccatggtgacccaaatggctatgacagataccacgccgtttgggcagcagagagtcttcaaggagaaagtggacacccgcacacctcggcttatgcccagaacccgcaaggttatggaaatcacagccgagtggctgtggcggaccctcggaagaaataagcgccctcggctgtgtacgagagaggaatttaccaagaaggtgcgccccattgctgccatgggcgccgtcttcacccaaagagatcagtgggacagcgcgaaagctgccgtggaggatgaagagttttggaagcctgttgaccgggaatgcaactcccatcagctggggaaatgtggctcttgcgtgtacaatatgatgggaaagcgcgagaaaaagctcggcgagttcgggaaggccaaaggaagcagagctatctggtatatgtggctgggcgcccggtaccttgaatttgaggctctggggttcctcaacgaagatcactggttttccagagagaatagctattctggagtcgagggcgaagggctgcataaacttggctacatcctgcgggacatttccaaaatccccggaggcgccatgtatgcggatgacacagccgggtgggacacccgcaacacggaggatgacctccacatgaaggagaagattacccagcaaatgggaccgggccatagcagactggctaatgccatcttcaagctgacataccagaacaaggtggtcaaagtgcagcggcctacccccacagggaccgttatggatattatctctcgcaaggaccagagaggatccggccaagtggggacatatggcctcaatacctttacgaacatggaggctcagctggtccggcagatggaaggagagggcgtgcttagcaaagccgatctggagaatccccacctcctggaaaagaaaatcacacagtggcttgagaccaagggggtggaacgcctgaagagaatggcgatttctggagacgattgcgttgtgaaacctatcgacgatcggttcgccaacgctctcctggccctgaacgacatgggcaaggtccgcaaagatattccgcaatggcagccctccaaggggtggcacgactggcaacaggtgcctttctgtagccatcactttcatgagctcatcatgaaagatggaagaaagctggttgtgccctgccggcctcaagacgaacttattggccgcgctagaatctcccagggggccggctggagcctgcgggagaccgcttgtctcggaaaggcctacgcgcagatgtggtctctgatgtacttccaccgcagagaccttcggctggccagcaatgctatctgctccgccgtccccgtgcactgggtccctacatctagaaccacatggagcattcatgcccaccatcaatggatgacgaccgaggatatgctcacagtgtggaaccgcgtttggatcgaagacaatccctggatggaggataaaaccccggtgacaacctgggaaaacgtcccttatctgggcaagcgggaggaccagtggtgtgggtccctgattggactcacgtctagagctacctgggcccagaatatccccacagcgattcagcaagtgcgcagcctgatcggcaacgaagagtttcttgattacatgccttccatgaaacggttcagaaaggaggaagagtctgaaggggctatttggtga

SEQ ID NO: 20463 - RNA, 9873 nt, synthetic construct
  misc_feature 1..9873: note = derived and/or modified CDS sequence (opt5) from DENV-3__GU131903__SS-prME
  source 1..9873: mol_type = other RNA
acctccctgtgcctgatgatgatgctgcccgccacccttgctttccacctgacgtcccgggacggcgaacctcggatgatcgtggggaagaacgaacgcgggaaatctctcctgtttaagaccgccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagcacgaaaacctgaagtataccgtgattatcacagtccatacgggggaccagcaccaggtgggaaatgacacccaaggcgttacagtggagatcacccctcaggcttccacagtcgaagccgtgctgcccgagtacggcaccctcgggctggaatgcagccctcgcacgggacttgatttcaacgagatgattctgctcaccatgaaaaataaggcttggatggtccatagacagtggtttttcgacctgccccttccgtggacatctggcgccaccacagagacccctacgtggaaccggaaagaactgctcgtgacatttaagaatgcccacgctaaaaagcaagaggttgtggtcctggggtcccaggaaggagcgatgcacaccgccctgacaggcgctaccgagatccagaacagcgggggcacctctattttcgccggacatctcaagtgtcgcctgaaaatggataaacttgaactgaaaggcatgtcctatgccatgtgcctcaatacatttgtgctgaagaaagaggttagcgagacgcagcacgggaccatcctgattaaggtggaatacaagggagaggacgctccctgtaaaatccctttctccacagaagatggccaagggaaggcccattctggaagacttatcaccgcgaaccccgtcgtgaccaagaaagaggagcccgtgaacattgaagctgagcctccgttcggcgaaagcaatatcgttattgggatcggcgacaaagccctcaagattaactggtacaagaaaggatccagcatcggcaagatgtttgaggccaccgctagaggggccagacgcatggctatcctgggagatacggcctgggacttcggctctgtcgggggagtgctcaattccctcggcaaaatggtgcaccagatttttgggagcgcgtatacagccctgttctctggcgtcagctggatcatgaagattggaatcggcgtgcttctgacctggattgggctcaactccaaaaatacctctatgagcttttcctgcatcgttattggaatcatcacactgtacctgggcgctgtggtccaggccgatatggggtgtgtgattaactggaagggaaaggaacttaaatgcggcagcgggatcttcgttaccaatgaggtgcatacatggacggagcagtataagtttcaagctgactctcccaaacggctcgccaccgcgattgccggcgcttgggaaaacggagtctgtggcatcagatccacaacccgcatggagaatctgctgtggaagcagattgccaacgaactcaattacatcctgtgggagaacaatatcaaacttacagtggttgtgggggatattatcggagtcctggaacagggcaagcggaccctcacgcctcagcccatggagctgaaatatagctggaagacctgggggaaggctaaaattgtgacagccgagacccaaaactcttccttcatcattgacggacctaatacacccgaatgcccgaacgccagcagagcttggaacgtgtgggaggtcgaagactacggctttggcgttttcaccacaaatatctggctgaaacttcgcgaggtgtatacccagtcctgtgatcaccggctcatgtctgcggccatcaaagacgaaagagctgtgcacgccgatatggggtactggattgagagccagaagaacggatcctggaaactggagaaggcctcttttatcgaagtcaagacgtgcacatggcctaaaagccataccctgtggtccaatggcgtgctcgagagcgacatgattatccccaagtctctggctgggcctatttcccagcacaaccatcgccccggataccacacccaaacagccggcccttggcaccttgggaaactggaactcgatttcaattattgcgagggaaccacggttgtgatcacagagaactgtggcacccggggccccagcctgagaacaaccacagtctctgggaagctgatccatgaatggtgctgtcgctcctgcacccttccgcctctccggtacatgggagaggacggctgttggtatgggatggaaattagacccatcaatgagaaagaagagaacatggttaagagcctggtgtctgcgggaagcggcaaggtggataattttacgatgggggtcctgtgcctcgctattctgttcgaggaagtgatgcggggaaaattcggcaagaaacacatgatcgccggcgttctttttaccttcgtgctgctcctgtccgggcagattacatggcgcgacatggcccataccctgatcatgattggaagcaacgcttctgatagaatgggcatgggggtcacataccttgccctgatcgcgacctttaagatccagcccttcctcgctctgggatttttcctccggaaactgacgtccagagagaatcttctgctcggcgtggggctggccatggccacaaccctgcaacttcctgaagacattgagcagatggctaacggaatcgccctgggcctcatgacactgaagctcattacccagtttgaaacctatcagctgtggacagctcttgtgagcctgacgtgttccaataccatcttcacactcaccgtcgcctggcgcacagcgaccctgattctggccggcgtttctcttctgccgctctgccaaagctcctctatgcggaagacggattggctgcccatgacagtggctgccatgggggtgcctcccctccctctgtttatcttcagccttaaagacacccccaagagacgctcctggcctctgaacgagggagtcatggctgtgggcctggtttctatcctcgccagctccctgcttagaaatgatgtgcccatggccgggccgctggtcgctggaggcctcctgattgcgtgttacgtgatcaccgggacaagcgccgacctcaccgttgagaaagctgccgacgtgacatgggaagaggaagccgagcagacgggagtctctcacaacctgatgattaccgtggatgacgatggcacaatgcggatcaaggacgatgaaaccgagaacattcttacagtcctgctgaaaaccgctctcctgatcgtgtccggcatctttccttatagcattcccgccacgcttctggtttggcatacctggcagaagcagacacaacgctctggggtgctctgggacgtcccttctcccccggagacccagaaagcggaactggaggaaggagtgtacagaatcaagcagcagggcattttcgggaagacacaagttggagtgggcgtccagaaagagggggtgtttcacaccatgtggcacgtgacacggggagctgttctcacgcataatggcaagcgcctggagcctaactgggccagcgtcaaaaaggatcttatcagctacggcgggggatggagactgaatgcccagtggcaaaaaggcgaagaggtccaggtgattgctgtcgaacccgggaagaaccctaagaatttccagaccatgcccggaatcttccagacaaccaccggcgagattggggccatcgcgctggactttaaacccggaacatccggcagccctatcattaaccgggaaggcaaggtggttgggctctatggaaatggcgtggtcacgaaaaacgggggatacgtgtccggcatcgctcaaaccaatgccgagccggatgggcccacacctgagctggaagaggaaatgttcaagaaacgcaaccttaccattatggacctgcaccccggcagcggaaagacaagaaagtatctccctgccatcgttcgggaggctattaaacgcagactgcggaccctcatcctggcccccacgagagtggtcgctgccgaaatggaggaggcgcttaagggcctgcctatccgctaccagacaaccgccaccaaatctgaacatacagggcgggagattgtggatctgatgtgccacgctacctttacaatgagactcctgagcccggttcgcgtgcccaattataaccttgtcatcatggacgaagcccatttcaccgatcctgcttccattgccgcccggggatacatctctacgagagtgggcatgggggaggctgcggccatttttatgacagctacaccccctggaacagccgaagccttcccccagagcaatgctccgatccaggacgaggagcgcgacatccctgaacggtcctggaactctggcaatgagtggattaccgattttgtggggaagacggtctggttcgttcccagcatcaaagccggcaacgacattgcgaactgtctgagaaagaatggaaagaaagtgatccaactctcccgcaagacctttgatacagaatatcagaaaacccggctgaacgactgggatttcgtggtcacaaccgacatttctgagatgggcgctaattttaaggccgatagagtgatcgacccccggcgctgcctgaaacctgttattctcacagatgggcccgagagagtgatccttgccggacctatgccggtcaccgctgccagcgcggcccagcggcgcggcagagtggggcggaacccccagaaggaaaatgaccaatacatcttcacgggacagcctctgaacaatgatgaggaccacgctcactggacagaagccaagatgctgctcgacaacattaatacccccgagggcatcattcctgctctgttcgaacccgagagagagaaatccgccgctatcgatggggaataccgccttaagggcgagagccggaaaacctttgttgaactgatgagacgcggagacctcccggtgtggctggcccataaggtcgcgtctgagggcattaaatatacagatcggaagtggtgcttcgacggggaaagaaacaatcagatcctggaggagaacatggatgtggaaatctggaccaaagagggagaacgcaagaagctccggcctagatggcttgacgcccgcacatactccgatcccctggctctgaaagagtttaaggacttcgccgctggcagaaaaagcattgccctcgatctggtcacggaaatcgggcgggtgccttctcaccttgcccatcgcaccagaaatgctctggacaacctcgttatgctgcacacatccgagcacggaggccgggcgtatcgccatgccgtggaggaactgcccgagaccatggaaacactccttctgctgggcctcatgattctgcttaccgggggagctatgctgtttctcatcagcggcaaggggattggaaaaacgtccatcggcctgatctgtgtgattgtctctagcgggatgctgtggatggccgatgttcctctccagtggatcgcctccgctattgtgcttgagttctttatgatggtgctgctgatccccgagccggaaaagcaaagaacccctcaggacaatcagctcgcctacgtcgtgattggaatcctgacacttgcggccattgttgctgccaacgagatgggcctgctcgaaaccacaaagcgggatctgggcatgagcaaagagcccggggtggtctctcccacctcctatctggacgtggacctccaccctgctagcgcctggacgctttacgcggtcgccacaaccgtgatcacaccgatgctgagacataccatcgaaaattctaccgctaacgttagcctggccgctattgccaaccaagctgtggtcctcatgggactggataagggctggcccatctccaaaatggaccttggggtgcctctgctcgccctgggatgctattctcaggttaatcccctgacactcacggcggccgtgcttctgctggtcacccactacgctattatcggccctgggctccaggccaaggctacacgcgaggcccagaaacggaccgccgcgggaattatgaagaaccccacagtggatggcatcatgaccatcgacctggatcctgtgatttacgacagcaagttcgagaaacaacttggccaggttatgctgctcgtcctgtgtgctgtgcagctgctccttatgagaacgtcctgggccctgtgcgaagctctgacactcgccaccgggccgatcaccacactgtgggagggatctcccggcaagttttggaataccacaattgccgtgagcatggctaacatcttccgcgggtcctatcttgccggagcgggcctggcctttagcattatgaaatctgtcgggacgggacggagaggcaccggctcccagggggaaacactcggagagaagtggaaaaagaagctgaatcaactgagccggaaagagttcgatctctacaagaaatccggcatcaccgaggttgaccgcacagaggctaaggaagggcttaaaagaggagagaccacgcatcacgccgtgtctcggggcagcgctaagctgcagtggtttgtggaacgcaacatggtcatccctgaggggagagtgattgatctgggatgtggccggggcgggtggtcctattactgcgccggactcaaaaaggttaccgaagtgcgcggctatacaaaggcggggcccggacacgaggagcctgtccccatgtctacctacggctggaatatcgtgaaactgatgagcgggaaggacgttttctatcttccgcctgaaaaatgtgatacactgctctgcgacattggagagtccagcccctctcccaccgtggaagagtccagaacaatccgggtcctgaagatggtggagccttggctgcgcaacaatcagttctgtattaaagtgctcaacccctacatggccaccggcatcgaacatcttgagagactgcagcggaagtacggcgggatgctggtcagaaatcctctcagccgcaactctacgcacgaaatggattggatttccaatggaacaggcaacatcgttagctctgtgaatatggtgagccggctgcttctgaacagatttaccatgacccatcgccggccgacaatcgagaaggacgtcgacctcggggctggaacgagacacgtgaacgccgaacccgagacccctaatatggatgttattggcgagcgcatcaaacggattaaggaagaacactcctctacatggcattatgacgatgaaaacccctacaaaacctgggcttatcacgggagctacgaggtgaaggccacaggatccgctagctccatgatcaatggcgtcgtgaaactgctgaccaagccttgggacgttgtgcccatggtcacacaaatggccatgaccgatacgaccccgttcggccagcagagagtgtttaaggaaaaagttgacacacgcacccctcggcccatgcctgggacaagaaaggtgatggagattaccgcggagtggctctggcgcacgctgggacggaacaaaaagcccagactttgcacacgcgaagagttcaccaaaaaggtcagaacaaatgccgctatgggcgccgtgtttaccgaagagaaccaatgggattctgctcgggccgccgtcgaagacgaggagttctggaagctggtggatcgcgaaagagagctccataaactggggaagtgtggaagctgcgtttataatatgatgggcaaacgggaaaagaaacttggggagtttggcaaggcgaaaggatccagagctatctggtacatgtggctgggcgcccggtatctcgagttcgaagccctggggtttctgaacgaggaccactggttctctcgcgaaaatagctactccggagtggagggcgaagggctccataagctgggatacatccttagagatatttctaagatccctggcggggctatgtatgccgacgacacggctggctgggatacccggattacagaggacgatctgcacaacgaggagaagatcacccagcagatggaccccgagcaccgccagctcgccaatgcgatttttaagctgacataccaaaacaaagtcgtgaaggtgcagagaccgacccctaaaggaacagttatggatatcatcagccggaaggaccagcgcggctccggacaggtgggaacctatggccttaatacgttcacaaacatggaagcccaactggtcagacagatggagggggaaggagtgctcagcaaggctgatctggagaatccccatctgctcgagaaaaagattacccagtggctggaaaccaaaggcgttgagcggcttaagcgcatggccatctctggggacgattgcgtggtcaaacccattgacgatagatttgctaacgccctgctcgcgctgaacgacatgggcaaggtgcggaaggatatccctcagtggcaaccgtccaaaggatggcacgactggcagcaggtccccttctgtagccatcacttccacgaacttattatgaaggacggccgcaaactggtggttccttgcagaccccaggatgagctcatcgggcgggcccgcatctctcaaggagctggctggtccctgaaggaaacagcctgtctggggaaggcttacgcccagatgtggagcctcatgtattttcatagacgggacctgagacttgcttctaatgccatttgctccgcggtgcctgtccactggatccccaccagccgcacaacgtggtccattcatgcccaccatcagtggatgaccacagaggatatgctgaccgtgtggaaccgggtttggatcgaggacaatccttggatggaagataagacacccgtgaccacgtgggaggacgtcccgtacctcggaaagagagaagatcaatggtgtggcagcctgattgggcttacctctcgcgctacatgggcccagaacatcctgaccgccattcaacaggtgcggagcctcatcggcgacgaggagttcctggattatatgccttccatgaaaagatttcgcaaggaagaggaatctgagggagctatctggtga

SEQ ID NO: 20464 - RNA, 9873 nt, synthetic construct
  misc_feature 1..9873: note = derived and/or modified CDS sequence (opt5) from DENV-3__GU131904__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaagtctctcctgtttaagaccgccagcggcattaatatgtgtacacttatcgcgatggatctgggggagatgtgcgacgataccgtgacatacaagtgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggaaaatagcatcaaacttacagtggttgtgggggatattatcggagtcctggaacagggcaagcggaccctcacgcctcagcccatggagctgaaatacagctggaagacctgggggaaggctaaaattgtgacagccgagacccaaaactcttccttcatcattgacggacctaatacacccgaatgcccgagcgcctccagagcttggaacgtgtgggaggtcgaagactatggctttggcgttttcaccacaaacatctggctgaaacttcgcgaggtgtacacccagtcttgtgatcatcggctcatgagcgcggccatcaaagacgaaagagctgtgcacgccgatatggggtactggattgagtcccagaagaatggatcttggaaactggagaaggccagctttatcgaagtcaagacgtgcacatggcctaaatcccacaccctgtggagcaacggcgtgctcgagtctgacatgattatccccaagtccctggctgggcctattagccagcataatcaccgccccggatatcatacccaaacagccggcccttggcaccttgggaaactggaactcgatttcaactactgcgagggaaccacggttgtgatcacagagaattgtggcacccggggcccctctctgagaacaaccacagtctccgggaagctgatccacgaatggtgctgtcgcagctgcacccttccgcctctccggtatatgggagaggacggctgttggtacgggatggaaattagacccatcaacgagaaagaagagaatatggtgaagtctctggttagcgcgggatccggcaaggtggataactttacgatgggggtcctgtgcctcgctattctgttcgaggaagtgatgcggggaaaattcggcaagaaacatatgatcgccggcgttctttttaccttcgtgctgctcctgagcgggcagattacatggcgcgacatggcccacaccctgatcatgattggatctaatgcttccgatagaatgggcatgggggtcacatatcttgccctgatcgcgacctttaagatccagcccttcctcgctctgggatttttcctccggaaactgacgagcagagagaaccttctgctcggcgtggggctggccatggccacaaccctgcaacttcctgaagacattgagcagatggctaatggaatcgccctgggcctcatgacactgaagctcattacccagtttgaaacctaccagctgtggacagctcttgtgtccctgacgtgttctaacaccatcttcacactcaccgtcgcctggcgcacagcgaccctgattctggccggcgttagccttctgccgctctgccaatcctctagcatgcggaagacggattggctgcccatgacagtggctgccatgggggtgcctcccctccctctgtttatcttctcccttaaagacacccccaagagacgctcttggcctctgaatgagggagtcatggctgtgggcctggttagcatcctcgcctccagcctgcttagaaacgatgtgcccatggccgggccgctggtcgctggaggcctcctgattgcgtgttatgtgatcaccgggacatctgccgacctcaccgttgagaaagctgccgacgtgacatgggaagaggaagccgagcagacgggagtctcccataatctgatgattaccgtggatgacgatggcacaatgcggatcaaggacgatgaaaccgagaacattcttacagtcctgctgaaaaccgctctcctgatcgtgagcggcatctttccttactctattcccgccacgcttctggtttggcacacctggcagaagcagacacaacgctccggggtgctctgggacgtcccttctcccccggagacccagaaagcggaactggaggaaggagtgtacagaatcaagcagcagggcattttcgggaagacacaagttggagtgggcgtccagaaagagggggtgtttcataccatgtggcacgtgacacggggagctgttctcacgcacaacggcaagcgcctggagcctaattgggcctccgtcaaaaaggatcttatctcctatggcgggggatggagactgagcgcccagtggcaaaaaggcgaagaggtccaggtgattgctgtcgaacccgggaagaaccctaagaatttccagaccatgcccggaatcttccagacaaccaccggcgagattggggccatcgcgctggactttaaacccggaacatccggcagccctatcattaaccgggaaggcaaggtggttgggctctacggaaatggcgtggtcacgaaaaacgggggatatgtgtctggcatcgctcaaaccaatgccgagccggatgggcccacacctgagctggaagaggaaatgttcaagaaacgcaaccttaccattatggacctgcatcccggcagcggaaagacaagaaagtacctccctgccatcgttcgggaggctattaaacgcagactgcggaccctcatcctggcccccacgagagtggtcgctgccgaaatggaggaggcgcttaagggcctgcctatccgctatcagacaaccgccaccaaatccgaacacacagggcgggagattgtggatctgatgtgccatgctacctttacaatgagactcctgtctccggttcgcgtgcccaattacaaccttgtcatcatggacgaagcccacttcaccgatcctgctagcattgccgcccggggatatatctccacgagagtgggcatgggggaggctgcggccatttttatgacagctacaccccctggaacagccgaagccttcccccagtctaatgctccgatccaggacgaggagcgcgacatccctgaacggagctggaactccggcaatgagtggattaccgattttgtggggaagacggtctggttcgttccctctatcaaagccggcaacgacattgcgaattgtctgagaaagaacggaaagaaagtgatccaactcagccgcaagacctttgatacagaataccagaaaacccggctgaacgactgggatttcgtggtcacaaccgacatttccgagatgggcgctaattttaaggccgatagagtgatcgacccccggcgctgcctgaaacctgttattctcacagatgggcccgagagagtgatccttgccggacctatgccggtcaccgctgccagcgcggcccagcggcgcggcagagtggggcggaacccccagaaggaaaatgaccaatacatcttcacgggacagcctctgaacaatgatgaggaccatgctcactggacagaagccaagatgctgctcgacaacattaatacccccgagggcatcattcctgctctgttcgaacccgagagagagaaatctgccgctatcgatggggaatatcgccttaagggcgagtcccggaaaacctttgttgaactgatgagacgcggagacctcccggtgtggctggcccacaaggtcgcgagcgagggcattaaatacacagatcggaagtggtgcttcgacggggaaagaaacaatcagatcctggaggagaacatggatgtggaaatctggaccaaagagggagaacgcaagaagctccggcctagatggcttgacgcccgcacatattctgatcccctggctctgaaagagtttaaggacttcgccgctggcagaaaatccattgccctcgatctggtcacggaaatcgggcgggtgcctagccatcttgcccaccgcaccagaaatgctctggacaacctcgttatgctgcatacatccgagcacggaggccgggcgtaccgccacgccgtggaggaactgcccgagaccatggaaacactccttctgctgggcctcatgattctgcttaccgggggagctatgctgtttctcatctctggcaaggggattggaaaaacgagcatcggcctgatctgtgtgattgcctccagcgggatgctgtggatggccgatgtccctctccagtggatcgcttctgccattgttcttgagttctttatgatggtgctgctgatccccgagccggaaaagcaaagaacccctcaggacaatcagctcgcgtatgtggtcattggaatcctgacacttgccgctattgtggccgctaacgagatgggcctgctcgaaaccacaaagcgggatctgggcatgtccaaagagcccggggttgtgagccccacctcttacctggacgtcgacctccatcctgccagcgcgtggacgctttatgccgtggctacaaccgtcatcacaccgatgctgagacacaccatcgaaaattccaccgccaacgtgtctctggctgccattgctaatcaagccgttgtgctcatgggactggataagggctggcccatcagcaaaatggaccttggggtccctctgctcgcgctgggatgctactcccaggtgaaccccctgacactcacggccgctgttcttctgctggtgacccattacgccattatcggccctgggctccaggctaaggccacacgcgaggcccagaaacggaccgcggctggaattatgaagaaccccacagtcgatggcatcatgaccatcgacctggatcctgtgatttatgactctaagttcgagaaacaacttggccaggtgatgctgctcgttctgtgtgccgtccagctgctccttatgagaacgagctgggctctgtgcgaagccctgacactcgccaccgggccgatcaccacactgtgggagggatcccccggcaagttttggaataccacaattgctgtgagcatggccaacatcttccgcgggtcttaccttgcgggagccggcctggctttttccattatgaaaagcgtggggacgggacggagaggcaccggctcccagggggaaacactcggagagaagtggaaaaagaagctgaatcaactgtctcggaaagagttcgatctctataagaaaagcggcatcaccgaggtcgaccgcacagaggccaaggaagggcttaaaagaggagagaccacgcaccatgctgtttcccggggctctgccaagctgcagtggtttgtggaacgcaacatggtgatccctgaggggagagtcattgatctgggatgtggccggggcgggtggagctactattgcgcgggactccgcaaagtgaccgaagttagaggctacacaaaaggcgggcccgggcacgaggagcctgtgcccatgtccacctatgggtggaatatcgtcaagctgatgagcggaaaagacgtgttctaccttccgcctgaaaagtgtgatacactgctctgcgacattggcgagtcttcccccagccccaccgttgaagagtctcggacaatccgcgtgctgaaaatggtcgagccttggctgagaaacaatcagttctgtattaaggtgctcaacccctacatgcctaccgtgatcgaacaccttgagcggctgcagagaaaatatggcgggatgctggtccgcaatccgctctcccggaacagcacgcatgaaatgtactggatttctaatggaacaggcaacatcgttagctccgtgaatatggtgtctagactgcttctgaaccgctttaccatgacccaccggagacccacaatcgagaaggatgtcgacctcggggccggaacgcgccatgtgaatgctgaacctgagacccccaacatggacgttattggcgagcggatcaagagaattaaagaagaacacagctccacatggcactatgatgacgaaaacccttacaagacctgggcctatcatgggagctacgaggtgaaagctacaggatccgcctctagcatgatcaatggcgtcgtgaagctgctgaccaaaccctgggatgttgtgccgatggtcacacaaatggctatgaccgacacgacccctttcggccagcagcgcgtgtttaaggaaaaggttgatacacggacccccagacctatggccgggacacgcaaagtgatggagattaccgcggagtggctctggcggacgctgggaagaaacaagaaaccccgcctttgcacaagagaagagttcaccaagaaagtccggacaaatgccgctatgggcgccgtgtttaccgaagagaaccaatgggactccgctcgcgccgccgtcgaagatgaggagttctggaagctggtggacagagaacgggagctccacaagctggggaaatgtggatcttgcgtttataatatgatgggcaagagagagaagaaacttggggagtttggcaaagcgaagggaagccgggctatctggtacatgtggctgggcgcccgctacctcgagttcgaagccctggggtttctgaacgaggatcattggttctccagagaaaattcttatagcggagtggagggcgaagggctccacaaactgggatacatccttcgggacatttccaagatccctggcggggctatgtatgccgatgacacggctggctgggacacccgcattacagaggatgacctgcataacgaggaaaagatcacccagcagatggatcccgagcacagacagctcgccaatgcgatttttaaactgacataccaaaacaaggtcgtgaaagtgcagcggccgacccctaagggaacagttatggacatcatcagccgcaaagatcagagaggctctggacaggtgggaacctatggccttaatacgttcacaaacatggaagcccaactggtccggcagatggagggggaaggagtgctctccaaggctgacctggagaatccccatctgctcgagaagaaaattacccagtggctggaaaccaagggcgttgagcgccttaaaagaatggccatcagcggggatgactgcgtggtcaagcccattgatgaccggtttgctaacgccctgctcgcgctgaatgatatgggcaaagtgcgcaaggacatccctcagtggcaaccgtctaagggatggcatgattggcagcaggtccccttctgttcccaccatttccacgaacttattatgaaagacggcagaaagctggtggttccttgccggccccaggacgagctcatcgggcgcgccagaatcagccaaggagctggctggtctctgaaagaaacagcctgtctggggaaggcttacgcccagatgtggtccctcatgtattttcaccggagagatctgcgccttgctagcaacgccatttgctccgcggtgcctgtccattggatccccaccagccggacaacgtggtctattcacgcccatcaccagtggatgaccacagaggacatgctgaccgtgtggaacagagtttggatcgaggataatccttggatggaagacaaaacacccgtgaccacgtgggaggatgtcccgtacctcggaaagcgcgaagaccaatggtgtggcagcctgattgggcttacctcccgggctacatgggcccagaacatcctgaccgccattcaacaggtgagatctctcatcggcgatgaggagttcctggactacatgcctagcatgaagcgctttcggaaagaagaggaatccgagggagctatctggtga

SEQ ID NO: 20465 - RNA, 9873 nt, synthetic construct
  misc_feature 1..9873: note = derived and/or modified CDS sequence (opt5) from DENV-3__GU131906__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaagtctctcctgtttaagaccgccagcggcattaatatgtgtacacttatcgcgatggatctgggggagatgtgcgacgataccgtgacatacaagtgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgatacccggacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccagcagagcttggaacgtgtgggaggtcgaagactatggctttggcgttttcaccacaaatatctggctgaaacttcgcgaggtgtacacccagtcctgtgatcatcggctcatgtctgcggccatcaaagacgaaagagctgtgcacgccgatatggggtactggattgagagccagaagaacggatcctggaaactggagaaggcctcttttatcgaagtcaagacgtgcacatggcctaaaagccacaccctgtggtccaatggcgtgctcgagagcgacatgattatccccaagtctctggctgggcctatttcccagcataaccaccgccccggatatcatacccaaacagccggcccttggcaccttgggaaactggaactcgatttcaattactgcgagggaaccacggttgtgatcacagagaactgtggcacccggggccccagcctgagaacaaccacagtctctgggaagctgatccacgaatggtgctgtcgctcctgcacccttccgcctctccggtatatgggagaggacggctgttggtacgggatggaaattagacccatcaatgagaaagaagagaacatggttaagagcctggtgtctgcgggaagcggcaaggtggataattttacgatgggggtcctgtgcctcgctattctgttcgaggaagtgatgcggggaaaattcggcaagaaacatatgatcgccggcgttctttttaccttcgtgctgctcctgtccgggcagattacatggcgcgacatggcccacaccctgatcatgattggaagcaacgcttctgatagaatgggcatgggggtcacatatcttgccctgatcgcgacctttaagatccagcccttcctcgctctgggatttttcctccggaaactgacgtccagagagaatcttctgctcggcgtggggctggccatggccacaaccctgcaacttcctgaagacattgagcagatggctaacggaatcgccctgggcctcatgacactgaagctcattacccagtttgaaacctaccagctgtggacagctcttgtgagcctgacgtgttccaataccatcttcacactcaccgtcgcctggcgcacagcgaccctgattctggccggcgtttctcttctgccgctctgccaaagctcctctatgcggaagacggattggctgcccatgacagtggctgccatgggggtgcctcccctccctctgtttatcttcagccttaaagacacccccagacgcagatcctggcctctgaacgagggagtcatggctgtgggcctggtttctatcctcgccagctccctgcttcggaatgatgtgcccatggccgggccgctggtcgctggaggcctcctgattgcgtgttatgtgatcaccgggacaagcgccgacctcaccgttgagaaggctgccgacgtgacatgggaagaggaagccgagcagacgggagtctctcataacctgatgattaccgtggatgacgatggcacaatgcgcatcaaagacgatgaaaccgagaacattcttacagtcctgctgaagaccgctctcctgatcgtgtccggcatctttccttacagcattcccgccacgcttctggtttggcacacctggcagaaacagacacaaagatctggggtgctctgggacgtcccttctcccccggagacccagaaggcggaactggaggaaggagtgtaccggatcaaacagcagggcattttcgggaagacacaagttggagtgggcgtccagaaggagggggtgtttcataccatgtggcacgtgacacgcggagctgttctcacgcacaatggcaaaagactggagcctaactgggccagcgtcaagaaagatcttatcagctatggcgggggatggcggctgtccgcccagtggcaaaagggcgaagaggtccaggtgattgctgtcgaacccgggaaaaatcctaagaacttccagaccatgcccggaatcttccagacaaccaccggcgagattggggccatcgcgctggactttaagcccggaacaagcggctcccctatcattaatcgcgaaggcaaagtggttgggctctacggaaacggcgtggtcacgaagaatgggggatatgtgagcggcatcgctcaaaccaacgccgagccggatgggcccacacctgagctggaagaggaaatgttcaaaaagagaaatcttaccattatggacctgcatcccggctctggaaaaacacggaagtacctccctgccatcgttcgcgaggctattaagagacggctgagaaccctcatcctggcccccacgcgcgtggtcgctgccgaaatggaggaggcgcttaaaggcctgcctatccggtatcagacaaccgccaccaagagcgaacacacagggagagagattgtggatctgatgtgccatgctacctttacaatgcgcctcctgtccccggttcgggtgcccaactacaatcttgtcatcatggacgaagcccacttcaccgatcctgcttctattgccgccagaggatatatcagcacgcgcgtgggcatgggggaggctgcggccatttttatgacagctacaccccctggaacagccgaagccttcccccagtccaacgctccgatccaggacgaggagcgggacatccctgaaagatcttggaatagcggcaacgagtggattaccgattttgtggggaaaacggtctggttcgttccctccatcaaggccggcaatgacattgcgaactgtctgcgcaaaaacggaaagaaggtgatccaactctctcggaaaacctttgatacagaataccagaagaccagactgaatgactgggatttcgtggtcacaaccgacattagcgagatgggcgctaactttaaagccgatcgggtgatcgacccccgcagatgcctgaagcctgttattctcacagatgggcccgagcgggtgatccttgccggacctatgccggtcaccgctgcctccgcggcccagcgcagaggccgggtggggagaaatccccagaaagaaaacgaccaatacatcttcacgggacagcctctgaataacgatgaggaccatgctcactggacagaagccaagatgctgctcgacaatattaacacccccgagggcatcattcctgctctgttcgaacccgagcgcgaaaagtccgccgctatcgatggggaatatcggcttaaaggcgagtctagaaagacctttgttgaactgatgcgccggggagacctcccggtgtggctggcccacaaagtcgcgtccgagggcattaagtacacagatagaaaatggtgcttcgacggggaacgcaataaccagatcctggaggagaatatggatgtggaaatctggaccaaggagggagaacggaaaaagctcagacctcgctggcttgacgccagaacatatagcgatcccctggctctgaaggagtttaaagacttcgccgctggccggaagtctattgccctcgatctggtcacggaaatcgggcgcgtgccttcccatcttgcccacagaacccggaacgctctggacaatctcgttatgctgcatacaagcgagcacggaggccgcgcgtacagacacgccgtggaggaactgcccgagaccatggaaacactccttctgctgggcctcatgattctgcttaccgggggagctatgctgtttctcatctccggcaaagggattggaaagacgtctatcggcctgatctgtgtgattgccagctccgggatgctgtggatggccgatgtccctctccagtggatcgctagcgccattgttcttgagttctttatgatggtgctgctgatccccgagccggaaaaacaacggacccctcaggacaaccagctcgcgtatgtggtcattggaatcctgacacttgccgctattgtggccgctaatgagatgggcctgctcgaaaccacaaagagagatctgggcatgtctaaggagcccggggttgtgtcccccaccagctacctggacgtcgacctccatcctgcctctgcgtggacgctttatgccgtggctacaaccgtcatcacaccgatgctgcgccacaccatcgaaaacagcaccgccaatgtgtccctggctgccattgctaaccaagccgttgtgctcatgggactggataaaggctggcccatctctaagatggaccttggggtccctctgctcgcgctgggatgctacagccaggtgaaccccctgacactcacggccgctgttcttctgctggtgacccattacgccattatcggccctgggctccaggctaaagccacacgggaggcccagaagagaaccgcggctggaattatgaaaaatcccacagtcgatggcatcatgaccatcgacctggatcctgtgatttatgactccaagttcgagaagcaacttggccaggtgatgctgctcgttctgtgtgccgtccagctgctccttatgcgcacgtcttgggctctgtgcgaagccctgacactcgccaccgggccgatcaccacactgtgggagggaagccccggcaaattttggaacaccacaattgctgtgtccatggccaatatcttccgggggagctaccttgcgggagccggcctggctttttctattatgaagtccgtggggacgggaagacggggcaccggcagccagggggaaacactcggagagaaatggaagaaaaagctgaaccaactgtcccgcaaggagttcgatctctataaaaagtctggcatcaccgaggtcgacagaacagaggccaaagaagggcttaagcggggagagaccacgcaccatgctgttagccgcggctccgccaaactgcagtggtttgtggaaagaaatatggtgatccctgaggggcgggtcattgatctgggatgtggccgcggcgggtggtcttactattgcgcgggactcaagaaagtgaccgaagttagaggctacacaaaaggcgggcccgggcacgaggagcctgtgcccatgagcacctatgggtggaacatcgtcaagctgatgtccggaaaagacgtgttctaccttccgcctgaaaagtgtgatacactgctctgcgacattggcgagagctctccctcccccaccgttgaagagagccggacaatccgcgtgctgaaaatggtcgagccttggctgagaaataaccagttctgtattaaggtgctcaatccctacatgcctaccgtgatcgaacaccttgagcggctgcagagaaaatatggcgggatgctggtccgcaacccgctctctagaaattccacgcatgaaatgtactggattagcaacggaacaggcaatatcgtttctagcgtgaacatggtgtccagactgcttctgaatcgctttaccatgacccaccggagacccacaatcgagaaggatgtcgacctcggggccggaacgcgccatgtgaacgctgaacctgagacccccaacatggacgttattggcgagcggatcaagagaattaaagaagaacactctagcacatggcactatgatgacgaaaatccttacaagacctgggcctatcatgggtcctacgaggtgaaagctacaggaagcgcctcctctatgatcaacggcgtcgtgaagctgctgaccaaaccctgggatgttgtgccgatggtcacacaaatggctatgaccgacacgacccctttcggccagcagcgcgtgtttaaggaaaaggttgatacacggacccccagacctatgcccgggacacgcaaagtgatggagattaccgccgagtggctctggcggacgctgggaagaaataagaaacctcgcctttgcacaagagaagagttcaccaagaaagtccggacaaacgcggccatgggcgctgtgtttaccgaagagaatcaatgggacagcgcccgcgctgccgtcgaagatgaggagttctggaagctggtggacagagaacgggagctccacaagctggggaaatgtggatcctgcgtttataacatgatgggcaagagagagaagaaacttggggagtttggcaaagccaagggatctcgggcgatctggtacatgtggctgggcgctcgctacctcgagttcgaagccctggggtttctgaatgaggatcattggttcagcagagaaaactcctattctggagtggagggcgaagggctccacaaactgggatacatccttcgggacattagcaagatccccggcggggccatgtatgctgatgacacggccggctgggacacccgcattacagaggatgacctgcataatgaggaaaagatcacccagcagatggatccggagcacagacagctcgctaacgccatttttaaactgacataccaaaataaggtcgtgaaagtgcagcggcctacccccaagggaacagttatggacatcatctcccgcaaagatcagagaggcagcggacaggtgggaacctatggccttaacacgttcacaaatatggaagcgcaactggtccggcagatggagggggaaggagtgctctctaaggccgacctggagaacccccatctgctcggcaagaaaattacccagtggctggagaccaagggggttgaacgccttaaaagaatggctatctccggcgatgactgcgtggtcaagcctattgatgaccggtttgccaatgctctgctcgccctgaacgatatgggaaaagtgcgcaaggacatcccgcagtggcaacccagcaagggctggcatgattggcagcaggtccctttctgttctcaccatttccacgagcttattatgaaagacgggagaaagctggtggttccctgccggcctcaggacgaactcatcggacgcgcgagaatctcccaaggcgccgggtggagcctgaaagagacagcttgtctgggaaaggcctacgctcagatgtggtctctcatgtattttcaccggagagatctgcgccttgcctccaacgctatttgcagcgccgtgcccgtccattggatccctacctcccggacaacgtggagcattcacgcgcatcaccagtggatgaccacagaagacatgctgaccgtgtggaatagagtttggatcgaggataacccctggatggaggacaaaacaccggtgaccacgtgggaagatgtcccttacctcggcaagcgcgaggaccaatggtgtgggtctctgattggccttaccagccgggccacatgggctcagaatatcctgaccgccattcaacaggtgagatccctcatcggagatgaagagttcctggactacatgccctctatgaagcgctttcggaaagaggaagagagcgaaggcgccatctggtga

SEQ ID NO: 20466 - RNA, 9873 nt, synthetic construct
  misc_feature 1..9873: note = derived and/or modified CDS sequence (opt5) from DENV-3__GU131907__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataagcttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgacaaaaaaggaggagcccgtgaatattgaagctgagcctccgttcggcgaatctaacatcgttattgggatcggcgacaaagccctcaagattaattggtataagaaaggaagctccatcggcaagatgtttgaggccaccgctcggggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagacccaaaactccagcttcatcattgacggacctaacacacccgaatgcccgtctgcctccagagcttggaatgtgtgggaggtcgaagactatggctttggcgttttcaccacaaacatctggctgaagcttcgcgaggtgtacacccagagctgtgatcatcggctcatgtccgcggccatcaaagacgaaagagctgtgcacgccgatatggggtactggattgagtctcagaagaatggaagctggaaactggagaaggcctcctttatcgaagtcaagacgtgcacatggcctaaatctcacaccctgtggagcaacggcgtgctcgagtccgacatgattatccccaagagcctggctgggcctatttctcagcataatcaccgccccggatatcatacccaaacagccggcccttggcaccttgggaaactggaactcgatttcaactactgcgagggaaccacggttgtgatcgcggagaattgtggcacacggggcccctccctgagaaccacaaccgtcagcgggaagctgatccacgaatggtgctgtcgctcttgcacacttccgcctctccggtatatgggagaggacggctgttggtacgggatggaaattagacccatcaacgagaaagaagagaatatggtgaagtccctggttagcgctggatctggcaaggtggataactttaccatgggggtcctgtgcctcgccattctgttcgaggaagtgatgcggggaaaattcggcaagaaacatatgatcgccggcgttctttttacgttcgtgctgctcctgagcgggcagattacctggcgcgacatggctcacacactgatcatgattggatccaatgccagcgatagaatgggcatgggggtcacctatcttgcgctgacagctacctttaagatccagcccttcctcgccctgggatttttcctccggaaactgacgtctagagagaaccttctgctcggcgtggggctggccatggctacaaccctgcaacttcctgaagacatcgagcagatggccaatggaattgctctgggcctcatgacactgaagctcatcacccagtttgaaacctaccagctgtggacagcccttgtgtccctgacgtgtagcaacaccattttcacactcaccgtcgcgtggcgcacagccaccctgatcctggctggcgtttcccttctgccgctctgccaatctagctccatgcggaagacggattggctgcccatgacagtggccgctatgggggtgcctcccctccctctgtttattttctctcttaaagacacccccaagagacgcagctggcctctgaatgagggagtcatggccgtgggcctggtttccatcctcgcctctagcctgcttagaaacgatgtgcccatggctgggccgctggtcgcgggaggcctcctgatcgcctgttatgtgattaccgggacatccgctgacctcaccgttgagaaagccgccgacgtgacatgggaagaggaagctgagcagacgggagtcagccataacctgatgatcaccgtggatgacgatggcacaatgcggattaaggacgatgaaaccgagaatatccttacagtcctgctgaaaaccgccctcctgattgtgtctggcatctttccttactccatccccgcgacgcttctggtttggcacacctggcagaagcagacacaacgcagcggggtgctctgggacgtcccttctcccccggagacccagaaagctgaactggaggaaggagtgtacagaattaagcagcagggcatcttcgggaagacacaagttggagtgggcgtccagaaagagggggtgtttcataccatgtggcacgtgacacggggagccgttctcacgcacaacggcaagcgcctggagcctaattgggcctccgtcaaaaaggatcttattagctatggcgggggatggagactgtctgctcagtggcaaaaaggcgaagaggtgcaggtgatcgccgtcgaacccgggaagaaccctaagaatttccagaccatgcccggaattttccagacaaccaccggcgagatcggggcgattgctctggactttaaacccggaacatccggcagccctatcatcaaccgggaaggcaaggtggttgggctctacggaaatggcgtggtcacgaaaaacgggggatatgtgtccggcattgcccaaaccaatgccgagccggatgggcccacacctgagctggaagaggaaatgttcaagaaacgcaaccttaccatcatggacctgcatcccggcagcggaaagacaagaaagtacctccctgctattgttcgggaggccatcaaacgcagactgcggaccctcattctggctcccacgagagtggtcgccgcggaaatggaggaggcccttaagggcctgcctatccgctatcagacaaccgctaccaaatctgaacacacagggcgggagatcgtggatctgatgtgccatgccacctttacaatgagactcctgagcccggttcgcgtgcccaattacaaccttgtcattatggacgaagctcacttcaccgatcctgcctccatcgccgctcggggatatatttctacgagagtgggcatgggggaggcggccgctatctttatgacagccaccccccctggaacagccgaagctttcccccagagcaatgccccgattcaggacgaggagcgcgacatccctgaacggtcctggaactctggcaatgagtggatcaccgattttgtggggaagacggtctggttcgttcccagcattaaagcgggcaacgacatcgctaactgtctgagaaagaatggaaagaaagtgattcaactctcccgcaagacctttgatacagaataccagaaaacccggctgaacgactgggatttcgtggtcacaaccgacatctctgagatgggcgccaattttaaggccgatagagtgattgacccccggcgctgcctgaaacctgttatcctcacagatgggcccgagagagtgattcttgctggacctatgccggtcaccgccgcgagcgccgctcagcggcgcggcagagtggggcggaacccccagaaggaaaatgaccaatacatcttcacgggacagcctctgaacaatgatgaggaccatgcccactggacagaagctaagatgctgctcgacaacatcaatacccccgagggcattatccctgccctgttcgaacccgagagagagaaatccgctgccattgatggggaatatcgccttaagggcgagagccggaaaacctttgttgaactgatgagacgcggagacctcccggtgtggctggcgcacaaggtcgcctctgagggcatcaaatacacagatcggaagtggtgcttcgacggggaaagaaacaatcagattctggaggagaacatggatgtggaaatctggaccaaagagggagaacgcaagaagctccggcctagatggcttgacgctcgcacatattccgatcccctggccctgaaagagtttaaggacttcgctgccggcagaaaaagcatcgccctcgatctggtcacggaaattgggcgggtgccttctcatcttgctcaccgcaccagaaatgcgctggacaacctcgttatgctgcatacatccgagcacggaggccgggcctaccgccacgctgtggaggaactgcccgagaccatggaaacactccttctgctgggcctcatgatcctgcttaccgggggagccatgctgtttctcattagcggcaaggggatcggaaaaacgtccattggcctgatctgtgtgatcgtctctagcgggatgctgtggatggccgatgttcctctccagtggattgcttccgccatcgtgcttgagttctttatgatggtgctgctgattcccgagccggaaaagcaaagaacccctcaggacaatcagctcgcgtatgtcgtgatcggaattctgacacttgccgctatcgttgccgctaacgagatgggcctgctcgaaaccacaaagcgggatctgggcatgagcaaagagcccggggtggtctctcccacctcctacctggacgtggacctccatcctgccagcgcgtggacgctttatgccgtcgctacaaccgtgattacaccgatgctgagacacaccatcgaaaattctaccgccaacgttagcctggctgccatcgctaaccaagccgtggtcctcatgggactggataagggctggcccatttccaaaatggaccttggggtgcctctgctcgcgctgggatgctactctcaggttaatcccctgacactcacggccgctgtgcttctgctggtcacccattacgccatcattggccctgggctccaggctaaggccacacgcgaggcccagaaacggaccgcggctggaatcatgaagaaccccacagtggatggcattatgaccatcgacctggatcctgtgatctatgacagcaagttcgagaaacaacttggccaggttatgctgctcgtcctgtgtgccgtgcagctgctccttatgagaacgtcctgggctctgtgcgaagccctgacactcgccaccgggccgattaccacactgtgggagggatctcccggcaagttttggaataccacaatcgctgtgagcatggccaacattttccgcgggtcctaccttgcgggagccggcctggcttttagcatcatgaaatctgtcgggacgggacggagaggcaccggctcccagggggaaacactcggagagaagtggaaaaagaagctgaatcaactgagccggaaagaattcgatctctataagaaatccggcattaccgaggttgaccgcacagaggccaaggaagggcttaaaagaggagagaccacgcaccatgctgtgtctcggggcagcgccaagctgcagtggtttgtggaacgcaacatggtcatccctgaggggagagtgatcgatctgggatgtggccggggcgggtggtcctactattgcgcgggactcaaaaaggttaccgaagtgcgcggctacacaaaggggggacccggccacgaggagcctgtccccatgtctacctatgggtggaatattgtgaaactgatgagcggaaaggacgttttctaccttccgcctgaaaaatgtgatacactgctctgcgacatcggcgagtccagcccctctcccaccgtggaagagtccagaacaattcgggtcctgaagatggtggagccttggctgcgcaacaatcagttctgtatcaaagtgctcaacccctacatgcctaccgtcattgaacaccttgagagactgcagcggaagtatggcgggatgctggttagaaatccgctcagccgcaactctacgcatgaaatgtactggatctccaatggaacaggcaacattgtgagctctgtgaatatggtcagccggctgcttctgaacagatttaccatgacccaccgccggcccacaatcgagaaggatgtggacctcggggccggaacgagacatgttaacgctgaacctgagacccccaatatggacgtgatcggcgagcgcattaaacggatcaaggaagagcactcctctacatggcactatgatgacgaaaacccttacaaaacctgggcctatcatgggagctacgaggtcaaggctacaggatccgccagctccatgattaatggcgtggttaaactgctgaccaagccctgggatgtggtcccgatggtgacacaaatggctatgaccgacacgacccctttcggccagcagagagtttttaaggaaaaagtggatacacgcaccccccggcctatgcccgggacaagaaaggtcatggagatcaccgccgagtggctctggcgcacgctgggacggaacaaaaagcctagactttgcacacgcgaagagttcaccaaaaaggtgagaacaaatgcggccatgggcgctgtctttaccgaagagaaccaatgggactctgcccgggctgccgtggaagatgaggagttctggaagctggttgacaaagaacgcgagctccacaagctggggaaatgtggaagctgcgtgtataatatgatgggcaagagagaaaaaaagcttggggagtttggcaaagccaagggatcccgggcgatttggtacatgtggctgggcgctagatacctcgagttcgaagccctggggtttctgaacgaggatcattggttctctcgggaaaatagctattccggagtcgagggcgaagggctccacaagctgggatacatccttcgcgacatctctaaaattcccggcggggccatgtatgctgatgacacggccggctgggacaccagaatcacagaggatgacctgcataacgaggaaaagattacccagcagatggatccggagcaccggcagctcgctaatgccatctttaaactgacataccaaaacaaggtggtgaaagttcagcgccctacccccaagggaacagtgatggacattatcagcagaaaggatcagcggggctccgggcaggtcggaacctatggccttaatacgttcacaaacatggaagcgcaactggtgcgccagatggagggggaaggagttctcagcaaagccgacctggagaatccccacctgctcgagaagaaaatcacccagtggctggaaaccaagggcgtggagagacttaaacggatggctatttctggggatgactgcgtcgtgaagcctatcgatgaccgctttgccaacgctctgctcgccctgaacgatatgggcaaggtcagaaaagacattccgcagtggcaaccctccaagggatggcatgattggcagcaggtgcctttctgtagccaccatttccacgaacttatcatgaaagacggccggaagctggttgtgccctgccgccctcaggacgagctcattgggagagcgcggatctctcaaggagccggctggtccctgaaagaaacagcttgtctggggaaggcctacgctcagatgtggagcctcatgtattttcaccgcagagatctgcggcttgcctctaatgctatctgctccgccgtccccgtgcattggattcctaccagcagaacaacgtggtccatccacgcgcatcaccagtggatgaccacagaggacatgctgaccgtttggaaccgcgtgtggattgaggataatccctggatggaagacaagacaccggtcaccacgtgggaggatgtgccttacctcggaaaacgggaagaccaatggtgtggcagcctgatcgggcttacctctagagccacatgggctcagaacattctgaccgccatccagcaggtgcgcagcctcattggcgatgaggagttcctggactacatgccctccatgaagcggtttagaaaagaagaggaaacagagggagccatctggtga

SEQ ID NO: 20467 - RNA, 9873 nt, synthetic construct
  misc_feature 1..9873: note = derived and/or modified CDS sequence (opt5) from DENV-3__GQ868634__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgcctccggcattaatatgtgtacccttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctgggaaaatggagtgtgtggcatcagatctacaacccgcatggagaacctgctgtggaagcagattgctaatgaactcaactatatcctgtgggagaataacatcaaacttacagtcgtggttggggatattatcggagtgctggaacagggcaagcggaccctcacgcctcagcccatggagctgaaatactcctggaagacctgggggaaggccaaaattgtcacagccgagacccaaaatagctctttcatcattgacggacctaacacacccgaatgcccgtccgctagcagagcgtggaacgtgtgggaggtggaagactatggctttggcgtcttcaccacaaatatctggctgaaacttcgcgaggtttacacccagtcctgtgatcatcggctcatgtctgccgctatcaaagacgaaagagccgtgcacgccgatatggggtactggattgagagccagaagaacggatcctggaaactggagaaggcttcttttatcgaagtgaagacgtgcacatggcctaaaagccacaccctgtggtccaatggcgtcctcgagagcgacatgattatccccaagtctctggccgggcctatttcccagcataaccaccgccccggatatcatacccaaacagcgggcccttggcaccttgggaaactggaactcgatttcaattactgcgagggaaccacggtggttatcacagagaactgtggcacccggggccccagcctgagaacaaccacagtgtctgggaagctgatccacgaatggtgctgtcgctcctgcacccttccgcctctccggtatatgggagaggacggctgttggtacgggatggaaattagacccatcaatgagaaagaagagaacatggtcaagagcctggtgtctgctggaagcggcaaggttgataattttacgatgggggtgctgtgcctcgccattctgttcgaggaagtcatgcggggaaaattcggcaagaaacatatgatcgccggcgtgctttttaccttcgttctgctcctgtccgggcagattacatggcgcgacatggctcacaccctgatcatgattggaagcaacgcctctgatagaatgggcatgggggtgacatatcttgcgctgatcgctacctttaagatccagcccttcctcgccctgggatttttcctccggaaactgacgtccagagagaatcttctgctcggcgtcgggctggccatggctacaaccctgcaacttcctgaagacattgagcagatggccaacggaatcgctctgggcctcatgacactgaagctcattacccagtttgaaacctaccagctgtggacagcccttgtgagcctgacgtgttccaataccatcttcacactcaccgtggcgtggcgcacagccaccctgattctggctggcgtctctcttctgccgctctgccaaagctcctctatgcggaagacggattggctgcccatgacagttgccgctatgggggtgcctcccctccctctgtttatcttcagccttaaagacacccccaagagacgctcctggcctctgaacgagggagtgatggccgtcggcctggtgtctatcctcgccagctccctgcttagaaatgatgttcccatggctgggccgctggtggcgggaggcctcctgattgcctgttatgtcatcaccgggacaagcgctgacctcaccgtggagaaagccgccgacgttacatgggaagaggaagctgagcagacgggagtgtctcataacctgatgattaccgtcgatgacgatggcacaatgcggatcaaggacgatgaaaccgagaacattcttacagtgctgctgaaaaccgccctcctgatcgtctccggcatctttccttacagcattcccgcgacgcttctggtgtggcacacctggcagaagcagacacaacgctctggggttctctgggacgtgccttctcccccggagacccagaaagctgaactggaggaaggagtctacagaatcaagcagcagggcattttcgggaagacacaagtgggagttggcgtgcagaaagagggggtctttcataccatgtggcacgtgacacggggagccgtgctcacgcacaatggcaagcgcctggagcctaactgggccagcgttaaaaaggatcttatcagctatggcgggggatggagactgaatgctcagtggcaaaaaggcgaagaggtccaggtgattgccgtggaacccgggaagaaccctaagaatttccagaccatgcccggaatcttccagacaaccaccggcgagattggggcgatcgctctggactttaaacccggaacatccggcagccctatcattaaccgggaaggcaaggtcgtggggctctacggaaatggcgttgtgacgaaaaacgggggatatgtctccggcatcgcccaaaccaatgccgagccggatgggcccacacctgagctggaagaggaaatgttcaagaaacgcaaccttaccattatggacctgcatcccggcagcggaaagacaagaaagtacctccctgctatcgtgcgggaggccattaaacgcagactgcggaccctcatcctggctcccacgagagttgtggccgcggaaatggaggaggcccttaagggcctgcctatccgctatcagacaaccgctaccaaatctgaacacacagggcgggagattgtcgatctgatgtgccatgccacctttacaatgagactcctgagcccggtgcgcgttcccaattacaaccttgtgatcatggacgaagctcacttcaccgatcctgcctccattgccgctcggggatatatctctacgagagtcggcatgggggaggcggccgctatttttatgacagccacaccccctggaacagccgaggctttcccccagagcaatgccccgatccaggacgaggagcgcgacatccctgaacggtcctggaactctggcaatgagtggattaccgattttgtggggaagacggtgtggttcgtccccagcatcaaagcgggcaacgacattgctaactgtctgagaaagaatggaaagaaagttatccaactctcccgcaagacctttgatacagaataccagaaaacccggctgaacgactgggatttcgtggtgacaaccgacatttctgagatgggcgccaattttaaggccgatagagtcatcgacccccggcgctgcctgaaacctgtgattctcacagatgggcccgagagagttatccttgctggacctatgccggtgaccgccgcgagcgccgctcagcggcgcggcagagtcgggcggaacccccagaaggaaaatgaccaatacatcttcacgggacagcctctgaacaatgatgaggaccatgcccactggacagaagctaagatgctgctcgacaacattaatacccccgagggcatcattcctgccctgttcgaacccgagagagagaaatccgctgccatcgatggggaatatcgccttaagggcgagagccggaaaacctttgtggaactgatgagacgcggagacctcccggtttggctggcgcacaaggtggcctctgagggcattaaatacacagatcggaagtggtgcttcgacggggaaagaaacaatcagatcctggaggagaacatggatgtcgaaatctggaccaaagagggagaacgcaagaagctccggcctagatggcttgacgctcgcacatattccgatcccctggccctgaaagagtttaaggacttcgctgccggcagaaaaagcattgccctcgatctggtgacggaaatcgggcgggtcccttctcatcttgctcaccgcaccagaaatgcgctggacaacctcgtgatgctgcatacatccgagcacggaggccgggcctaccgccacgctgttgaggaactgcccgagaccatggaaacactccttctgctgggcctcatgattctgcttaccgggggagccatgctgtttctcatcagcggcaaggggattggaaaaacgtccatcggcctgatctgtgtgattgtgtctagcgggatgctgtggatggccgatgtccctctccagtggatcgcttccgccattgttcttgagttctttatgatggtgctgctgatccccgagccggaaaagcaaagaacccctcaggacaatcagctcgcgtatgtggtcattggaatcctgacacttgccgctattgtggccgctaacgagatgggcctgctcgaaaccacaaagcgggatctgggcatgagcaaagagcccggggttgtgtctcccacctcctacctggacgtcgacctccatcctgccagcgcgtggacgctttatgccgtggctacaaccgtcatcacaccgatgctgagacacaccatcgaaaattctaccgccaacgtgagcctggctgccattgctaaccaagccgttgtgctcatgggactggataagggctggcccatctccaaaatggaccttggggtccctctgctcgcgctgggatgctactctcaggtgaatcccctgacactcacggccgctgttcttctgctggtgacccattacgccattatcggccctgggctccaggctaaggccacacgcgaggcccagaaacggaccgcggctggaattatgaagaaccccacagtcgatggcatcatgaccatcgacctggatcctgtgatttatgacagcaagttcgagaaacaacttggccaggtgatgctgctcgttctgtgtgccgtccagctgctccttatgagaacgtcctgggctctgtgcgaagccctgacactcgccaccgggccgatcaccacactgtgggagggatctcccggcaagttttggaataccacaattgctgtgagcatggccaacatcttccgcgggtcctaccttgcgggagccggcctggcttttagcattatgaaatctgtggggacgggacggagaggcaccggctcccagggggaaacactcggagagaagtggaaaaagaagctgaatcaactgagccggaaagagttcgatctctataagaaatccggcatcaccgaggtcgaccgcacagaggccaaggaagggcttaaaagaggagagaccacgcaccatgctgtttctcggggcagcgccaagctgcagtggtttgtggaacgcaacatggtgatccctgaggggagagtcattgatctgggatgtggccggggcgggtggtcctactattgcgcgggactcaaaaaggtgaccgaagttcgcggctacacaaaaggcgggcccgggcacgaggagcctgtgcccatgtctacctatgggtggaatatcgtcaaactgatgagcggaaaggacgtgttctaccttccgcctgaaaaatgtgatacactgctctgcgacattggcgagtccagcccctctcccaccgttgaagagtccagaacaatccgggtgctgaagatggtcgagccttggctgcgcaacaatcagttctgtattaaagtgctcaacccctacatgcctaccgtgatcgaacaccttgagagactgcagcggaagtatggcgggatgctggtcagaaatccgctcagccgcaactctacgcatgaaatgtactggatttccaatggaacaggcaacatcgttagctctgtgaatatggtgagccggctgcttctgaacagatttaccatgacccaccgccggcccacaatcgagaaggatgtcgacctcggggccggaacgagacatgtgaacgctgaacctgagacccccaatatggacgttattggcgagcgcatcaaacggattaaggaagaacactcctctacatggcactatgatgacgaaaacccttacaaaacctgggcctatcatgggagctacgaggtgaaggctacaggatccgccagctccatgatcaatggcgtcgtgaaactgctgaccaagccctgggatgttgtgccgatggtcacacaaatggctatgaccgacacgacccctttcggccagcagagagtgtttaaggaaaaagttgatacacgcacaccccggcctatgcccgggacaagaaaggtgatggagattaccgccgagtggctctggcgcacgctgggacggaacaaaaagcctagactttgcacacgcgaagagttcaccaaaaaggtcagaacaaatgcggccatgggcgctgtgtttaccgaagagaaccaatgggactctgcccgggctgccgtcgaagatgaggagttctggaagctggtggaccgcgaaagagagctccacaaactggggaagtgtggaagctgcgtttataatatgatgggcaaacgggaaaagaaacttggggagtttggcaaggccaaaggatccagagcgatctggtacatgtggctgggcgctcggtacctcgagttcgaagccctggggtttctgaacgaggatcattggttctctcgcgaaaatagctattccggagtggagggcgaagggctccacaagctgggatacatccttagagacatttctaagatccccggcggggccatgtatgctgatgacacggccggctgggacacccggattacagaggatgacctgcataacgaggagaagatcacccagcagatggatccggagcaccgccagctcgctaatgccatttttaagctgacataccaaaacaaagtcgtgaaggtgcagagacctacccccaaaggaacagttatggacatcatcagccggaaggatcagcgcggctccggacaggtgggaacctatggccttaatacgttcacaaacatggaagcgcaactggtcagacagatggagggggaaggagtgctcagcaaggccgacctggagaatccccatctgctcgagaaaaagattacccagtggctggaaaccaaaggcgttgagcggcttaagcgcatggctatctctggggatgactgcgtggtcaaacctattgatgacagatttgccaacgctctgctcgccctgaacgatatgggcaaggtgcggaaggacatcccgcagtggcaaccctccaaaggatggcatgattggcagcaggtccctttctgtagccaccatttccacgaacttattatgaaggacggccgcaaactggtggttccctgcagacctcaggacgagctcatcgggcgggcgcgcatctctcaaggagccggctggtccctgaaggaaacagcttgtctggggaaagcctacgctcagatgtggagcctcatgtattttcacagacgggatctgagacttgcctctaatgctatttgctccgccgtgcccgtccattggatccctaccagccgcacaacgtggtccattcacgcgcatcaccagtggatgaccacagaggacatgctgaccgtgtggaaccgggtttggatcgaggataatccctggatggaagacaagacaccggtgaccacgtgggaggatgtcccttacctcggaaagagagaagaccaatggtgtggcagcctgattgggcttacctctcgcgccacatgggctcagaacatcctgaccgccattcaacaggtgcggagcctcatcggcgatgaggagttcctggactacatgccctccatgaaaagatttcgcaaggaagaggaatctgagggagccatctggtga

SEQ ID NO: 20468 - RNA, 9873 nt, synthetic construct
  misc_feature 1..9873: note = derived and/or modified CDS sequence (opt5) from DENV-3__GU131908__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcgggaagtctctcctgtttaagaccgcctccggcattaatatgtgtacccttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctggaagaatggagtgtgtggcatcagatctacaacccgcatggaaaacctgctgtggaaacagattgctaatgagctcaactatatcctgtgggaaaataacatcaaacttacagtcgtggttggggatattatcggagtgctggagcagggcaaacggaccctcacgcctcagcccatggaactgaagtactcctggaagacctgggggaaagccaagattgtcacagccgagacccaaaatagctctttcatcattgacggacctaacacacccgagtgcccgtccgctagcagagcgtggaacgtgtgggaagtggaggactatggctttggcgtcttcaccacaaatatctggctgaaacttcgcgaagtttacacccagtcctgtgatcatcggctcatgtctgccgctatcaaggacgagagagccgtgcacgccgatatggggtactggattgaaagccagaaaaacggatcctggaagctggagaaggcttcttttatcgaggtgaaaacgtgcacatggcctaagagccacaccctgtggtccaatggcgtcctcgaaagcgacatgattatccccaaatctctggccgggcctatttcccagcataaccaccgccccggatatcatacccaaacagcgggcccttggcaccttgggaagctggagctcgatttcaattactgcgaaggaaccacggtggttatcacagagaactgtggcacccggggccccagcctgagaacaaccacagtgtctgggaaactgatccacgagtggtgctgtcgctcctgcacccttccgcctctccggtatatgggagaagacggctgttggtacgggatggagattagacccatcaatgaaaaggaggaaaacatggtcaagagcctggtgtctgctggaagcggcaaagttgataattttacgatgggggtgctgtgcctcgccattctgttcgaggaggtcatgcggggaaagttcggcaaaaagcatatgatcgccggcgtgctttttaccttcgttctgctcctgtccgggcagattacatggcgcgacatggctcacaccctgatcatgattggaagcaacgcctctgatagaatgggcatgggggtgacatatcttgcgctgatcgctacctttaaaatccagcccttcctcgccctgggatttttcctccggaagctgacgtccagagaaaatcttctgctcggcgtcgggctggccatggctacaaccctgcaacttcctgaggacattgaacagatggccaacggaatcgctctgggcctcatgacactgaagctcattacccagtttgagacctaccagctgtggacagcccttgtgagcctgacgtgttccaataccatcttcacactcaccgtggcgtggcgcacagccaccctgattctggctggcgtctctcttctgccgctctgccaaagctcctctatgcggaaaacggattggctgcccatgacagttgccgctatgggggtgcctcccctccctctgtttatcttcagccttaaggacacccccaaaagacgctcctggcctctgaacgaaggagtgatggccgtcggcctggtgtctatcctcgccagctccctgcttagaaatgatgttcccatggctgggccgctggtggcgggaggcctcctgattgcctgttatgtcatcaccgggacaagcgctgacctcaccgtggagaaggccgccgacgttacatgggaggaagaggctgaacagacgggagtgtctcataacctgatgattaccgtcgatgacgatggcacaatgcggatcaaagacgatgagaccgaaaacattcttacagtgctgctgaagaccgccctcctgatcgtctccggcatctttccttacagcattcccgcgacgcttctggtgtggcacacctggcagaaacagacacaacgctctggggttctctgggacgtgccttctcccccggagacccagaaggctgagctggaagagggagtctacagaatcaagcagcagggcattttcgggaaaacacaagtgggagttggcgtgcagaaggaaggggtctttcataccatgtggcacgtgacacggggagccgtgctcacgcacaatggcaaacgcctggagcctaactgggccagcgttaagaaagatcttatcagctatggcgggggatggagactgaatgctcagtggcaaaagggcgaggaagtccaggtgattgccgtggagcccgggaagaaccctaaaaatttccagaccatgcccggaatcttccagacaaccaccggcgaaattggggcgatcgctctggactttaagcccggaacatccggcagccctatcattaaccgggagggcaaagtcgtggggctctacggaaatggcgttgtgacgaagaacgggggatatgtctccggcatcgcccaaaccaatgccgaaccggatgggcccacacctgagctggaggaagagatgttcaaaaagcgcaaccttaccattatggacctgcatcccggcagcggaaagacaagaaaatacctccctgctatcgtgcgggaagccattaagcgcagactgcggaccctcatcctggctcccacgagagttgtggccgcggagatggaagaggcccttaaaggcctgcctatccgctatcagacaaccgctaccaagtctgagcacacagggcgggaaattgtcgatctgatgtgccatgccacctttacaatgagactcctgagcccggtgcgcgttcccaattacaaccttgtgatcatggacgaggctcacttcaccgatcctgcctccattgccgctcggggatatatctctacgagagtcggcatgggggaagcggccgctatttttatgacagccacaccccctggaacagccgaggctttcccccagagcaatgccccgatccaggacgaggaacgcgacatccctgagcggtcctggaactctggcaatgaatggattaccgattttgtggggaaaacggtgtggttcgtccccagcatcaaggcgggcaacgacattgctaactgtctgagaaagaatggcaaaaaggttatccaactctcccgcaaaacctttgatacagagtaccagaagacccggctgaacgactgggatttcgtggtgacaaccgacatttctgaaatgggagccaattttaaagccgatagagtcatcgacccccggcgctgcctgaagcctgtgattctcacagatgggcccgagagagttatccttgctggacctatgccggtgaccgccgcgagcgccgctcagcggcgcggcagagtcgggcggaacccccagaaggagaatgaccaatacatcttcacgggacagcctctgaacaatgatgaagaccatgcccactggacagaggctaaaatgctgctcgacaacattaatacccccgaaggcatcattcctgccctgttcgagcccgaaagagagaagtccgctgccatcgatggggagtatcgccttaaaggcgaaagccggaagacctttgtggagctgatgagacgcggagacctcccggtttggctggcgcacaaagtggcctctgaaggcattaagtacacagatcggaaatggtgcttcgacggggagagaaacaatcagatcctggaagagaacatggatgtcgagatctggaccaaggaaggagagcgcaagaaactccggcctagatggcttgacgctcgcacatattccgatcccctggccctgaaggaatttaaagacttcgctgccggcagaaagagcattgccctcgatctggtgacggagatcgggcgggtcccttctcatcttgctcaccgcaccagaaatgcgctggacaacctcgtgatgctgcatacatccgaacacggaggccgggcctaccgccacgctgttgaggagctgcccgaaaccatggagacactccttctgctgggcctcatgattctgcttaccgggggagccatgctgtttctcatcagcggcaaagggattggaaagacgtccatcggcctgatctgtgtgattgtgtctagcgggatgctgtggatggccgatgtccctctccagtggatcgcttccgccattgttcttgagttctttatgatggtgctgctgatccccgagccggagaagcaaagaacccctcaggacaatcagctcgcgtatgtggtcattggaatcctgacacttgccgctattgtggccgctaacgaaatgggcctgctcgagaccacaaaacgggatctgggcatgagcaaggaacccggggttgtgtctcccacctcctacctggacgtcgacctccatcctgccagcgcgtggacgctttatgccgtggctacaaccgtcatcacaccgatgctgagacacaccatcgaaaattctaccgccaacgtgagcctggctgccattgctaaccaagccgttgtgctcatgggactggataaaggctggcccatctccaagatggaccttggggtccctctgctcgcgctgggatgctactctcaggtgaatcccctgacactcacggccgctgttcttctgctggtgacccattacgccattatcggccctgggctccaggctaaagccacacgcgaagcccagaagcggaccgcggctggaattatgaagaaccccacagtcgatggcatcatgaccatcgacctggatcctgtgatttatgacagcaaattcgagaagcaacttggccaggtgatgctgctcgttctgtgtgccgtccagctgctccttatgagaacgtcctgggctctgtgcgaggccctgacactcgccaccgggccgatcaccacactgtgggaaggatctcccggcaaattttggaataccacaattgctgtgagcatggccaacatcttccgcgggtcctaccttgcgggagccggcctggcttttagcattatgaagtctgtggggacgggacggagaggcaccggctcccagggggagacactcggagaaaaatggaagaagaaactgaatcaactgagccggaaggagttcgatctctataaaaagtccggcatcaccgaagtcgaccgcacagaggccaaagaggggcttaagagaggagaaaccacgcaccatgctgtttctcggggcagcgccaaactgcagtggtttgtggagcgcaacatggtgatccctgaagggagagtcattgatctgggatgtggccggggcgggtggtcctactattgcgcgggactcaagaaggtgaccgaggttcgcggctacacaaaagggggacccggccacgaagaacctgtgcccatgtctacctatgggtggaatatcgtcaagctgatgagcggaaaagacgtgttctaccttccgcctgagaagtgtgatacactgctctgcgacattggcgaatccagcccctctcccaccgttgaggaatccagaacaatccgggtgctgaaaatggtcgagccttggctgcgcaacaatcagttctgtattaaggtgctcaacccctacatgcctaccgtgatcgagcaccttgaaagactgcagcggaagtatggcgggatgctggtcagaaatccgctcagccgcaactctacgcatgagatgtactggatttccaatggaacaggcaacatcgttagctctgtgaatatggtgagccggctgcttctgaacagatttaccatgacccaccgccggcccacaatcgaaaaagatgtcgacctcggggccggaacgagacatgtgaacgctgagcctgaaacccccaatatggacgttattggcgagcgcatcaagcggattaaagaggaacactcctctacatggcactatgatgacgagaacccttacaagacctgggcctatcatgggagctacgaagtgaaagctacaggatccgccagctccatgatcaatggcgtcgtgaagctgctgaccaagccctgggatgttgtgccgatggtcacacaaatggctatgaccgacacgacccctttcggccagcagagagtgtttaaagagaaggttgatacacgcacaccccggcctatgcccgggacaagaaaagtgatggaaattaccgccgagtggctctggcgcacgctgggacggaacaagaaacctagactttgcacacgcgaggagttcaccaagaaggtcagaacaaatgcggccatgggcgctgtgtttaccgaggaaaaccaatgggactctgcccgggctgccgtcgaggatgaagagttctggaaactggtggaccgcgagagagaactccacaagctggggaaatgtggaagctgcgtttataatatgatgggcaagcgggagaagaaacttggggaatttggcaaagccaaaggatccagagcgatctggtacatgtggctgggcgctcggtacctcgagttcgaggccctggggtttctgaacgaagatcattggttctctcgcgagaatagctattccggagtggaaggcgaggggctccacaagctgggatacatccttagagacatttctaaaatccccggcggggccatgtatgctgatgacacggccggctgggacacccggattacagaagatgacctgcataacgaggagaagatcacccagcagatggatccggaacaccgccagctcgctaatgccatttttaaactgacataccaaaacaaggtcgtgaaagtgcagagacctacccccaagggaacagttatggacatcatcagccggaaggatcagcgcggctccggacaggtgggaacctatggccttaatacgttcacaaacatggaggcgcaactggtcagacagatggaaggggagggagtgctcagcaaagccgacctggaaaatccccatctgctcgagaagaaaattacccagtggctggagaccaagggcgttgaacggcttaaacgcatggctatctctggggatgactgcgtggtcaagcctattgatgacagatttgccaacgctctgctcgccctgaacgatatgggcaaggtgcggaaagacatcccgcagtggcaaccctccaagggatggcatgattggcagcaggtccctttctgtagccaccatttccacgagcttattatgaaagacggccgcaagctggtggttccctgcagacctcaggacgaactcatcgggcgggcgcgcatctctcaaggagccggctggtccctgaaagagacagcttgtctggggaaggcctacgctcagatgtggagcctcatgtattttcacagacgggatctgagacttgcctctaatgctatttgctccgccgtgcccgtccattggatccctaccagccgcacaacgtggtccattcacgcgcatcaccagtggatgaccacagaagacatgctgaccgtgtggaaccgggtttggatcgaggataatccctggatggaggacaagacaccggtgaccacgtgggaagatgtcccttacctcggaaaaagagaggaccaatggtgtggcagcctgattgggcttacctctcgcgccacatgggctcagaacatcctgaccgccattcaacaggtgcggagcctcatcggcgatgaagagttcctggactacatgccctccatgaagagatttcgcaaagaggaagagtctgaaggagccatctggtga

SEQ ID NO: 20469 - RNA, 9873 nt, synthetic construct
  misc_feature 1..9873: note = derived and/or modified CDS sequence (opt5) from DENV-3__GU131909__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgcctccggcattaatatgtgtacccttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagtccaaacccacgctggacatcgagctccagaagaccgaagctacacaactggccacccttcgcaaactgtgtattgagggaaagatcacaaatattaccacggatagcagatgccctacacagggcgaagcgaccctcccggaggaacaggaccagaactatgtgtgtaaacacacctacgtggatcggggctgggggaatggatgcggcctgtttgggaagggatctcttgtcacatgcgccaagttccaatgtctggagcccatcgagggcaaagtggttcagtatgaaaacctcaagtacaccgtgattatcacagtccacacgggggaccagcatcaggtgggaaatgacacccaaggcgttacagtggagatcacccctcaggcttccacagtcgaagccgtgctgcccgagtatggcaccctggggctcgaatgcagccctcgcacgggactggattttaacgagatgattcttctgaccatgaaaaataaggcttggatggtccacagacagtggttctttgacctccccctgccgtggacatctggcgccaccacagagacccctacgtggaaccggaaagaacttctggtgacattcaagaatgcccatgctaaaaagcaagaggttgtggtcctcgggtcccaggaaggagcgatgcacaccgccctgacaggcgctaccgagatccagaacagcgggggcacctctatttttgccggacacctgaagtgtcgcctcaaaatggataagctggaacttaaaggcatgtcctacgccatgtgcctgaatacattcgtgctcaagaaagaggttagcgagacgcagcatgggaccatcctgattaaggtggaatacaagggagaggacgctccctgtaaaatccctttctccacagaagatggccaagggaaggcccacaacggaagactgatcaccgcgaaccccgtcgtgaccaagaaggaggagcccgtgaatattgaagctgagcctccgtttggcgaatctaacatcgttattgggatcggcgacaaagcccttaagattaattggtataagaaaggaagctccatcggcaagatgttcgaggccaccgctagaggggctagacgcatggctatcctcggagatacggcctgggactttggcagcgtcgggggagtgctgaactctctgggcaaaatggtgcatcagattttcgggtccgcgtacacagccctctttagcggcgtctcttggatcatgaagattggaatcggcgtgctgcttacctggattgggctgaatagcaaaaacacctccatgtctttcagctgcatcgttattggaatcatcacactctatctgggcgctgtggtccaggccgatatggggtgtgctattaattggaagggaaaggaactgaaatgcggctccgggatctttgtgaccaacgaggttcacacatggacggagcagtacaagttccaagccgacagccccaaacggcttgcgaccgccattgctggcgcctgggaaaatggagtgtgtggcatcagatctacaacccgcatggagaacctcctgtggaagcagattgctaatgaactgaactatatcctctgggagaataacatcaaactgacagtcgtggttggggatattatcggagtgcttgaacagggcaagcggaccctgacgcctcagcccatggagctcaaatactcctggaagacctgggggaaggccaaaattgtcacagccgagacccaaaatagctcttttatcattgacggacctaacacacccgaatgcccgtccgctagcagagcgtggaacgtgtgggaggtggaagactatggcttcggcgtctttaccacaaatatctggctgaagctgcgcgaggtttacacccagtcctgtgatcatcggcttatgtctgccgctatcaaagacgaaagagccgtgcacgccgatatggggtactggattgagagccagaagaacggatcctggaaactcgagaaggcttctttcatcgaagtgaagacgtgcacatggcctaaaagccacaccctgtggtccaatggcgtcctggagagcgacatgattatccccaagtctctcgccgggcctatttcccagcataaccaccgccccggatatcatacccaaacagcgggcccttggcacctggggaaacttgaactggattttaattactgcgagggaaccacggtggttatcacagagaactgtggcacccggggccccagcctcagaacaaccacagtgtctgggaagctgatccacgaatggtgctgtcgctcctgcaccctgccgcctcttcggtatatgggagaggacggctgttggtacgggatggaaattagacccatcaatgagaaagaagagaacatggtcaagagcctcgtgtctgctggaagcggcaaggttgataatttcacgatgggggtgctgtgcctggccattctcttcgaggaagtcatgcggggaaaatttggcaagaaacatatgatcgccggcgtgctgttcacctttgttcttctgctctccgggcagattacatggcgcgacatggctcacaccctgatcatgattggaagcaacgcctctgatagaatgggcatgggggtgacatatctggcgcttatcgctaccttcaagatccagccctttctggccctcggattctttctgcggaaactcacgtccagagagaatctgcttctgggcgtcgggctcgccatggctacaaccctgcaactgcctgaagacattgagcagatggccaacggaatcgctcttggcctgatgacactcaagctgattacccagttcgaaacctaccagctctggacagccctggtgagccttacgtgttccaataccatctttacactgaccgtggcgtggcgcacagccaccctcattctggctggcgtctctctgcttccgctgtgccaaagctcctctatgcggaagacggattggctccccatgacagttgccgctatgggggtgcctcccctgcctctcttcatctttagcctgaaagacacccccaagagacgctcctggcctcttaacgagggagtgatggccgtcggcctggtgtctatcctggccagctccctcctgagaaatgatgttcccatggctgggccgcttgtggcgggaggcctgctcattgcctgttatgtcatcaccgggacaagcgctgacctgaccgtggagaaagccgccgacgttacatgggaagaggaagctgagcagacgggagtgtctcataacctcatgattaccgtcgatgacgatggcacaatgcggatcaaggacgatgaaaccgagaacattctgacagtgcttctgaaaaccgccctgctcatcgtctccggcatcttcccttacagcattcccgcgacgctgcttgtgtggcacacctggcagaagcagacacaacgctctggggttctgtgggacgtgccttctcccccggagacccagaaagctgaactcgaggaaggagtctacagaatcaagcagcagggcatttttgggaagacacaagtgggagttggcgtgcagaaagagggggtcttccataccatgtggcacgtgacacggggagccgtgctgacgcacaatggcaagcgcctcgagcctaactgggccagcgttaaaaaggatctgatcagctatggcgggggatggagacttaatgctcagtggcaaaaaggcgaagaggtccaggtgattgccgtggaacccgggaagaaccctaagaatttccagaccatgcccggaatctttcagacaaccaccggcgagattggggcgatcgctctggacttcaaacccggaacatccggcagccctatcattaaccgggaaggcaaggtcgtggggctgtacggaaatggcgttgtgacgaaaaacgggggatatgtctccggcatcgcccaaaccaatgccgagccggatgggcccacacctgagctcgaagaggaaatgtttaagaaacgcaacctgaccattatggaccttcatcccggcagcggaaagacaagaaagtacctgcctgctatcgtgcgggaggccattaaacgcagactccggaccctgatcctcgctcccacgagagttgtggccgcggaaatggaggaggccctgaagggccttcctatccgctatcagacaaccgctaccaaatctgaacacacagggcgggagattgtcgatctgatgtgccatgccaccttcacaatgagactgctcagcccggtgcgcgttcccaattacaacctggtgatcatggacgaagctcactttaccgatcctgcctccattgccgctcggggatatatctctacgagagtcggcatgggggaggcggccgctattttcatgacagccacaccccctggaacagccgaggcttttccccagagcaatgccccgatccaggacgaggagcgcgacatccctgaacggtcctggaactctggcaatgagtggattaccgatttcgtggggaagacggtgtggtttgtccccagcatcaaagcgggcaacgacattgctaactgtcttagaaagaatggaaagaaagttatccaactgtcccgcaagaccttcgatacagaataccagaaaacccggctcaacgactgggattttgtggtgacaaccgacatttctgagatgggcgccaatttcaaggccgatagagtcatcgacccccggcgctgcctgaaacctgtgattctgacagatgggcccgagagagttatcctcgctggacctatgccggtgaccgccgcgagcgccgctcagcggcgcggcagagtcgggcggaacccccagaaggaaaatgaccaatacatcttcacgggacagcctcttaacaatgatgaggaccatgcccactggacagaagctaagatgctgctggacaacattaatacccccgagggcatcattcctgccctctttgaacccgagagagagaaatccgctgccatcgatggggaatatcgcctgaagggcgagagccggaaaaccttcgtggaacttatgagacgcggagacctgccggtttggctcgcgcacaaggtggcctctgagggcattaaatacacagatcggaagtggtgctttgacggggaaagaaacaatcagatcctggaggagaacatggatgtcgaaatctggaccaaagagggagaacgcaagaagctgcggcctagatggctcgacgctcgcacatattccgatccccttgccctgaaagagttcaaggactttgctgccggcagaaaaagcattgccctggatctcgtgacggaaatcgggcgggtcccttctcatctggctcaccgcaccagaaatgcgcttgacaacctggtgatgctccatacatccgagcacggaggccgggcctaccgccacgctgttgaggaactgcccgagaccatggaaacactgctccttctgggcctgatgattctcctgaccgggggagccatgcttttcctgatcagcggcaaggggattggaaaaacgtccatcggcctcatctgtgtgattgtgtctagcgggatgctgtggatggccgatgtccctctgcagtggatcgcttccgccattgttctcgagtttttcatgatggtgcttctgatccccgagccggaaaagcaaagaacccctcaggacaatcagctggcgtatgtggtcattggaatcctcacactggccgctattgtggccgctaacgagatgggccttctggaaaccacaaagcgggatctcggcatgagcaaagagcccggggttgtgtctcccacctcctacctggacgtcgacctgcatcctgccagcgcgtggacgctctatgccgtggctacaaccgtcatcacaccgatgcttagacacaccatcgaaaattctaccgccaacgtgagcctggctgccattgctaaccaagccgttgtgctgatgggactcgataagggctggcccatctccaaaatggacctgggggtccctcttctggcgctcggatgctactctcaggtgaatcccctgacactgacggccgctgttctccttctggtgacccattacgccattatcggccctgggctgcaggctaaggccacacgcgaggcccagaaacggaccgcggctggaattatgaagaaccccacagtcgatggcatcatgaccatcgacctcgatcctgtgatttatgacagcaagtttgagaaacaactgggccaggtgatgcttctggttctctgtgccgtccagctgctgctcatgagaacgtcctgggctctttgcgaagccctgacactggccaccgggccgatcaccacactctgggagggatctcccggcaagttctggaataccacaattgctgtgagcatggccaacatctttcgcgggtcctacctggcgggagccggccttgctttcagcattatgaaatctgtggggacgggacggagaggcaccggctcccagggggaaacactgggagagaagtggaaaaagaagctcaatcaactgagccggaaagaatttgatctgtataagaaatccggcatcaccgaggtcgaccgcacagaggccaaggaagggctcaaaagaggagagaccacgcaccatgctgtttctcggggcagcgccaaacttcagtggttcgtggaacgcaacatggtgatccctgaggggagagtcattgatctgggatgtggccggggcgggtggtcctactattgcgcgggactgaaaaaggtgaccgaagttcgcggctacacaaaaggcgggcccgggcacgaggagcctgtgcccatgtctacctatgggtggaatatcgtcaaactcatgagcggaaaggacgtgttctacctgccgcctgaaaaatgtgatacacttctgtgcgacattggcgagtccagcccctctcccaccgttgaagagtccagaacaatccgggtgctcaagatggtcgagccttggctgcgcaacaatcagttttgtattaaagtgctgaacccctacatgcctaccgtgatcgaacacctcgagagacttcagcggaagtatggcgggatgctggtcagaaatccgctgagccgcaactctacgcatgaaatgtactggatttccaatggaacaggcaacatcgttagctctgtgaatatggtgagccggctcctgcttaacagattcaccatgacccaccgccggcccacaatcgagaaggatgtcgacctgggggccggaacgagacatgtgaacgctgaacctgagacccccaatatggacgttattggcgagcgcatcaaacggattaaggaagaacactcctctacatggcactatgatgacgaaaacccttacaaaacctgggcctatcatgggagctacgaggtgaaggctacaggatccgccagctccatgatcaatggcgtcgtgaaactcctgaccaagccctgggatgttgtgccgatggtcacacaaatggctatgaccgacacgaccccttttggccagcagagagtgttcaaggaaaaagttgatacacgcacaccccggcctatgcccgggacaagaaaggtgatggagattaccgccgagtggctgtggcgcacgctcggacggaacaaaaagcctagactgtgcacacgcgaagagtttaccaaaaaggtcagaacaaatgcggccatgggcgctgtgttcaccgaagagaaccaatgggactctgcccgggctgccgtcgaagatgaggagttttggaaacttgtggaccgcgaaagagagctgcacaaactcgggaagtgtggaagctgcgtttataatatgatgggcaaacgggaaaagaaactgggggagttcggcaaggccaaaggatccagagcgatctggtacatgtggcttggcgctcggtacctggagtttgaagccctcgggttcctgaacgaggatcattggttttctcgcgaaaatagctattccggagtggagggcgaagggctgcacaagctcggatacatcctgagagacatttctaagatccccggcggggccatgtatgctgatgacacggccggctgggacacccggattacagaggatgaccttcataacgaggagaagatcacccagcagatggatccggagcaccgccagctggctaatgccattttcaagctcacataccaaaacaaagtcgtgaaggtgcagagacctacccccaaaggaacagttatggacatcatcagccggaaggatcagcgcggctccggacaggtgggaacctatggcctgaatacgtttacaaacatggaagcgcaacttgtcagacagatggagggggaaggagtgctgagcaaggccgacctcgagaatccccatctgctggagaaaaagattacccagtggctcgaaaccaaaggcgttgagcggctgaagcgcatggctatctctggggatgactgcgtggtcaaacctattgatgacagattcgccaacgcccttctggccctcaacgatatgggcaaggtgcggaaggacatcccgcagtggcaaccctccaaaggatggcatgattggcagcaggtccctttctgtagccaccattttcacgaactgattatgaaggacggccgcaaacttgtggttccctgcagacctcaggacgagctgatcgggcgggcgcgcatctctcaaggagccggctggtccctcaaggaaacagcttgtctggggaaagcctacgctcagatgtggagcctgatgtatttccacagacgggatctcagactggcctctaatgctatttgctccgccgtgcccgtccattggatccctaccagccgcacaacgtggtccattcacgcgcatcaccagtggatgaccacagaggacatgcttaccgtgtggaaccgggtttggatcgaggataatccctggatggaagacaagacaccggtgaccacgtgggaggatgtcccttacctgggaaagagagaagaccaatggtgtggcagcctcattgggctgacctctcgcgccacatgggctcagaacatccttaccgccattcaacaggtgcggagcctgatcggcgatgaggagtttctcgactacatgccctccatgaaaagattccgcaaggaagaggaatctgagggagccatctggtga

SEQ ID NO: 20470 - RNA, 9873 nt, synthetic construct
  misc_feature 1..9873: note = derived and/or modified CDS sequence (opt5) from DENV-3__GU131912__SS-prME
  source 1..9873: mol_type = other RNA
acaagcctgtgcctcatgatgatgctgcccgccacacttgctttccacctgacgtcccgggacggcgaacctcggatgatcgtggggaagaacgaacgcggaaaatctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcaccaatattttcgccggacacctcaagtgtcgcctgaaaatggataaacttgaactgaaaggcatgtcttacgccatgtgcctcaacacatttgtgctgaagaaagaggtttccgagacgcagcatgggaccatcctgattaaggtggaatacaagggagaggacgctccctgtaaaatccctttcagcacagaagatggccaagggaaggcccacaacggaagacttatcaccgcgaatcccgtcgtgaccaagaaagaggagcccattaacatcgaagctgagcctccgttcggcgaatccaatattgtgatcgggattggcgacaaagccctcaagatcaactggtataagaaaggatctagcatcggcaagatgtttgaggccaccgctagaggggccagacgcatggctattctgggagatacggcctgggacttcggctccgttgggggagtcctgaatagcctcggcaaaatggtgcatcagatctttgggtctgcgtacacagccctgttctccggcgtgagctggattatgaagatcggaattggcgtccttctgacctggatcgggctcaactctaaaaataccagcatgtccttttcttgcattgtgatcggaatcattacactgtatctgggcgctgttgtgcaggccgatatggggtgtgtcatcaactggaagggaaaggaacttaaatgcggcaatgggattttcgtgaccaacgaggttcacacatggacggagcagtacaagtttcaagctgacagccccaaacggctcgccaccgcgatcgccggctcctgggaaaatggagtgtgtggcattagaagcacaacccgcatggagaacctgctgtggaagcagatcgctaatgaactcaactatatcctgtgggagaataacattaaacttacagtcgtggttggggatatcattggagtgctggaacagggcaagcggaccctcacgcctcagcccatggagctgaaatactcttggaagacctgggggaaggccaaaatcgtcacagctgagacccaaaactccagcttcattatcgacggacctaatacacccgaatgcccgtctgcctccagagcctggaacgtgtgggaggtggaagactatggctttggcgtcttcaccacaaatatctggctgaaacttcgcgaggtttacacccagagctgtgatcatcggctcatgtccgctgcgattaaagacgaaagagccgtgcacgctgatatggggtactggatcgagtctcagaagaacggaagctggaaactggagaaggcctcctttattgaagtgaagacgtgcacatggcctaaatctcacaccctgtggagcaatggcgtcctcgagtccgacatgatcattcccaagagcctggccgggcctatctctcagcataaccaccgccccggatatcatacccaaacagctggcccttggcaccttgggaaactggaactcgatttcaattactgcgagggaaccacggtggttatcgccgagaactgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaatgagaaagaagagaacatggtcaagtccctggtgagcgcgggatctggcaaggttgataattttaccatgggggtgctgtgcctcgctatcctgttcgaggaagtcatgcggggaaaattcggcaagaaacatatgattgccggcgtgctttttacgttcgttctgctcctgagcgggcagatcacctggcgcgacatggcccacacactgattatgatcggatccaacgctagcgatagaatgggcatgggggtgacctatcttgccctgatcgcgacatttaagattcagcccttcctcgctctgggatttttcctccggaaactgacctctagagagaatcttctgctcggcgtcgggctggccatggccacgacactgcaacttcctgaagacatcgagcagatggctaacggaattgccctgggcctcatgaccctgaagctcatcacacagtttgaaacctaccagctgtggaccgctcttgtgtccctgacatgtagcaatacgattttcaccctcacagtggcctggcgcaccgcgacactgatcctggccggcgtctcccttctgccgctctgccaatctagctccatgcggaagaccgattggctgcccatgacggttgctgccatgggggtgcctcccctccctctgtttatcttctctcttaaagacacacccaagagaaaaagctggcctctgaacgagggagtgatggctgtcggcctggtgtccattctcgcctctagcctgcttcgcaacgatgttcccatggccgggccgctggtggctggaggcctcctgatcgcgtgttatgtcattaccgggacctccgccgacctcacagtggagaaggctgccgacgttacctgggaagaggaagccgagcagacaggagtgagccataatctgatgatcacggtcgatgacgatggcaccatgagaattaaagacgatgaaacagagaacatccttaccgtgctgctgaagacagctctcctgatcgtctctggcatttttccttactccatccccgccacccttctggtgtggcacacgtggcagaaacagacccaacggagcggggttctctgggacgtgccttctcccccggagacacagaaggcggaactggaggaaggagtctaccgcattaagcagcagggcatcttcgggaaaacccaagtgggagttggcgtgcagaaggagggggtctttcatacaatgtggcacgtgaccagaggagctgtgctcacacacaatggcaaacggctggagcctaactgggcctccgttaagaaagatcttattagctatggcgggggatggcgcctgtctgcccagtggcaaaagggcgaagaggtccaggtgatcgctgtggaacccgggaagaatcctaaaaacttccagacgatgcccggaattttccagaccacaaccggcgagatcggggccatcgcgctggactttaagcccggaacctccggcagccctattatcaatagagaaggcaaagtcgtggggctctacggaaacggcgttgtgacaaagaatgggggatatgtctccggcattgctcaaacgaacgccgagccggatgggcccacccctgagctggaagaggaaatgttcaaaaagcggaatcttacaatcatggacctgcatcccggcagcggaaagacccgcaaatacctccctgccattgtgagagaggctatcaagcggcgcctgagaacactcatcctggcccccacccgggttgtggctgccgaaatggaggaggcgcttaaaggcctgcctattagatatcagacgacagcctctaagagcgaacacaccgggcgcgagatcgtcgatctgatgtgccatgctacctttacaatgcggctcctgtccccggtgagagttcccaactacaatcttattatcatggacgaagcccacttcaccgatcctgcttctattgccgcccgcggatatatcagcacacgggtgggcatgggggaggctgcggccatctttatgaccgctacgccccctggaacagccgaagccttcccccagtccaacgctccgattcaggacgaggagagagacatccctgaacgctcttggaatagcggcaacgagtggattaccgattttgtcgggaaaacagtgtggttcgtgccctccatcaaggccggcaacgacattgcgaattgtctgcggaagaacggcaaaaaggtcatccaactctctagaaaaacctttgatacggaataccagaagacccgcctgaatgactgggatttcgttgtgacaaccgacattagcgagatgggagctaactttaaagccgatcgggtgatcgaccccagacggtgcctgaagcctgtcatcctcacagatgggcccgagcgcgtgattcttgccggacctatgccggttaccgctgcctccgcggcccagagacggggccgcgtggggagaaatccccagaaggaaaacgaccaatacatcttcacaggacagcctctgaataacgatgaggaccatgctcactggaccgaagccaaaatgctgctcgacaatattaacacgcccgagggcatcattcctgctctgttcgaacccgagcgggaaaagagcgccgctatcgatggggaatatagacttaaaggcgagtctcgcaagacatttgtcgaactgatgcggagaggagacctcccggtgtggctggcccacaaagttgcgtccgagggcatcaagtacaccgatcgcaaatggtgcttcgacggggaacggaataaccagattctggaggagaatatggatgtggaaatctggaccaaggagggagaaagaaagaaactccgccctcggtggcttgacgccagaacatatagcgatcccctggctctgaaggagtttaaagacttcgccgctggccgcaagtctattgccctcgatctggtcaccgaaatcgggagagtgccttcccatcttgcccaccggacacgcaacgctctggacaatctcgtcatgctgcatacgagcgagcacggaggcagagcgtaccggcacgccgtggaggaactgcccgagaccatggaaacactccttctgctgggcctcatgattctgcttaccgggggagctatgctgtttctcatctccggcaaagggatcggaaagacatctattggcctgatctgtgttattgtgagctccgggatgctgtggatggccgatgtgcctctccagtggatcgccagcgctattgtccttgagttctttatgatggttctgctgatccccgagccggaaaagcaacgcacccctcaggacaaccagctcgcctatgtggtgattggaatcctgacgcttgcggccatcgtcgctgccaatgagatgggcctgctcgaaaccacaaaaagagatctgggcatgtctaaggagcccggggtggtttcccccaccagctacctggacgtggacctccatcctgcttctgcctggacactttatgcggtcgccaccacggtgattacaccgatgctgcggcacaccatcgaaaacagcacagctaacgtctccctggccgctattgccaatcaagctgtggttctcatgggactggataaaggctggcccatctctaagatggaccttggggtgcctctgctcgccctgggatgctacagccaggtcaaccccctgaccctcaccgcggccgtgcttctgctggttacacattacgctattatcggccctgggctccaggccaaagctacgagagaggcccagaagcgcaccgccgcgggaatcatgaagaatcccacagtggatggcattatgaccatcgacctggatcctgtcatttatgactccaaattcgagaagcaacttggccaggtgatgctgctcgtgctgtgtgctgttcagctgctccttatgcggacatcttgggccctgtgcgaagctctgaccctcgccacggggccgatcacaaccctgtgggagggaagccccggcaaattttggaacaccacaattgccgtctccatggctaatatcttcagagggagctaccttgccggagcgggcctggccttttctatcatgaagtccgtggggaccggacgccggggcacaggcagccagggggaaacgctcggagagaaatggaagaagaaactgaaccaactgtccagaaaggagttcgatctctataaaaagtctggcattaccgaggtggaccggacagaggctaaagaagggcttaagcgcggagagaccacacaccatgccgtcagcagaggctccgctaaactgcagtggtttgttgaacggaatatggtgatccctgaggggcgcgtgattgatctgggatgtggcagaggcgggtggtcttactattgcgccggactcaagaaggtcaccgaagtgcggggctacacgaaagggggacccggccacgaggagcctgttcccatgagcacctatgggtggaacatcgtgaagctgatgtccggaaaagacgtcttctaccttccgcctgaaaagtgtgatacactgctctgcgacattggcgagagctctccctcccccaccgtggaagagagccgcacaatcagagttctgcggatggtggagccttggctgcgcaataaccagttctgtattaaagtcctcaatccctacatgcctaacgtgatcgaacaccttgagagactgcagcggaagtatggcgggatgctggtgagaaatccgctctctcgcaactccacccatgaaatgtactggatcagcaatggaacaggcaacattgtctctagcgttaacatggtgtcccggctgcttctgaatagatttaccatgacgcaccgccggcccacaatcgagaaggatgtggacctcggggcgggaaccagacatgtcaacgccgaacctgagacccccaatatggacgtgattggcgagcgcatcaaacggattaaggaagaacactctagcacatggcactatgatgacgaaaacccttacaaaacgtgggcttatcatgggtcctacgaggttaaggccaccggaagcgcttcctctatgatcaatggcgtggtcaaactgctgacaaagccctgggatgtggttccgatggtgacccaaatggccatgacagacaccacacctttcggccagcagagagtctttaaggaaaaagtggatacccgcacgccccggcctatgcccgggaccagaaaggttatggagatcacagctgagtggctctggcgcaccctgggacggaacaaaaagcctagactttgcacacgcgaagagttcaccaaaaaggtgagaacgaatgccgcgatgggcgccgtctttacagaagagaaccaatgggacagcgctcgggccgctgtggaagatgaggagttctggaagctggtcgacaaagaacgcgagctccacaagctggggaaatgtggatcctgcgtgtataatatgatgggcaagagagagaagaaacttggggagtttggcaaagccaagggatctcgggccatttggtacatgtggctgggcgcgagatacctcgagttcgaagctctggggtttctgaacgaggatcattggttcagccgggaaaattcctattctggagttgagggcgaagggctccacaagctgggatacatccttcgcgacattagcaaaatccccggcggggccatgtatgccgatgacaccgctggctgggacacaagaattaccgaggatgacctgcataacgaggaaaagatcacgcagcagatggatccggagcaccggcagctcgccaatgctatctttaaactgacctaccaaaacaaggtggtcaaagtgcagcgccctacacccaagggaaccgtgatggacattatctccagaaaggatcagcggggcagcgggcaggttggaacatatggccttaataccttcacaaacatggaagcccaactggtgcgccagatggagggggaaggagtcctctctgaggcggacctggagaacccccatctgctcgagaagaagattacccagtggctggagacgaaaggcgtggaaagacttaagcggatggccatctccggggatgactgcgttgtgaaacctattgatgaccgctttgctaatgccctgctcgctctgaacgatatgggcaaggtcagaaaggacatcccgcagtggcaacccagcaaaggatggcatgattggcaacaggtgcctttctgttctcaccatttccacgagcttatcatgaaggacggccggaaactggtcgtgccctgccgccctcaggacgaactcattgggagagcccggatctcccaaggagcgggctggagcctgaaggagacagcctgtctggggaaggcttacgcccagatgtggtctctcatgtattttcaccgcagagatctgcggcttgcttccaatgccatttgcagcgctgttcccgtgcattggatccctacctccagaaccacatggagcattcacgcccatcaccagtggatgaccacagaggacatgctgacggtctggaaccgcgtgtggatcgaagataatccctggatggaggacaagaccccggttacaacctgggaagatgtgccttacctcggaaagcgggaggaccaatggtgtggctctctgattgggcttacaagcagagcgacctgggcccagaacatcctgacggctatccagcaggtccgctccctcattggcgatgaggagttcctggactacatgccctctatgaaacggtttagaaaggaggaagagagcgaaggagccatctggtga

SEQ ID NO: 20471 - RNA, 9873 nt, synthetic construct
  misc_feature 1..9873: note = derived and/or modified CDS sequence (opt5) from DENV-3__GU131913__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaaatctctcctgtttaagaccgccagcggcattaatatgtgtacacttatcgcgatggatctgggggaaatgtgcgacgataccgtgacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccattaatatcgaagctgagcctccgttcggcgaatctaacattgtgatcgggattggcgacaaagccctcaagatcaattggtataagaaaggaagctccatcggcaagatgtttgaggccaccgctagaggggccagacgcatggctattctgggagatacggcctgggacttcggcagcgttgggggagtcctgaactctctcggcaaaatggtgcatcagatctttgggtccgcgtacacagccctgttcagcggcgtgtcttggattatgaagatcggaattggcgtccttctgacctggatcgggctcaatagcaaaaacacctccatgtcttttagctgcattgtgatcggaatcgttacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagacccaaaactccagcttcatcattgacggacctaacacacccgaatgcccgtctgcctccagagcttggaatgtgtgggaggtcgaagactatggctttggcgttttcaccacaaacatctggctgaaacttcgcgaggtgcatacccagagctgtgatcaccggctcatgtccgcggccatcaaagacgaaagagctgtgcacgccgatatggggtactggattgagtctcagaagaatggaagctggaaactggagaaggcctcctttatcgaagtcaagacgtgcacatggcctaaatctcataccctgtggagcaacggcgtgctcgagtccgacatgattatccccaagagcctggctgggcctatttctcagcacaatcatcgccccggataccacacccaaacagccggcccttggcaccttgggaaactggaactcgatttcaactattgcgagggaaccacggttgtgatcgcggagaattgtggcacacggggcccctccctgagaaccacaaccgtcagcgggaagctgatccatgaatggtgctgtcgctcttgcacacttccgcctctccggtacatgggagaggacggctgttggtatgggatggaaattagacccatcaacgagaaagaagagaatatggtgaagtccctggttagcgctggatctggcaaggtggataactttaccatgggggtcctgtgcctcgccattctgttcgaggaagtgatgcggggaaaattcggcaagaaacacatgatcgccggcgttctttttacgttcgtgctgctcctgagcgggcagattacctggcgcgacatggctcatacactgatcatgattggatccaatgccagcgatagaatgggcatgggggtcacctaccttgcgctgatcgctacatttaagatccagcccttcctcgccctgggatttttcctccggaaactgacctctagagagaaccttctgctcggcgtggggctggccatggctacgacactgcaacttcctgaagacattgagcagatggccaatggaatcgctctgggcctcatgaccctgaagctcattacacagtttgaaacctatcagctgtggaccgcccttgtgtccctgacatgtagcaacacgatcttcaccctcacagtcgcgtggcgcaccgccacactgattctggctggcgtttcccttctgccgctctgccaatctagctccatgcggaagaccgattggctgcccatgacggtggccgctatgggggtgcctcccctccctctgtttatcttctctcttaaagacacacccaagagaaaaagctggcctctgaatgagggagtcatggccgtgggcctggtttccatcctcgcctctagcctgcttcgcaacgatgtgcccatggctgggccgctggtcgcgggaggcctcctgattgcctgttacgtgatcaccgggacctccgctgacctcacagttgagaaggccgccgacgtgacctgggaagaggaagctgagcagacaggagtcagccacaacctgatgattacggtggatgacgatggcaccatgagaatcaaagacgatgaaacagagaatattcttaccgtcctgctgaagacagccctcctgatcgtgtctggcatctttccttattccattcccgcgacccttctggtttggcatacgtggcagaaacagacccaacggagcggggtgctctgggacgtcccttctcccccggagacacagaaggctgaactggaggaaggagtgtaccgcatcaagcagcagggcattttcgggaaaacccaagttggagtgggcgtccagaaggagggggtgtttcacacaatgtggcacgtgaccagaggagccgttctcacacataacggcaaacggctggagcctaattgggcctccgtcaagaaagatcttatcagctacggcgggggatggcgcctgtctgctcagtggcaaaagggcgaagaggtccaggtgattgccgtcgaacccgggaagaaccctaaaaatttccagacgatgcccggaatcttccagaccacaaccggcgagattggggcgatcgctctggactttaagcccggaacctccggcagccctatcattaacagagaaggcaaagtggttgggctctatggaaatggcgtggtcacaaagaacgggggatacgtgtccggcatcgcccaaacgaatgccgagccggatgggcccacccctgagctggaagaggaaatgttcaaaaagcggaaccttacaattatggacctgcaccccggcagcggaaagacccgcaaatatctccctgctatcgttagagaggccattaagcggcgcctgagaacactcatcctggctcccacccgggtggtcgccgcggaaatggaggaggcccttaaaggcctgcctatcagataccagacgacagctaccaagtctgaacataccgggcgcgagattgtggatctgatgtgccacgccacatttaccatgcggctcctgagcccggttagagtgcccaattataaccttgtcatcatggacgaagctcatttcacagatcctgcctccattgccgctcgcggatacatctctacccgggtgggcatgggggaggcggccgctatttttatgacggccacaccccctggaaccgccgaggctttcccccagagcaatgccccgatccaggacgaggagagagacatccctgaacgctcctggaactctggcaatgagtggattacagattttgtggggaaaaccgtctggttcgttcccagcatcaaggcgggcaacgacattgctaactgtctgcggaagaatggcaaaaaggtgatccaactctccagaaaaacgtttgataccgaatatcagaagacacgcctgaacgactgggatttcgtggtcaccacagacatttctgagatgggagccaattttaaagccgatcgggtgatcgaccccagacggtgcctgaagcctgttattctcaccgatgggcccgagcgcgtgatccttgctggacctatgccggtcacagccgcgagcgccgctcagagacggggccgcgtggggagaaacccccagaaggaaaatgaccaatacatcttcaccggacagcctctgaacaatgatgaggaccacgcccactggacggaagctaaaatgctgctcgacaacattaatacacccgagggcatcattcctgccctgttcgaacccgagcgggagaagtccgctgccatcgatggggaatacagacttaaaggcgagagccgcaagacctttgttgaactgatgcggagaggagacctcccggtgtggctggcgcataaagtcgcctctgagggcattaagtataccgatcgcaaatggtgcttcgacggggaacggaacaatcagatcctggaggagaacatggatgtggaaatctggacaaaggagggagaaagaaagaaactccgccctcggtggcttgacgctagaacctactccgatcccctggccctgaaggagtttaaagacttcgctgccggccgcaagagcattgccctcgatctggtcacagaaatcgggagagtgccttctcaccttgctcatcggacgcgcaatgcgctggacaacctcgttatgctgcacacctccgagcacggaggcagagcctatcggcatgctgtggaggaactgcccgagacaatggaaaccctccttctgctgggcctcatgattctgcttacagggggagccatgctgtttctcatcagcggcaaagggattggaaagacctccatcggcctgatctgtgtgattgtctctagcgggatgctgtggatggccgatgttcctctccagtggatcgcttccgccattgtgcttgagttctttatgatggtgctgctgatccccgagccggaaaagcaacgcacgcctcaggacaatcagctcgcgtacgtcgtgattggaatcctgacccttgccgctattgttgccgctaacgagatgggcctgctcgaaacaaccaaaagagatctgggcatgagcaaggagcccggggtggtctctcccacatcctatctggacgtggacctccaccctgccagcgcgtggaccctttacgccgtcgctacgacagtgatcaccccgatgctgcggcatacaatcgaaaattctaccgccaacgttagcctggctgccattgctaaccaagccgtggtcctcatgggactggataaaggctggcccatctccaagatggaccttggggtgcctctgctcgcgctgggatgctattctcaggttaatcccctgaccctcacagccgctgtgcttctgctggtcacgcactacgccattatcggccctgggctccaggctaaagccaccagagaggcccagaagcgcacagcggctggaattatgaagaaccccaccgtggatggcatcatgacaatcgacctggatcctgtgatttacgacagcaaattcgagaagcaacttggccaggttatgctgctcgtcctgtgtgccgtgcagctgctccttatgcggacctcctgggctctgtgcgaagccctgacgctcgccacagggccgatcaccaccctgtgggagggatctcccggcaaattttggaatacaaccattgctgtgagcatggccaacatcttcagagggtcctatcttgcgggagccggcctggcttttagcattatgaagtctgtcgggacaggacgccggggcacgggctcccagggggaaaccctcggagagaaatggaagaagaaactgaatcaactgagcagaaaggagttcgatctctacaaaaagtccggcatcacagaggttgaccggaccgaggccaaagaagggcttaagcgcggagagacaacccatcacgctgtgtctagaggcagcgccaaactgcagtggtttgtggaacggaacatggtcatccctgaggggcgcgtgattgatctgggatgtggcagaggcgggtggtcctattactgcgcgggactcaagaaggttacggaagtgcggggctataccaaagggggacccggccacgaggagcctgtccccatgtctacatacgggtggaatatcgtgaagctgatgagcggaaaagacgttttctatcttccgcctgaaaagtgtgataccctgctctgcgacattggcgagtccagcccctctcccacagtggaagagtcccgcaccatcagagtcctgaaaatggtggagccttggctgcggaacaatcagttctgtattaaggtgctcaacccctacatgcctaatgtcatcgaacatcttgagcgcctgcagagaaagtacggcgggatgctggttcggaacccgctcagcagaaattctacacacgaaatgtattggatttccaacggaaccggcaatatcgtgagctctgtgaacatggtcagccgcctgcttctgaaccggtttacgatgacacatagacgccccaccatcgagaaagatgtggacctcggggccggaacccggcacgttaatgctgaacctgagacacccaacatggacgtgattggcgagagaatcaagcgcattaaagaagaacactcctctacgtggcattacgatgacgaaaatccttataagacctgggcctaccacgggagctatgaggtcaaagctacaggatccgccagctccatgatcaacggcgtggttaagctgctgaccaagccctgggatgtggtcccgatggtgacacaaatggctatgaccgacacaacccctttcggccagcagcgggtttttaaagaaaaggtggatacgagaacaccccgccctatgcccgggacacggaaagtcatggagattaccgccgagtggctctggagaacactgggacgcaataagaaacctcggctttgcaccagagaagagttcacgaagaaggtgcgcacaaacgcggccatgggcgctgtctttaccgaagagaatcaatgggactctgccagagctgccgtggaagatgaggagttctggaaactggttgacaaggaacgggagctccataaactggggaagtgtggaagctgcgtgtacaacatgatgggcaaacgcgaaaagaaacttggggagtttggcaaggccaagggatccagagcgatctggtatatgtggctgggcgctcggttcctcgagtttgaagccctggggttcctgaatgaggatcactggttttctagagaaaacagctactccggagtcgagggcgaagggctccataaactgggatacatccttcgggacatttctaagatccccggcggggccatgtatgctgatgacacagccggctgggacacccgcattacggaggatgacctgcacaatgaggagaagatcacccagcagatggatccggagcacagacagctcgctaacgccattttcaagctgacataccaaaataaagtggtgaaggttcagcggcctacccccaagggaacagtgatggacatcatcagccgcaaagatcagagaggctccgggcaggtcggaacctatggccttaacacatttaccaatatggaagcgcaactggtgcggcagatggagggggaaggagttctcagcgaggccgacctggagaacccccatctgctcgaaaagaaaattacgcagtggctggagacaaagggcgtggaacgccttaaaagaatggctatctctggggatgactgcgtcgtgaagcctattgatgaccggttcgccaacgctctgctcgccctgaatgatatgggcaaggtccgcaaagacatcccgcagtggcaaccctccaagggatggcacgattggcaacaggtgcctttctgtagccatcactttcacgagcttattatgaaagacggcagaaagctggttgtgccctgccggcctcaggacgaactcatcgggcgcgcgagaatctctcaaggagccggctggtccctgaaagagaccgcttgtctggggaaggcctacgctcagatgtggagcctcatgtatttccatcggcgcgatctgagacttgcctctaacgctatttgctccgccgtccccgtgcactggatccctaccagccggacaacctggtccattcatgcgcaccatcagtggatgacaacggaggacatgctgaccgtttggaatagagtgtggatcgaagataacccctggatgggagacaagacaccggtcaccacatgggaggatgtgccttacctcggcaaacgcgaagaccaatggtgtgggagcctgattggccttacctctcgggccacgtgggctcagaatatcctgaccgccattcaacaggtgagaagcctcatcggagatgaggagtttctggactatatgccctccatgaagcgcttccggaaagaagaggaatctgagggcgccatctggtga

SEQ ID NO: 20472 - RNA, 9873 nt, synthetic construct
  misc_feature 1..9873: note = derived and/or modified CDS sequence (opt5) from DENV-3__GU131914__SS-prME
  source 1..9873: mol_type = other RNA
accagcctgtgcctcatgatgatgctgcccgccacacttgctttccacctgacgtcccgggacggagaacctcggatgatcgtggggaagaacgaacgcgggaaatctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccattaatatcgaagctgagcctccgttcggcgaatctaacattgtgatcgggattggcgacaaagccctcaagatcaattggtataagaaaggaagctccatcggcaagatgtttgaggccaccgctagaggggccagacgcatggctattctgggagatacggcctgggacttcggcagcgttgggggagtcctgaactctctcggcaaaatggtgcatcagatctttgggtccgcgtacacagccctgttcagcggcgtgtcttggattatgaagatcggaattggcgtccttctgacctggatcgggctcaatagcaaaaacacctccatgtcttttagctgcattgtgatcggaatcattacactgtatctgggcgctgttgtgcaggccgatatggggtgtgtcatcaattggaagggaaaggaacttaaatgcggcaacgggattttcgtgaccaatgaggttcacacatggacggagcagtacaagtttcaagctgactcccccaaacggctcgccaccgcgatcgccggcgcttgggaaaacggagtgtgtggcattagaagcacaacccgcatggagaatctgctgtggaagcagatcgccaacgaactcaattatatcctgtgggagaacaatattaaacttacagtcgtggttggggatatcattggagtgctggaacagggcaagcggaccctcacgcctcagcccatggagctgaaatactcttggaagacctgggggaaggctaaaatcgtcacagccgagacccaaaactccagcttcattatcgacggacctaacacacccgaatgcccgtctgcctccagagcttggaatgtgtgggaggtggaagactatggctttggcgtcttcaccacaaacatctggctgaaacttcgcgaggttcatacccagagctgtgatcaccggctcatgtccgcggccattaaagacgaaagagctgtgcacgccgatatggggtactggatcgagtctcagaagaatggaagctggaaactggagaaggcctcctttattgaagtgaagacgtgcacatggcctaaatctcataccctgtggagcaacggcgtcctcgagtccgacatgatcattcccaagagcctggctgggcctatctctcagcacaatcatcgccccggataccacacccaaacagccggcccttggcaccttgggaaactggaactcgatttcaactattgcgagggaaccacggtggttatcgcggagaattgtggcacacggggcccctccctgagaaccacaaccgtgagcgggaagctgattcatgaatggtgctgtcgctcttgcacacttccgcctctccggtacatgggagaggacggctgttggtatgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacacatgattgccggcgtgctttttacgttcgttctgctcctgagcgggcagatcacctggcgcgacatggctcatacactgattatgatcggatccaatgccagcgatagaatgggcatgggggtgacctaccttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctatcagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagaaaaagctggcctctgaatgagggagtgatggccgtcggcctggtgtccattctcgcctctagcctgcttcgcaacgatgttcccatggctgggccgctggtggcgggaggcctcctgatcgcctgttacgtcattaccgggacctccgctgacctcacagtggagaaggccgccgacgttacctgggaagaggaagctgagcagacaggagtgagccacaacctgatgatcacggtcgatgacgatggcaccatgagaattaaagacgatgaaacagagaatatccttaccgtgctgctgaagacagccctcctgatcgtctctggcatttttccttattccatccccgcgacccttctggtgtggcatacgtggcagaaacagacccaacggagcggggttctctgggacgtgccttctcccccggagacacagaaggctgaactggaggaaggagtctaccgcattaagcagcagggcatcttcgggaaaacccaagtgggagttggcgtgcagaaggagggggtctttcacacaatgtggcacgtgaccagaggagccgtgctcacacataacggcaaacggctggagcctaattgggcctccgttaagaaagatcttattagctacggcgggggatggcgcctgtctgctcagtggcaaaagggcgaagaggtccaggtgatcgccgtggaacccgggaagaaccctaaaaatttccagacgatgcccggaattttccagaccacaaccggcgagatcggggcgatcgctctggactttaagcccggaacctccggcagccctattatcaacagagaaggcaaagtcgtggggctctatggaaatggcgttgtgacaaagaacgggggatacgtctccggcattgcccaaacgaatgccgagccggatgggcccacccctgagctggaagaggaaatgttcaaaaagcggaaccttacaatcatggacctgcaccccggcagcggaaagacccgcaaatatctccctgctattgtgagagaggccatcaagcggcgcctgagaacactcatcctggctcccacccgggttgtggccgcggaaatggaggaggcccttaaaggcctgcctattagataccagacgacagctaccaagtctgaacataccgggcgcgagatcgtcgatctgatgtgccacgccacatttaccatgcggctcctgagcccggtgagagttcccaattataaccttgtgattatggacgaagctcatttcacagatcctgcctccatcgccgctcgcggatacatttctacccgggtcggcatgggggaggcggccgctatctttatgacggccacaccccctggaaccgccgaggctttcccccagagcaatgccccgatccaggacgaggagagagacattcctgaacgctcctggaactctggcaatgagtggatcacagattttgtggggaaaaccgtgtggttcgtccccagcattaaggcgggcaacgacatcgctaactgtctgcggaagaatggcaaaaaggttattcaactctccagaaaaacgtttgataccgaatatcagaagacacgcctgaacgactgggatttcgtggtgaccacagacatctctgagatgggagccaattttaaagccgatcgggtcattgaccccagacggtgcctgaagcctgtgatcctcaccgatgggcccgagcgcgttatccttgctggacctatgccggtgacagccgcgagcgccgctcagagacggggccgcgtcgggagaaacccccagaaggaaaatgaccaatacattttcaccggacagcctctgaacaatgatgaggaccacgcccactggacggaagctaaaatgctgctcgacaacatcaatacacccgagggcattatccctgccctgttcgaacccgagcgggagaagtccgctgccattgatggggaatacagacttaaaggcgagagccgcaagacctttgtggaactgatgcggagaggagacctcccggtttggctggcgcataaagtggcctctgagggcatcaagtataccgatcgcaaatggtgcttcgacggggaacggaacaatcagatcctggaggagaacatggatgtcgaaatttggacaaaggagggagaaagaaagaaactccgccctcggtggcttgacgctagaacctactccgatcccctggccctgaaggagtttaaagacttcgctgccggccgcaagagcatcgccctcgatctggtgacagaaattgggagagtcccttctcaccttgctcatcggacgcgcaatgcgctggacaacctcgtgatgctgcacacctccgagcacggaggcagagcctatcggcatgctgttgaggaactgcccgagacaatggaaaccctccttctgctgggcctcatgatcctgcttacagggggagccatgctgtttctcattagcggcaaagggatcggaaagacctccatcggcctgatttgtgtgatcgtgtctagcgggatgctgtggatggccgatgtccctctccagtggattgcttccgccatcgttcttgagttctttatgatggtgctgctgattcccgagccggaaaagcaacgcacgcctcaggacaatcagctcgcgtacgtggtcatcggcattctgacccttgccgctatcgtggccgctaacgagatgggcctgctcgaaacaaccaaaagagatctgggcatgagcaaggagcccggggttgtgtctcccacatcctatctggacgtcgacctccaccctgccagcgcgtggaccctttacgccgtggctacgacagtcatcaccccgatgctgcggcatacaattgaaaattctaccgccaacgtgagcctggctgccatcgctaaccaagccgttgtgctcatgggactggataaaggctggcccatttccaagatggaccttggggtccctctgctcgcgctgggatgctattctcaggtgaatcccctgaccctcacagccgctgttcttctgctggtgacgcactacgccatcattggccctgggctccaggctaaagccaccagagaggcccagaagcgcacagcggctggaatcatgaagaaccccaccgtcgatggcatcatgacaattgacctggatcctgtgatctacgacagcaaattcgagaagcaacttggccaggtgatgctgctcgttctgtgtgccgtccagctgctccttatgcggacctcctgggctctgtgcgaagccctgacgctcgccacagggccgattaccaccctgtgggagggatctcccggcaaattttggaatacaaccatcgctgtgagcatggccaacattttcagagggtcctatcttgcgggagccggcctggcttttagcatcatgaagtctgtggggacaggacgccggggcacgggctcccagggggaaaccctcggagagaaatggaagaagaaactgaatcaactgagcagaaaggagttcgatctctacaaaaagtccggcatcacagaggtcgaccggaccgaggccaaagaagggcttaagcgcggagagacaacccatcacgctgtttctagaggcagcgccaaactgcagtggtttgtggaacggaacatggtgattcctgaggggcgcgtcatcgatctgggatgtggcagaggcgggtggtcctattactgcgcgggactcaagaaggtgacggaagttcggggctataccaaagggggacccggccacgaggagcctgtgcccatgtctacatacgggtggaatattgtcaagctgatgagcggaaaagacgtgttctatcttccgcctgaaaagtgtgataccctgctctgcgacatcggcgagtccagcccctctcccacagttgaagagtcccgcaccattagagtgctgaaaatggtcgagccttggctgcggaacaatcagttctgtatcaaggtgctcaacccctacatgcctaatgtgattgaacatcttgagcgcctgcagagaaagtacggcgggatgctggtccggaacccgctcagcagaaattctacacacgaaatgtattggatctccaacggaaccggcaatatcgttagctctgtgaacatggtgagccgcctgcttctgaaccggtttacgatgacacatagacgccccaccattgagaaagatgtcgacctcggggccggaacccggcacgtgaatgctgaacctgagacacccaacatggacgttatcggcgagagaattaagcgcatcaaagaagaacactcctctacgtggcattacgatgacgaaaatccttataagacctgggcctaccacgggagctatgaggtgaaagctacaggatccgccagctccatgattaacggcgtcgtgaagctgctgaccaagccctgggatgttgtgccgatggtcacacaaatggctatgaccgacacaacccctttcggccagcagcgggtgtttaaagaaaaggttgatacgagaacaccccgccctatgcccgggacacggaaagtgatggagatcaccgccgagtggctctggagaacactgggacgcaataagaaacctcggctttgcaccagagaagagttcacgaagaaggtccgcacaaacgcggccatgggcgctgtgtttaccgaagagaatcaatgggactctgccagagctgccgtcgaagatgaggagttctggaaactggtggacaaggaacgggagctccataaactggggaagtgtggaagctgcgtttacaacatgatgggcaaacgcgaaaagaaacttggggagtttggcaaggccaagggatccagagcgatctggtatatgtggctgggcgctcggttcctcgagtttgaagccctggggttcctgaatgaggatcactggttttctagagaaaacagctactccggagtggagggcgaagggctccataaactgggatacattcttcgggacatctctaagattcccggcggggccatgtatgctgatgacacagccggctgggacacccgcatcacggaggatgacctgcacaatgaggagaagattacccagcagatggatccggagcacagacagctcgctaacgccatcttcaagctgacataccaaaataaagtcgtgaaggtgcagcggcctacccccaagggaacagttatggacatcattagccgcaaagatcagagaggctccggacaggtgggaacctatggccttaacacatttaccaatatggaagcgcaactggtccggcagatggagggggaaggagtgctcagcgaggccgacctggagaacccccatctgctcgaaaagaaaatcacgcagtggctggagacaaagggcgttgaacgccttaaaagaatggctatttctggggatgactgcgtggtcaagcctatcgatgaccggttcgccaacgctctgctcgccctgaatgatatgggcaaggtgcgcaaagacattccgcagtggcaaccctccaagggatggcacgattggcagcaggtccctttctgtagccatcactttcacgagcttatcatgaaagacggcagaaagctggtggttccctgccggcctcaggacgaactcatcgggcgcgcgagaatttctcaaggagccggctggtccctgaaagagaccgcttgtctggggaaggcctacgctcagatgtggagcctcatgtatttccatcggcgcgatctgagacttgcctctaacgctatctgctccgccgtgcccgtccactggattcctaccagccggacaacctggtccatccatgcgcaccatcagtggatgacaacggaggacatgctgaccgtgtggaatagagtttggattgaagataacccctggatgggagacaagacaccggtgaccacatgggaggatgtcccttacctcggcaaacgcgaagaccaatggtgtgggagcctgatcggccttacctctcgggccacgtgggctcagaatattctgaccgccatccaacaggtgagaagcctcatcggagatgaggagtttctggactatatgccctccatgaagcgcttccggaaagaagaggaatctgagggcgccatttggtga

SEQ ID NO: 20473 - RNA, 9873 nt, synthetic construct
  misc_feature 1..9873: note = derived and/or modified CDS sequence (opt5) from DENV-3__GU131915__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaaatgtccgctcattgctgaagccgagcccgaagacatcgattgctggtgtaacctgacctccacatgggttacctatggaacgtgcaatcaggccggcgagcatagacgggacaagcgctctgtggctctggcccctcacgtggggatgggactcgataccagaacacagacctggatgagcgctgagggcgcctggcggcaggtcgaaaaagtggagacatgggcgctgcgccatcccggcttcaccattcttgccctgtttctcgctcactacatcgggacgtccctgacacagaaggttgtgatcttcattcttctgatgctcgtcaccccttctatgacaatgagatgtgtgggagttggcaaccgggactttgtggaagggctgagcggagccacctgggtcgatgtggtgctggagcatggcgggtgcgtcaccacaatggctaagtccaaacccacgctcgacatcgagctgcagaagaccgaagccacacaacttgcgaccctgcgcaaactctgtattgagggaaagatcacaaatattaccacggatagcagatgccctacacagggcgaagccaccctgccggaggaacaggaccagaactatgtttgtaaacacacctacgtggatcggggctgggggaatggatgcggccttttcgggaagggatctctggtgacatgcgctaagtttcaatgtctcgagcccatcgagggcaaagtcgtgcagcacgaaaacctgaagtataccgttattatcacagtgcatacgggggaccagcaccaggtcggaaatgacacccaaggcgtgacagttgagatcacccctcaggcctccacagtggaagctgtcctgcccgagtacggcaccctcgggctggaatgcagccctcgcacgggacttgatttcaacgagatgattctgctcaccatgaaaaataaggcctggatggtgcatagacagtggtttttcgacctgccccttccgtggacatctggcgccaccacagagacccctacgtggaaccggaaagaactgctcgtcacatttaagaatgctcacgcgaaaaagcaagaggtggttgtgctggggtcccaggaaggagccatgcacaccgctctgacaggcgccaccgagatccagaacagcgggggcacctctattttcgccggacatctcaagtgtcgcctgaaaatggataaacttgaactgaaaggcatgtcctatgctatgtgcctcaatacatttgtcctgaagaaagaggtgagcgagacgcagcacgggaccatcctgattaaggttgaatacaagggagaggacgccccctgtaaaatccctttctccacagaagatggccaagggaaggcgcattctggaagacttatcaccgctaaccccgtggtcaccaagaaggaggagcccgtgaacattgaagccgagcctccgttcggcgaaagcaatatcgtgattgggatcggcgacaaagccctcaagattaactggtacaagaaaggatccagcatcggcaagatgtttgaggctaccgccagaggggctagacgcatggccatcctgggagatacggcgtgggacttcggctctgttgggggagtcctgaatagcctcggcaaaatggtgcaccagatttttgggagcgcctatacagctctgttctctggcgtgagctggatcatgaagattggaatcggcgtccttctgacctggattgggctcaactccaaaaatacctctatgagcttttcctgcatcgtgattggaatcatcacactgtacctgggcgccgttgtgcaggctgatatggggtgtgtcattaactggaagggaaaggaacttaaatgcggcagcgggatcttcgtgaccaatgaggttcatacatggacggagcagtataagtttcaagccgactctcccaaacggctcgcgaccgccattgctggcgcctgggaaaacggagtgtgtggcatcagatccacaacccgcatggagaatctgctgtggaagcagattgctaacgaactcaattacatcctgtgggagaacaatatcaaacttacagtcgtggttggggatattatcggagtgctggaacagggcaagcggaccctcacgcctcagcccatggagctgaaatatagctggaagacctgggggaaggccaaaattgtcacagccgagacccaaaactcttccttcatcattgacggacctaatacacccgaatgcccgagcgcttccagagcgtggaacgtgtgggaggtggaagactacggctttggcgtcttcaccacaaacatctggctgaaacttcgcgaggtttatacccagtcttgtgatcaccggctcatgagcgccgctatcaaagacgaaagagccgtgcacgccgatatggggtactggattgagtcccagaagaatggatcttggaaactggagaaggctagctttatcgaagtgaagacgtgcacatggcctaaatcccataccctgtggagcaacggcgtcctcgagtctgacatgattatccccaagtccctggccgggcctattagccagcacaatcatcgccccggataccacacccaaacagcgggcccttggcaccttgggaaactggaactcgatttcaactattgcgagggaaccacggtggttatcacagagaattgtggcacccggggcccctctctgagaacaaccacagtgtccgggaagctgatccatgaatggtgctgtcgcagctgcacccttccgcctctccggtacatgggagaggacggctgttggtatgggatggaaattagacccatcaacgagaaagaagagaatatggtcaagtctctggtgagcgctggatccggcaaggttgataactttacgatgggggtgctgtgcctcgccattctgttcgaggaagtcatgcggggaaaattcggcaagaaacacatgatcgccggcgtgctttttaccttcgttctgctcctgagcgggcagattacatggcgcgacatggctcataccctgatcatgattggatctaatgcctccgatagaatgggcatgggggtgacataccttgcgctgatcgctacctttaagatccagcccttcctcgccctgggatttttcctccggaaactgacgagcagagagaaccttctgctcggcgtcgggctggccatggctacaaccctgcaacttcctgaagacattgagcagatggccaatggaatcgctctgggcctcatgacactgaagctcattacccagtttgaaacctatcagctgtggacagcccttgtgtccctgacgtgttctaacaccatcttcacactcaccgtggcgtggcgcacagccaccctgattctggctggcgtcagccttctgccgctctgccaatcctctagcatgcggaagacggattggctgcccatgacagttgccgctatgggggtgcctcccctccctctgtttatcttctcccttaaagacacccccaagagacgctcttggcctctgaatgagggagtgatggccgtcggcctggtgagcatcctcgcctccagcctgcttagaaacgatgttcccatggctgggccgctggtggcgggaggcctcctgattgcctgttacgtcatcaccgggacatctgctgacctcaccgtggagaaagccgccgacgttacatgggaagaggaagctgagcagacgggagtgtcccacaatctgatgattaccgtcgatgacgatggcacaatgcggatcaaggacgatgaaaccgagaacattcttacagtgctgctgaaaaccgccctcctgatcgtcagcggcatctttccttattctattcccgcgacgcttctggtgtggcatacctggcagaagcagacacaacgctccggggttctctgggacgtgccttctcccccggagacccagaaagctgaactggaggaaggagtctacagaatcaagcagcagggcattttcgggaagacacaagtgggagttggcgtgcagaaagagggggtctttcacaccatgtggcacgtgacacggggagccgtgctcacgcataacggcaagcgcctggagcctaattgggcctccgttaaaaaggatcttatctcctacggcgggggatggagactgaacgctcagtggcaaaaaggcgaagaggtccaggtgattgccgtggaacccgggaagaatcctaagaacttccagaccatgcccggaatcttccagacaaccaccggcgagattggggcgatcgctctggactttaaacccggaacaagcggctcccctatcattaatcgggaaggcaaggtcgtggggctctatggaaacggcgttgtgacgaaaaatgggggatacgtcagcggcatcgcccaaaccaacgccgagccggatgggcccacacctgagctggaagaggaaatgttcaagaaacgcaatcttaccattatggacctgcaccccggctctggaaagacaagaaagtatctccctgctatcgtgcgggaggccattaaacgcagactgcggaccctcatcctggctcccacgagagttgtggccgcggaaatggaggaggcccttaagggcctgcctatccgctaccagacaaccgctaccaaaagcgaacatacagggcgggagattgtcgatctgatgtgccacgccacctttacaatgagactcctgtccccggtgcgcgttcccaactataatcttgtgatcatggacgaagctcatttcaccgatcctgcctctattgccgctcggggatacatcagcacgagagtcggcatgggggaggcggccgctatttttatgacagccacaccccctggaacagccgaggctttcccccagtccaacgccccgatccaggacgaggagcgcgacatccctgaacggtcttggaatagcggcaacgagtggattaccgattttgtggggaagacggtgtggttcgtcccctccatcaaagcgggcaatgacattgctaactgtctgagaaagaacggaaagaaagttatccaactctctcgcaagacctttgatacagaatatcagaaaacccggctgaatgactgggatttcgtggtgacaaccgacattagcgagatgggcgccaactttaaggccgatagagtcatcgacccccggcgctgcctgaaacctgtgattctcacagatgggcccgagagagttatccttgctggacctatgccggtgaccgccgcgtccgccgctcagcggcgcggcagagtcgggcggaatccccagaaggaaaacgaccaatacatcttcacgggacagcctctgaataacgatgaggaccacgcccactggacagaagctaagatgctgctcgacaatattaacacccccgagggcatcattcctgccctgttcgaacccgagagagagaaaagcgctgccatcgatggggaataccgccttaagggcgagtctcggaaaacctttgtggaactgatgagacgcggagacctcccggtttggctggcgcataaggtggcctccgagggcattaaatatacagatcggaagtggtgcttcgacggggaaagaaataaccagatcctggaggagaatatggatgtcgaaatctggaccaaagagggagaacgcaagaagctccggcctagatggcttgacgctcgcacatacagcgatcccctggccctgaaagagtttaaggacttcgctgccggcagaaaatctattgccctcgatctggtgacggaaatcgggcgggtcccttcccaccttgctcatcgcaccagaaacgcgctggacaatctcgtgatgctgcacacaagcgagcacggaggccgggcctatcgccatgctgttgaggaactgcccgagaccatggaaacactccttctgctgggcctcatgattctgcttaccgggggagccatgctgtttctcatctccggcaaggggattggaaaaacgtctatcggcctgatctgtgtgattgtgagctccgggatgctgtggatggccgatgtccctctccagtggatcgctagcgccattgttcttgagttctttatgatggtgctgctgatccccgagccggaaaagcaaagaacccctcaggacaaccagctcgcgtacgtggtcattggaatcctgacacttgccgctattgtggccgctaatgagatgggcctgctcgaaaccacaaagcgggatctgggcatgtctaaagagcccggggttgtgtcccccaccagctatctggacgtcgacctccaccctgcctctgcgtggacgctttacgccgtggctacaaccgtcatcacaccgatgctgagacataccatcgaaaacagcaccgccaatgtgtccctggctgccattgctaaccaagccgttgtgctcatgggactggataagggctggcccatctctaaaatggaccttggggtccctctgctcgcgctgggatgctatagccaggtgaaccccctgacactcacggccgctgttcttctgctggtgacccactacgccattatcggccctgggctccaggctaaggccacacgcgaggcccagaaacggaccgcggctggaattatgaagaatcccacagtcgatggcatcatgaccatcgacctggatcctgtgatttacgactccaagttcgagaaacaacttggccaggtgatgctgctcgttctgtgtgccgtccagctgctccttatgagaacgtcttgggctctgtgcgaagccctgacactcgccaccgggccgatcaccacactgtgggagggaagccccggcaagttttggaacaccacaattgctgtgtccatggccaatatcttccgcgggagctatcttgcgggagccggcctggctttttctattatgaaatccgtggggacgggacggagaggcaccggcagccagggggaaacactcggagagaagtggaaaaagaagctgaaccaactgtcccggaaagagttcgatctctacaagaaatctggcatcaccgaggtcgaccgcacagaggccaaggaagggcttaaaagaggagagaccacgcatcacgctgttagccggggctccgccaagctgcagtggtttgtggaacgcaatatggtgatccctgaggggagagtcattgatctgggatgtggccggggcgggtggtcttattactgcgcgggactcaaaaaggtgaccgaagttcgcggctatacaaaaggcgggcccgggcacgaggagcctgtgcccatgagcacctacgggtggaacatcgtcaaactgatgtccggaaaggacgtgttctatcttccgcctgaaaaatgtgatacactgctctgcgacattggcgagagctctccctcccccaccgttgaagagagcagaacaatccgggtgctgaagatggtcgagccttggctgcgcaataaccagttctgtattaaagtgctcaatccctacatgcctaccgtgatcgaacatcttgagagactgcagcggaagtacggcgggatgctggtcagaaacccgctctctcgcaattccacgcacgaaatgtattggattagcaacggaacaggcaatatcgtttctagcgtgaacatggtgtcccggctgcttctgaatagatttaccatgacccatcgccggcccacaatcgagaaggatgtcgacctcggggccggaacgagacacgtgaacgctgaacctgagacccccaacatggacgttattggcgagcgcatcaaacggattaaggaagaacactctagcacatggcattacgatgacgaaaatccttataaaacctgggcctaccacgggtcctatgaggtgaaggctacaggaagcgcctcctctatgatcaacggcgtcgtgaaactgctgaccaagccctgggatgttgtgccgatggtcacacaaatggctatgaccgacacgacccctttcggccagcagagagtgtttaaggaaaaagttgatacacgcacaccccggcctatgcccgggacaagaaaggtgatggagattaccgccgagtggctctggcgcacgctgggacggaataaaaagcctagactttgcacacgcgaagagttcaccaaaaaggtcagaacaaacgcggccatgggcgctgtgtttaccgaagagaatcaatgggacagcgcccgggctgccgtcgaagatgaggagttctggaagctggtggaccgcgaaagagagctccataaactggggaagtgtggatcctgcgtttacaacatgatgggcaaacgggaaaagaaacttggggagtttggcaaggccaaaggatctagagcgatctggtatatgtggctgggcgctcggtacctcgagttcgaagccctggggtttctgaatgaggatcactggttcagccgcgaaaactcctactctggagtggagggcgaagggctccataagctgggatatatccttagagacattagcaagatccccggcggggccatgtacgctgatgacacggccggctgggacacccggattacagaggatgacctgcacaatgaggagaagatcacccagcagatggatccggagcaccgccagctcgctaacgccatttttaagctgacatatcaaaataaagtcgtgaaggtgcagagacctacccccaaaggaacagttatggacatcatctcccggaaggatcagcgcggcagcggacaggtgggaacctacggccttaacacgttcacaaatatggaagcgcaactggtcagacagatggagggggaaggagtgctctctaaggccgacctggagaacccccatctgctcgagaaaaagattacccagtggctggaaaccaaaggcgttgagcggcttaagcgcatggctatctccggggatgactgcgtggtcaaacctattgatgacagatttgccaatgctctgctcgccctgaacgatatgggcaaggtgcggaaggacatcccgcagtggcaacccagcaaaggatggcacgattggcagcaggtccctttctgttctcatcacttccacgaacttattatgaaggacggccgcaaactggtggttccctgcagacctcaggacgagctcatcgggcgggcgcgcatctcccaaggagccggctggagcctgaaggaaacagcttgtctggggaaagcctatgctcagatgtggtctctcatgtactttcatagacgggatctgagacttgcctccaacgctatttgcagcgccgtgcccgtccactggatccctacctcccgcacaacgtggagcattcatgcgcaccatcagtggatgaccacagaggacatgctgaccgtgtggaatcgggtttggatcgaggataacccctggatggaagacaagacaccggtgaccacgtgggaggatgtcccttatctcggaaagagagaagaccaatggtgtggctctctgattgggcttaccagccgcgccacatgggctcagaatatcctgaccgccattcaacaggtgcggtccctcatcggcgatgaggagttcctggactacatgccctctatgaaaagatttcgcaaggaagaggaaagcgagggagccatctggtga

SEQ ID NO: 20474 - RNA, 9873 nt, synthetic construct
  misc_feature 1..9873: note = derived and/or modified CDS sequence (opt5) from DENV-3__GU131916__SS-prME
  source 1..9873: mol_type = other RNA
acctccctgtgcctcatgatgatgctgcccgccacccttgctttccacctgacgtcccgggacggcgaacctcggatgatcgtggggaagaacgaacgcggaaaatctctcctgtttaagaccgccagcggcattaatatgtgtacccttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaagaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccagcagagcttggaacgtgtgggaggtcgaagactatggctttggcgttttcaccacaaatatctggctgaaacttcgcgaggtgtacacccagtcctgtgatcatcggctcatgtctgcggccatcaaagacgaaagagctgtgcacgccgatatggggtactggattgagagccagaagaacggatcctggaaactggagaaggcctcttttatcgaagtcaagacgtgcacatggcctaaaagccacaccctgtggtccaatggcgtgctcgagagcgacatgattatccccaagtctctggctgggcctatttcccagcataaccaccgccccggatatcatacccaaacagccggcccttggcaccttgggaaactggaactcgatttcaattactgcgagggaaccacggttgtgatcacagagaactgtggcacccggggccccagcctgagaacaaccacagtctctgggaagctgatccacgaatggtgctgtcgctcctgcacccttccgcctctccggtatatgggagaggacggctgttggtacgggatggaaattagacccatcaatgagaaagaagagaacatggttaagagcctggtgtctgcgggaagcggcaaggtggataattttacgatgggggtcctgtgcctcgctattctgttcgaggaagtgatgcggggaaaattcggcaagaaacatatgatcgccggcgttctttttaccttcgtgctgctcctgtccgggcagattacatggcgcgacatggcccacaccctgatcatgattggaagcaacgcttctgatagaatgggcatgggggtcacatatcttgccctgatcgcgacctttaagatccagcccttcctcgctctgggatttttcctccggaaactgacgtccagagagaatcttctgctcggcgtggggctggccatggccacaaccctgcaacttcctgaagacattgagcagatggctaacggaatcgccctgggcctcatgacactgaagctcattacccagtttgaaacctaccagctgtggacagctcttgtgagcctgacgtgttccaataccatcttcacactcaccgtcgcctggcgcacagcgaccctgattctggccggcgtttctcttctgccgctctgccaaagctcctctatgcggaagacggattggctgcccatgacagtggctgccatgggggtgcctcccctccctctgtttatcttcagccttaaagacacccccaagagacgctcctggcctctgaacgagggagtcatggctgtgggcctggtttctatcctcgccagctccctgcttagaaatgatgtgcccatggccgggccgctggtcgctggaggcctcctgattgcgtgttatgtgatcaccgggacaagcgccgacctcaccgttgagaaagctgccgacgtgacatgggaagaggaagccgagcagacgggagtctctcataacctgatgattaccgtggatgacgatggcacaatgcggatcaaggacgatgaaaccgagaacattcttacagtcctgctgaaaaccgctctcctgatcgtgtccggcatctttccttacagcattcccgccacgcttctggtttggcacacctggcagaagcagacacaacgctctggggtgctctgggacgtcccttctcccccggagacccagaaagcggaactggaggaaggagtgtacagaatcaagcagcagggcattttcgggaagacacaagttggagtgggcgtccagaaagagggggtgtttcataccatgtggcacgtgacacggggagctgttctcacgcacaatggcaagcgcctggagcctaactgggccagcgtcaaaaaggatcttatcagctatggcgggggatggagactgtccgcccagtggcaaaaaggcgaagaggtccaggtgattgctgtcgaacccgggaagaatcctaagaacttccagaccatgcccggaatcttccagacaaccaccggcgagattggggccatcgcgctggactttaaacccggaacaagcggctcccctatcattaatcgggaaggcaaggtggttgggctctacggaaacggcgtgatcacgaaaaatgggggatatgtcagcggcattgctcaaaccaacgccgagccggatgggcccacacctgagctggaagaggaaatgttcaagaaacgcaatcttaccatcatggacctgcatcccggctctggaaagacaagaaagtacctccctgccattgtgcgggaggctatcaaacgcagactgcggaccctcatcctggcccccacgagagttgtggctgccgaaatggaggaggcgcttaagggcctgcctattcgctatcagacaaccgccaccaaaagcgaacacacagggcgggagatcgtcgatctgatgtgccatgctacctttacaatgagactcctgtccccggtgcgcgttcccaactacaatcttgtgattatggacgaagcccacttcaccgatcctgcttctatcgccgcccggggatatattagcacgagagtcggcatgggggaggctgcggccatctttatgacagctacaccccctggaacagccgaagccttcccccagtccaacgctccgatccaggacgaggagcgcgacattcctgaacggtcttggaatagcggcaacgagtggatcaccgattttgtggggaagacggtgtggttcgtcccctccattaaagccggcaatgacatcgcgaactgtctgagaaagaacggaaagaaagttattcaactctctcgcaagacctttgatacagaataccagaaaacccggctgaatgactgggatttcgtggtgacaaccgacatcagcgagatgggcgctaactttaaggccgatagagtcattgacccccggcgctgcctgaaacctgtgatcctcacagatgggcccgagagagttatccttgccggacctatgccggtgaccgctgcctccgcggcccagcggcgcggcagagtcgggcggaatccccagaaggaaaacgaccaatacattttcacgggacagcctctgaataacgatgaggaccatgctcactggacagaagccaagatgctgctcgacaatatcaacacccccgagggcattatccctgctctgttcgaacccgagagagagaaaagcgccgctattgatggggaatatcgccttaagggcgagtctcggaaaacctttgtggaactgatgagacgcggagacctcccggtttggctggcccacaaggtggcgtccgagggcatcaaatacacagatcggaagtggtgcttcgacggggaaagaaataaccagatcctggaggagaatatggatgtcgaaatttggaccaaagagggagaacgcaagaagctccggcctagatggcttgacgcccgcacatatagcgatcccctggctctgaaagagtttaaggacttcgccgctggcagaaaatctatcgccctcgatctggtgacggaaattgggcgggtcccttcccatcttgcccaccgcaccagaaacgctctggacaatctcgtgatgctgcatacaagcgagcacggaggccgggcgtaccgccacgccgttgaggaactgcccgagaccatggaaacactccttctgctgggcctcatgatcctgcttacctccggggctatgctgtttctcatttctggaaagggcatcgggaaaacgagcatcggactgatttgtgtgatcgtgtccagcggcatgctgtggatggccgatgtccctctccagtggattgcctctgctatcgttcttgagttctttatgatggtgctgctgattcccgagccggaaaagcaaagaacccctcaggacaaccagctcgcctatgtggtcatcgggattctgacacttgcggccatcgtggctgccaatgagatgggactgctcgaaaccacaaagcgggatctgggcatgtccaaagagcccggcgttgtgagccccacctcttacctggacgtcgacctccatcctgctagcgcctggacgctttatgcggtggccacaaccgtcatcacaccgatgctgagacacaccattgaaaactccaccgctaatgtgtctctggccgctatcgccaaccaagctgttgtgctcatggggctggataagggatggcccattagcaaaatggaccttggcgtccctctgctcgccctggggtgctactcccaggtgaaccccctgacactcacggcggccgttcttctgctggtgacccattacgctatcattggacctggcctccaggccaaggctacacgcgaggcccagaaacggaccgccgcggggatcatgaagaatcccacagtcgatggaatcatgaccattgacctggatcctgtgatctatgactctaagttcgagaaacaacttggccaggtgatgctgctcgttctgtgtgctgtccagctgctccttatgagaacgagctgggccctgtgcgaagctctgacactcgccaccggcccgattaccacactgtgggaggggtcccccggaaagttttggaacaccacaatcgccgtgagcatggctaatattttccgcggctcttaccttgccggggcgggactggccttttccatcatgaaaagcgtgggcacggggcggagaggaaccggctcccagggcgaaacactcggggagaagtggaaaaagaagctgaaccaactgtctcggaaagagttcgatctctataagaaaagcggaatcaccgaggtcgaccgcacagaggctaaggaaggccttaaaagaggggagaccacgcaccatgccgtttcccggggatctgctaagctgcagtggtttgtggaacgcaatatggtgattcctgagggcagagtcatcgatctggggtgtggacggggcggctggagctactattgcgccgggctcaaaaaggtgaccgaagttcgcggatacacaaagggcgggcccggacacgaggagcctgtgcccatgtccacctatggctggaacattgtcaaactgatgagcgggaaggacgtgttctaccttccgcctgaaaaatgtgatacactgctctgcgacatcggagagtcttcccccagccccaccgttgaagagtctagaacaattcgggtgctgaagatggtcgagccttggctgcgcaataaccagttctgtatcaaagtgctcaatccctacatgcctaccgtgattgaacaccttgagagactgcagcggaagtatggcggcatgctggtcagaaacccgctctcccgcaatagcacgcatgaaatgtactggatctctaacgggacaggaaatatcgttagctccgtgaacatggtgtctcggctgcttctgaatagatttaccatgacccaccgccggcccacaattgagaaggatgtcgacctcggcgcggggacgagacatgtgaacgccgaacctgagacccccaacatggacgttatcggagagcgcattaaacggatcaaggaagaacacagctccacatggcactatgatgacgaaaatccttacaaaacctgggcttatcatggcagctacgaggtgaaggccacagggtccgcttctagcatgattaacggagtcgtgaaactgctgaccaagccctgggatgttgtgccgatggtcacacaaatggccatgaccgacacgacccctttcggccagcagagagtgtttaaggaaaaagttgatacacgcacaccccggcctatgcccggcacaagaaaggtgatggagatcaccgctgagtggctctggcgcacgctggggcggaataaaaagcctagactttgcacacgcgaagagttcaccaaaaaggtcagaacaaacgccgcgatgggagccgtgtttaccgaagagaatcaatgggactccgctcgggccgctgtcgaagatgaggagttctggaagctggtggaccgcgaaagagagctccacaaactgggcaagtgtgggtcttgcgtttataacatgatgggaaaacgggaaaagaaacttggcgagtttgggaaggccaaaggcagcagagccatctggtacatgtggctgggagcgcggtacctcgagttcgaagctctgggctttctgaatgaggatcattggttctcccgcgaaaactcttatagcggggtggagggagaaggcctccacaagctggggtacattcttagagacatctccaagattcccggaggcgccatgtatgccgatgacacggctgggtgggacacccggatcacagaggatgacctgcataatgaggagaagattacccagcagatggatccggagcaccgccagctcgccaacgctatctttaagctgacataccaaaataaagtcgtgaaggtgcagagacctacccccaaaggcacagttatggacatcattagccggaaggatcagcgcggatctggccaggtggggacctatggacttaacacgttcacaaatatggaagcccaactggtcagacagatggagggcgaagacgtgctctccaaggcggatctggagaacccccatctgctcgagaaaaagatcacccagtggctggaaaccaaaggggttgagcggcttaagcgcatggccattagcggagacgattgcgtggtcaaacctatcgacgatagatttgctaatgccctgctcgctctgaacgacatgggcaaggtgcggaaggatattccgcagtggcaaccctctaaagggtggcatgactggcagcaggtccctttctgttcccaccatttccacgaacttatcatgaaggacggccgcaaactggtggttccctgcagacctcaggatgagctcatcggacgggcccgcattagccaaggcgcggggtggtctctgaaggaaacagcctgtctgggaaaggcttacgcccagatgtggtccctcatgtattttcacagacgggacctgagacttgctagcaacgccatctgctccgctgtgcccgtccattggattcctaccagccgcacaacgtggtctatccacgcccatcaccagtggatgaccacagaggatatgctgaccgtgtggaatcgggtttggattgaggacaacccctggatggaagataagacaccggtgaccacgtgggaggacgtcccttacctcggcaagagagaagatcaatggtgtgggagcctgatcggacttacctcccgcgcgacatgggcccagaatattctgaccgctatccaacaggtgcggtctctcatcggcgacgaggagttcagcgattacatgccctccatgaaaagatttcgcaaggaagaggaatctgagggggccatttggtga

SEQ ID NO: 20475 - RNA, 9873 nt, synthetic construct
  misc_feature 1..9873: note = derived and/or modified CDS sequence (opt5) from DENV-3__GU131917__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcacccttctgatgctcgtgacaccttctatgaccatgagatgtgttggagtgggcaaccgggactttgtcgaagggctgagcggagctacctgggtggatgtggtcctggagcatggcgggtgcgttacaacgatggccaagtccaaacccaccctcgacattgagctgcagaagacagaagctacccaacttgccacactgcgcaaactctgtatcgagggaaagattaccaatatcacgacagatagcagatgccctacccagggcgaagcgaccctgccggaggaacaggaccagaactatgtgtgtaaacacacatacgtggatcggggctgggggaatggatgcggccttttcgggaagggatctctggtcacctgcgccaagtttcaatgtctcgagcccattgagggcaaagtggttcagtatgaaaacctgaagtacacagtgatcattacggtccacaccggggaccagcatcaggtgggaaatgacacacaaggcgttaccgtggagatcacacctcaggcttccaccgtcgaagccgtgctgcccgagtatggcacgctcgggctggaatgcagccctcgcaccggacttgatttcaacgagatgatcctgctcacaatgaaaaataaggcttggatggtccacagacagtggtttttcgacctgccccttccgtggacctctggcgccacaaccgagacgcctacatggaaccggaaagaactgctcgtgacctttaagaatgcccatgctaaaaagcaagaggttgtggtcctggggtcccaggaaggagcgatgcacacagccctgaccggcgctaccgagattcagaacagcgggggcacatctatcttcgccggacacctcaagtgtcgcctgaaaatggataagcttgaactgaaaggcatgtcctacgccatgtgcctcaatacgtttgtgctgaagaaagaggttagcgagacccagcatgggacaattctgatcaaggtggaatacaagggagaggacgctccctgtaaaattcctttctccaccgaagatggccaagggaaggcccacaacggaagacttatcacagcgaaccccgtcgtgaccaaaaaggaggagcccgtgaatatcgaagctgagcctccgttcggcgaatctaacattgttatcgggattggcgacaaagccctcaagatcaattggtataagaaaggaagctccattggcaagatgtttgaggccacggctcggggggccagacgcatggctatcctgggagatacagcctgggacttcggcagcgtcgggggagtgctgaactctctcggcaaaatggtgcatcagatctttgggtccgcgtacaccgccctgttcagcggcgtctcttggattatgaagatcggaattggcgtgcttctgacctggatcgggctcaatagcaaaaacacatccatgtcttttagctgcattgttatcggaattatcaccctgtatctgggcgctgtggtccaggccgatatggggtgtgtgatcaattggaagggaaaggaacttaaatgcggcaacgggattttcgttacaaatgaggtgcacacgtggaccgagcagtacaagtttcaagctgactcccccaaacggctcgccacagcgatcgccggcgcttgggaaaacggagtctgtggcattagaagcaccacacgcatggagaatctgctgtggaagcagatcgccaacgaactcaattatattctgtgggagaacaatatcaaacttaccgtggttgtgggggatatcattggagtcctggaacagggcaagcggacgctcacccctcagcccatggagctgaaatactcttggaagacatgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatttggctgaagcttcgcgaggtgtacacgcagagctgtgatcatcggctcatgtccgcggccatcaaagacgaaagagctgtgcacgccgatatggggtactggatcgagtctcagaagaatggaagctggaaactggagaaggcctcctttattgaagtcaagacatgcacctggcctaaatctcacaccctgtggagcaacggcgtgctcgagtccgacatgatcattcccaagagcctggctgggcctatctctcagcataatcaccgccccggatatcatacacaaaccgccggcccttggcaccttgggaaactggaactcgatttcaactactgcgagggaacgacagttgtgattgcggagaattgtggcacccggggcccctccctgagaacaaccacagtcagcgggaagctgatccacgaatggtgctgtcgctcttgcacccttccgcctctccggtatatgggagaggacggctgttggtacgggatggaaatcagacccattaacgagaaagaagagaatatggtgaagtccctggttagcgctggatctggcaaggtggataactttacgatgggggtcctgtgcctcgccatcctgttcgaggaagtgatgcggggaaaattcggcaagaaacatatgattgccggcgttctttttaccttcgtgctgctcctgagcgggcagatcacatggcgcgacatggctcacaccctgattatgatcggatccaatgccagcgatagaatgggcatgggggtcacatatcttgcgctgattgctacctttaagatccagcccttcctcgccctgggatttttcctccggaaactgacgtctagagagaaccttctgctcggcgtggggctggccatggctacaaccctgcaacttcctgaagacatcgagcagatggccaatggaattgctctgggcctcatgacactgaagctcatcacccagtttgaaacctaccagctgtggacagcccttgtgtccctgacgtgtagcaacaccattttcacactcaccgtcgcgtggcgcacagccaccctgatcctggctggcgtttcccttctgccgctctgccaatctagctccatgcggaagacggattggctgcccatgacagtggccgctatgggggtgcctcccctccctctgtttattttctctcttaaagacacccccaagagacgcagctggcctctgaatgagggagtcatggccgtgggcctggtttccatcctcgcctctagcctgcttagaaacgatgtgcccatggctgggccgctggtcgcgggaggcctcctgatcgcctgttatgtgattaccgggacatccgctgacctcaccgttgagaaagccgccgacgtgacatgggaagaggaagctgagcagacgggagtcagccataacctgatgatcaccgtggatgacgatggcacaatgcggattaaggacgatgaaaccgagaatatccttacagtcctgctgaaaaccgccctcctgattgtgtctggcatctttccttactccatccccgcgacgcttctggtttggcacacctggcagaagcagacacaacgcagcggggtgctctgggacgtcccttctcccccggagacccagaaagctgaactggaggaaggagtgtacagaattaagcagcagggcatcttcgggaagacacaagttggagtgggcgtccagaaagagggggtgtttcataccatgtggcacgtgacacggggagccgttctcacgcacaacggcaagcgcctggagcctaattgggcctccgtcaaaaaggatcttattagctatggcgggggatggagactgtctgctcagtggcaaaaaggcgaagaggtgcaggtgatcgccgtcgaacccgggaagaaccctaagaatttccagaccatgcccggaattttccagacaaccaccggcgagatcggggcgattgctctggactttaaacccggaacatccggcagccctatcatcaaccgggaaggcaaggtggttgggctctacggaaatggcgtggtcacgaaaaacgggggatatgtgtccggcattgcccaaaccaatgccgagccggatgggcccacacctgagctggaagaggaaatgttcaagaaacgcaaccttaccatcatggacctgcatcccggcagcggaaagacaagaaagtacctccctgctattgttcgggaggccatcaaacgcagactgcggaccctcattctggctcccacgagagtggtcgccgcggaaatggaggaggcccttaagggcctgcctatccgctatcagacaaccgctaccaaatctgaacacacagggcgggagatcgtggatctgatgtgccatgccacctttacaatgagactcctgagcccggttcgcgtgcccaattacaaccttgtcattatggacgaagctcacttcaccgatcctgcctccatcgccgctcggggatatatttctacgagagtgggcatgggggaggcggccgctatctttatgacagccaccccccctggaacagccgaagctttcccccagagcaatgccccgattcaggacgaggagcgcgacatccctgaacggtcctggaactctggcaatgagtggatcaccgattttgtggggaagacggtctggttcgttcccagcattaaagcgggcaacgacatcgctaactgtctgagaaagaatggaaagaaagtgattcaactctcccgcaagacctttgatacagaataccagaaaacccggctgaacgactgggatttcgtggtcacaaccgacatctctgagatgggcgccaattttaaggccgatagagtgattgacccccggcgctgcctgaaacctgttatcctcacagatgggcccgagagagtgattcttgctggacctatgccggtcaccgccgcgagcgccgctcagcggcgcggcagagtggggcggaacccccagaaggaaaatgaccaatacatcttcacgggacagcctctgaacaatgatgaggaccatgcccactggacagaagctaagatgctgctcgacaacatcaatacccccgagggcattatccctgccctgttcgaacccgagagagagaaatccgctgccattgatggggaatatcgccttaagggcgagagccggaaaacctttgttgaactgatgagacgcggagacctcccggtgtggctggcgcacaaggtcgcctctgagggcatcaaatacacagatcggaagtggtgcttcgacggggaaagaaacaatcagattctggaggagaacatggatgtggaaatctggaccaaagagggagaacgcaagaagctccggcctagatggcttgacgctcgcacatattccgatcccctggccctgaaagagtttaaggacttcgctgccggcagaaaaagcatcgccctcgatctggtcacggaaattgggcgggtgccttctcatcttgctcaccgcaccagaaatgcgctggacaacctcgttatgctgcatacatccgagcacggaggccgggcctaccgccacgctgtggaggaactgcccgagaccatggaaacactccttctgctgggcctcatgatcctgcttaccgggggagccatgctgtttctcattagcggcaaggggatcggaaaaacgtccattggcctgatctgtgtgatcgtctctagcgggatgctgtggatggccgatgttcctctccagtggattgcttccgccatcgtgcttgagttctttatgatggtgctgctgattcccgagccggaaaagcaaagaacccctcaggacaatcagctcgcgtatgtcgtgatcggaattctgacacttgccgctatcgttgccgctaacgagatgggcctgctcgaaaccacaaagcgggatctgggcatgagcaaagagcccggggtggtctctcccacctcctacctggacgtggacctccatcctgccagcgcgtggacgctttatgccgtcgctacaaccgtgattacaccgatgctgagacacaccatcgaaaattctaccgccaacgttagcctggctgccatcgctaaccaagccgtggtcctcatgggactggataagggctggcccatttccaaaatggaccttggggtgcctctgctcgcgctgggatgctactctcaggttaatcccctgacactcacggccgctgtgcttctgctggtcacccattacgccatcattggccctgggctccaggctaaggccacacgcgaggcccagaaacggaccgcggctggaatcatgaagaaccccacagtggatggcattatgaccatcgacctggatcctgtgatctatgacagcaagttcgagaaacaacttggccaggttatgctgctcgtcctgtgtgccgtgcagctgctccttatgagaacgtcctgggctctgtgcgaagccctgacactcgccaccgggccgattaccacactgtgggagggatctcccggcaagttttggaataccacaatcgctgtgagcatggccaacattttccgcgggtcctaccttgcgggagccggcctggcttttagcatcatgaaatctgtcgggacgggaaagcggggcaccggctcccagggggaaacactcggagagaaatggaagaagaaactgaatcaactgagcagaaaggaattcgatctctataaaaagtccggcattaccgaggttgaccggtctgaggccaaagaagggcttaagcgcggagagacaacccaccatgctgtgagcagaggctccgccaaactgcagtggtttgtggaacggaacatggtcatccctgaggggcgcgtgatcgatctgggatgtggcagaggcgggtggtcttactattgcgcgggactcaagaaggttacggaagtgcggggctacaccaaagggggacccggccacgaggagcctgtccccatgagcacatatgggtggaatattgtgaagctgatgtccggaaaagacgttttctaccttccgcctgaaaagtgtgataccctgctctgcgacatcggcgagagctctccctcccccacagtggaagagagccgcaccattagagtcctgaaaatggtggagccttggctgcggaacaatcagttctgtatcaaggtgctcaacccctacatgcctacagtcattgaacaccttgagcgcctgcagagaaagtatggcgggatgctggttcggaatccgctctctagaaactccacccatgaaatgtactggatcagcaatggaacgggcaacattgtgtctagcgtgaatatggtctcccgcctgcttctgaaccggtttacaatgacccacagacgccccaccatcgagaaagatgtggacctcggggccggaacacggcatgttaacgctgaacctgagacgcccaatatggacgtgatcggcgagagaattaagcgcatcaaagaagagcactctagcacctggcactatgatgacgaaaacccttacaagacatgggcctatcatgggtcctacgaggtcaaagctaccggaagcgcctcctctatgattaatggcgtggttaagctgctgacaaagccctgggatgtggtcccgatggtgacccaaatggctatgacagacaccacgcctttcggccagcagcgggtttttaaagaaaaggtggataccagaacaccccgccctatgcccgggacccggaaagtcatggagatcacagccgagtggctctggagaaccctgggacgcaacaagaaacctcggctttgcacgagagaagagttcacaaagaaggtgcgcaccaatgcggccatgggcgctgtctttacagaagagaaccaatgggacagcgccagagctgccgtggaagatgaggagttctggaaactggttgacaaggaacgggagctccacaaactggggaagtgtggatcctgcgtgtataatatgatgggcaaacgcgaaaagaaacttggggagtttggcaaggccaagggatctagagcgatttggtacatgtggctgggcgctcggtacctcgagttcgaagccctggggtttctgaacgaggatcattggttcagcagagaaaattcctattctggagtcgagggcgaagggctccacaaactgggatacatccttcgggacatcagcaagattcccggcggggccatgtatgctgatgacaccgccggctgggacacgcgcatcaccgaggatgacctgcataacgaggaaaaaattacacagcagatggatccggagcacagacagctcgctaatgccatctttaagctgacctaccaaaacaaagtggtgaaggttcagcggcctacacccaagggaaccgtgatggacattatctcccgcaaagatcagagaggcagcgggcaggtcggaacatatggccttaataccttcacgaacatggaagcgcaactggtgcggcagatggagggggaaggagttctctctaaggccgacctggagaatccccacctgctcgagaaaaagatcattcagtggctggaaacaaaaggcgtggagcgccttaagagaatggctatctccggggatgactgcgtcgtgaagcctattgatgaccggtttgccaacgctctgctcgccctgaacgatatgggcaaagtccgcaaggacatcccgcagtggcaacccagcaaaggatggcatgattggcagcaggtgcctttctgttctcaccatttccacgaacttattatgaaggacggcagaaaactggttgtgccctgccggcctcaggacgagctcatcgggcgcgcgagaatctcccaaggagccggctggagcctgaaggaaaccgcttgtctggggaaggcctacgctcagatgtggtctctcatgtattttcaccggcgcgatctgagacttgcctccaatgctatttgcagcgccgtccccgtgcattggatccctacctcccggacaacctggagcattcacgcgcatcaccagtggatgacaacggaggacatgctgtctgtttggaacagagtgtggatcgaggataatccctggatggaagacaaaaccccggtcacaacctgggaggatgtgccttacctcggaaagcgcgaagaccaatggtgtggcagcctgattgggcttacatcccgggccacctgggctcagaacatcctgacggccattcagcaggtgagatctctcatcggcgatgaggagttcctggactacatgcccagcatgaaacgctttcggaaggaagaggaatccgagggagccatctggtga

SEQ ID NO: 20476 - RNA, 9873 nt, synthetic construct
  misc_feature 1..9873: note = derived and/or modified CDS sequence (opt5) from DENV-3__GU131918__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataagcttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgacaaaaaaggaggagcccgtgaatattgaagctgagcctccgttcggcgaatctaacatcgttattgggatcggcgacaaagccctcaagattaattggtataagaaaggaagctccatcggcaagatgtttgaggccaccgctcggggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagacccaaaactccagcttcatcattgacggacctaacacacccgaatgcccgtctgcctccagagcttggaatgtgtgggaggtcgaagactatggctttggcgttttcaccacaaacatctggctgaagcttcgcgaggtgtacacccagagctgtgatcatcggctcatgtccgcggccatcaaagacgaaagagctgtgcacgccgatatggggtactggattgagtctcagaagaatggaagctggaaactggagaaggcctcctttatcgaagtcaagacgtgcacatggcctaaatctcacaccctgtggagcaacggcgtgctcgagtccgacatgattatccccaagagcctggctgggcctatttctcagcataatcaccgccccggatatcatacccaaacagccggcccttggcaccttgggaaactggaactcgatttcaactactgcgagggaaccacggttgtgatcacagagaattgtggcacccggggcccctccctgagaacaaccacagtcagcgggaagctgatccacgaatggtgctgtcgctcttgcacccttccgcctctccggtatatgggagaggacggctgttggtacgggatggaaattagacccatcaacgagaaagaagagaatatggtgaagtccctggttagcgcgggatctggcaaggtggataactttacgatgggggtcctgtgcctcgctattctgttcgaggaagtgatgcggggaaaattcggcaagaaacatatgatcgccggcgttctttttaccttcgtgctgctcctgagcgggcagattacatggcgcgacatggcccacaccctgatcatgattggatccaatgctagcgatagaatgggcatgggggtcacatatcttgccctgatcgcgacctttaagatccagcccttcctcgctctgggatttttcctccggaaactgacgtctagagagaaccttctgctcggcgtggggctggccatggccacaaccctgcaacttcctgaagacattgagcagatggctaatggaatcgccctgggcctcatgacactgaagctcattacccagtttgaaacctaccagctgtggacagctcttgtgtccctgacgtgtagcaacaccatcttcacactcaccgtcgcctggcgcacagcgaccctgattctggccggcgtttcccttctgccgctctgccaatctagctccatgcggaagacggattggctgcccatgacagtggctgccatgggggtgcctcccctccctctgtttatcttctctcttaaagacacccccaagagacgcagctggcctctgaatgagggagtcatggctgtgggcctggtttccatcctcgcctctagcctgcttagaaacgatgtgcccatggccgggccgctggtcgctggaggcctcctgattgcgtgttatgtgatcaccgggacatccgccgacctcaccgttgagaaagctgccgacgtgacatgggaagaggaagccgagcagacgggagtcagccataacctgatgattaccgtggatgacgatggcacaatgcggatcaaggacgatgaaaccgagaatattcttacagtcctgctgaaaaccgctctcctgatcgtgtctggcatctttccttactccattcccgccacgcttctggtttggcacacctggcagaagcagacacaacgcagcggggtgctctgggacgtcccttctcccccggagacccagaaagcggaactggaggaaggagtgtacagaatcaagcagcagggcattttcgggaagacacaagttggagtgggcgtccagaaagagggggtgtttcataccatgtggcacgtgacacggggagctgttctcacgcacaacggcaagcgcctggagcctaattgggcctccgtcaaaaaggatcttatcagctatggcgggggatggagactgtctgcccagtggcaaaaaggcgaagaggtgcaggtgattgctgtcgaacccgggaagaaccctaagaatttccagaccatgcccggaatcttccagacaaccaccggcgagattggggccatcgcgctggactttaaacccggaacatccggcagccctatcattaaccgggaaggcaaggtggttgggctctacggaaatggcgtggtcacgaaaaacgggggatatgtgtccggcatcgctcaaaccaatgccgagccggatgggcccacacctgagctggaagaggaaatgttcaagaaacgcaaccttaccattatggacctgcatcccggcagcggaaagacaagaaagtacctccctgccatcgttcgggaggctattaaacgcagactgcggaccctcatcctggcccccacgagagtggtcgctgccgaaatggaggaggcgcttaagggcctgcctatccgctatcagacaaccgccaccaaatctgaacacacagggcgggagattgtggatctgatgtgccatgctacctttacaatgagactcctgagcccggttcgcgtgcccaattacaaccttgtcatcatggacgaagcccacttcaccgatcctgcttccattgccgcccggggatatatctctacgagagtgggcatgggggaggctgcggccatttttatgacagctaccccccctggaacagccgaagccttcccccagagcaatgctccgatccaggacgaggagcgcgacatccctgaacggtcctggaactctggcaatgagtggattaccgattttgtggggaagacggtctggttcgttcccagcatcaaagccggcaacgacattgcgaactgtctgagaaagaatggaaagaaagtgatccaactctcccgcaagacctttgatacagaataccagaaaacccggctgaacgactgggatttcgtggtcacaaccgacatttctgagatgggcgctaattttaaggccgatagagtgatcgacccccggcgctgcctgaaacctgttattctcacagatgggcccgagagagtgatccttgccggacctatgccggtcaccgctgccagcgcggcccagcggcgcggcagagtggggcggaacccccagaaggaaaatgaccaatacatcttcacgggacagcctctgaacaatgatgaggaccatgctcactggacagaagccaagatgctgctcgacaacattaatacccccgagggcatcattcctgctctgttcgaacccgagagagagaaatccgccgctatcgatggggaatatcgccttaagggcgagagccggaaaacctttgttgaactgatgagacgcggagacctcccggtgtggctggcccacaaggtcgcgtctgagggcattaaatacacagatcggaagtggtgcttcgacggggaaagaaacaatcagatcctggaggagaacatggatgtggaaatctggaccaaagagggagaacgcaagaagctccggcctagatggcttgacgcccgcacatattccgatcccctggctctgaaagagtttaaggacttcgccgctggcagaaaaagcattgccctcgatctggtcacggaaatcgggcgggtgccttctcatcttgcccaccgcaccagaaatgctctggacaacctcgttatgctgcatacatccgagcacggaggccgggcgtaccgccacgccgtggaggaactgcccgagaccatggaaacactccttctgctgggcctcatgattctgcttaccgggggagctatgctgtttctcatcagcggcaaggggattggaaaaacgtccatcggcctgatctgtgtgattgtctctagcgggatgctgtggatggccgatgttcctctccagtggatcgcctccgctattgtgcttgagttctttatgatggtgctgctgatccccgagccggaaaagcaaagaacccctcaggacaatcagctcgcctatgtcgtgattggaatcctgacacttgcggccattgttgctgccaacgagatgggcctgctcgaaaccacaaagcgggatctgggcatgagcaaagagcccggggtggtctctcccacctcctacctggacgtggacctccatcctgctagcgcctggacgctttatgcggtcgccacaaccgtgatcacaccgatgctgagacacaccatcgaaaattctaccgctaacgttagcctggccgctattgccaaccaagctgtggtcctcatgggactggataagggctggcccatctccaaaatggaccttggggtgcctctgctcgccctgggatgctactctcaggttaatcccctgacactcacggcggccgtgcttctgctggtcacccattacgctattatcggccctgggctccaggccaaggctacacgcgaggcccagaaacggaccgccgcgggaattatgaagaaccccacagtggatggcatcatgaccatcgacctggatcctgtgatttatgacagcaagttcgagaaacaacttggccaggttatgctgctcgtcctgtgtgctgtgcagctgctccttatgagaacgtcctgggccctgtgcgaagctctgacactcgccaccgggccgatcaccacactgtgggagggatctcccggcaagttttggaataccacaattgccgtgagcatggctaacatcttccgcgggtcctaccttgccggagcgggcctggcctttagcattatgaaatctgtcgggacgggaaagcggggcaccggctcccagggggaaacactcggagagaaatggaagaagaaactgaatcaactgagcagaaaggaattcgatctctataaaaagtccggcatcaccgaggttgaccggtctgaggctaaagaagggcttaagcgcggagagacaacccaccatgccgtgagcagaggctccgctaaactgcagtggtttgtggaacggaacatggtcatccctgaggggcgcgtgattgatctgggatgtggcagaggcgggtggtcttactattgcgccggactcaagaaggttacggaagtgcggggctacaccaaagggggacccggccacgaggagcctgtccccatgagcacatatgggtggaatatcgtgaagctgatgtccggaaaagacgttttctaccttccgcctgaaaagtgtgataccctgctctgcgacattggcgagagctctccctcccccacagtggaagagagccgcaccatcagagtcctgaaaatggtggagccttggctgcggaacaatcagttctgtattaaggtgctcaacccctacatgcctacagtcatcgaacaccttgagcgcctgcagagaaagtatggcgggatgctggttcggaatccgctctctagaaactccacccatgaaatgtactggattagcaatggaacgggcaacatcgtgtctagcgtgaatatggtctcccgcctgcttctgaaccggtttacaatgacccacagacgccccaccatcgagaaagatgtggacctcggggcgggaacacggcatgttaacgccgaacctgagacgcccaatatggacgtgattggcgagagaatcaagcgcattaaagaagagcactctagcacctggcactatgatgacgaaaacccttacaagacatgggcttatcatgggtcctacgaggtcaaagccaccggaagcgcttcctctatgatcaatggcgtggttaagctgctgacaaagccctgggatgtggtcccgatggtgacccaaatggccatgacagacaccacgcctttcggccagcagcgggtttttaaagaaaaggtggataccagaacaccccgccctatgcccgggacccggaaagtcatggagattacagctgagtggctctggagaaccctgggacgcaacaagaaacctcggctttgcacgagagaagagttcacaaagaaggtgcgcaccaatgccgcgatgggcgccgtctttacagaagagaaccaatgggacagcgctagagccgctgtggaagatgaggagttctggaaactggttgacaaggaacgggagctccacaaactggggaagtgtggatcctgcgtgtataatatgatgggcaaacgcgaaaagaaacttggggagtttggcaaggccaagggatctagagccatctggtacatgtggctgggcgcgcggtacctcgagttcgaagctctggggtttctgaacgaggatcattggttcagcagagaaaattcctattctggagtcgagggcgaagggctccacaaactgggatacatccttcgggacattagcaagatccccggcggggccatgtatgccgatgacaccgctggctgggacacgcgcattaccgaggatgacctgcataacgaggaaaaaatcacacagcagatggatccggagcacagacagctcgccaatgctatttttaagctgacctaccaaaacaaagtggtgaaggttcagcggcctacacccaagggaaccgtgatggacatcatctcccgcaaagatcagagaggcagcgggcaggtcggaacatatggccttaataccttcacgaacatggaagcccaactggtgcggcagatggagggggaaggagttctctctaaggcggacctggagaatccccacctgctcgagaaaaagattatccagtggctggaaacaaaaggcgtggagcgccttaagagaatggccatttccggggatgactgcgtcgtgaagcctatcgatgaccggtttgctaacgccctgctcgctctgaacgatatgggcaaagtccgcaaggacattccgcagtggcaacccagcaaaggatggcatgattggcagcaggtgcctttctgttctcaccatttccacgaacttatcatgaaggacggcagaaaactggttgtgccctgccggcctcaggacgagctcatcgggcgcgccagaatttcccaaggagcgggctggagcctgaaggaaaccgcctgtctggggaaggcttacgcccagatgtggtctctcatgtattttcaccggcgcgatctgagacttgcttccaatgccatctgcagcgctgtccccgtgcattggattcctacctcccggacaacctggagcatccacgcccatcaccagtggatgacaacggaggacatgctgtctgtttggaacagagtgtggattgaggataatccctggatggaagacaaaaccccggtcacaacctgggaggatgtgccttacctcggaaagcgcgaagaccaatggtgtggcagcctgatcgggcttacatcccgggcgacctgggcccagaacattctgacggctatccagcaggtgagatctctcatcggcgatgaggagttcctggactacatgcccagcatgaaacgctttcggaaggaagaggaatccgagggagccatttggtga

SEQ ID NO: 20477 - RNA, 9873 nt, synthetic construct
  misc_feature 1..9873: note = derived and/or modified CDS sequence (opt5) from DENV-3__GU131933__SS-prME
  source 1..9873: mol_type = other RNA
acaagcctgtgcctcatgatgatgctgcccgccacacttgctttccacctgacgtcccgggacggcgagcctcggatgatcgtggggaagaacgaacgcggaaaatctctcctgtttaagacagccagcggcattaatatgtgtacacttatcgcgatggatctgggggagatgtgcgacgatacagtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaagaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggaaaatagcatcaaacttacagtggttgtgggggatattatcggagtcctggaacagggcaagcggaccctcacgcctcagcccatggagctgaaatacagctggaagacctgggggaaggctaaaattgtgacagccgagacccaaaactcttccttcatcattgacggacctaatacacccgaatgcccgagcgcctccagagcttggaacgtgtgggaggtcgaagactatggctttggcgttttcaccacaaacatctggctgaaacttcgcgaggtgtacacccagtcttgtgatcatcggctcatgagcgcggccatcaaagacgaaagagctgtgcacgccgatatggggtactggattgagtcccagaagaatggatcttggaaactggagaaggccagctttatcgaagtcaagacgtgcacatggcctaaatcccacaccctgtggagcaacggcgtgctcgagtctgacatgattatccccaagtccctggctgggcctattagccagcataatcaccgccccggatatcatacccaaacagccggcccttggcaccttgggaaactggaactcgatttcaactactgcgagggaaccacggttgtgatcacagagaattgtggcacccggggcccctctctgagaacaaccacagtctccgggaagctgatccacgaatggtgctgtcgcagctgcacccttccgcctctccggtatatgggagaggacggctgttggtacgggatggaaattagacccatcaacgagaaagaagagaatatggtgaagtctctggttagcgcgggatccggcaaggtggataactttacgatgggggtcctgtgcctcgctattctgttcgaggaagtgatgcggggaaaattcggcaagaaacatatgatcgccggcgttctttttaccttcgtgctgctcctgagcgggcagattacatggcgcgacatggcccacaccctgatcatgattggatctaatgcttccgatagaatgggcatgggggtcacatatcttgccctgatcgcgacctttaagatccagcccttcctcgctctgggatttttcctccggaaactgacgagcagagagaaccttctgctcggcgtggggctggccatggccacaaccctgcaacttcctgaagacattgagcagatggctaatggaatcgccctgggcctcatgacactgaagctcattacccagtttgaaacctaccagctgtggacagctcttgtgtccctgacgtgttctaacaccatcttcacactcaccgtcgcctggcgcacagcgaccctgattctggccggcgttagccttctgccgctctgccaatcctctagcatgcggaagacggattggctgcccatgacagtggctgccatgggggtgcctcccctccctctgtttatcttctcccttaaagacacccccaagagacgctcttggcctctgaatgagggagtcatggctgtgggcctggttagcatcctcgcctccagcctgcttagaaacgatgtgcccatggccgggccgctggtcgctggaggcctcctgattgcgtgttatgtgatcaccgggacatctgccgacctcaccgttgagaaagctgccgacgtgacatgggaagaggaagccgagcagacgggagtctcccataatctgatgattaccgtggatgacgatggcacaatgcggatcaaggacgatgaaaccgagaacattcttacagtcctgctgaaaaccgctctcctgatcgtgagcggcatctttccttactctattcccgccacgcttctggtttggcacacctggcagaagcagacacaacgctccggggtgctctgggacgtcccttctcccccggagacccagaaagcggaactggaggaaggagtgtacagaatcaagcagcagggcattttcgggaagacacaagttggagtgggcgtccagaaagagggggtgtttcataccatgtggcacgtgacacggggagctgttctcacgcacaacggcaagcgcctggagcctaattgggcctccgtcaaaaaggatcttatctcctatggcgggggatggagactgagcgcccagtggcaaaaaggcgaagaggtccaggtgattgctgtcgaacccgggaagaaccctaagaatttccagaccatgcccggaatcttccagacaaccatgggcgagattggggccatcgcgctggactttaaacccggaacctccggcagccctatcattaaccgggaaggcaaggtggttgggctctacggaaatggcgtggtcaccaagaacgggggatatgtgtctggcatcgctcaaacgaatgccgagccggatgggcccacccctgagctggaagaggaaatgttcaagaaacgcaaccttacaattatggacctgcatcccggcagcggaaagaccagaaagtacctccctgccatcgttcgggaggctattaaacgcagactgcggacactcatcctggcccccaccagagtggtcgctgccgaaatggaggaggcgcttaagggcctgcctatccgctatcagacgacagccaccaaatccgaacacaccgggcgggagattgtggatctgatgtgccatgctacatttaccatgagactcctgtctccggttcgcgtgcccaattacaaccttgtcatcatggacgaagcccacttcacagatcctgctagcattgccgcccggggatatatctccaccagagtgggcatgggggaggctgcggccatttttatgacggctacaccccctggaaccgccgaagccttcccccagtctaatgctccgatccaggacgaggagcgcgacatccctgaacggagctggaactccggcaatgagtggattacagattttgtggggaagaccgtctggttcgttccctctatcaaagccggcaacgacattgcgaattgtctgagaaagaacggaaagaaagtgatccaactcagccgcaagacgtttgataccgaataccagaaaacacggctgaacgactgggatttcgtggtcaccacagacatttccgagatgggcgctaattttaaggccgatagagtgatcgacccccggcgctgcctgaaacctgttattctcaccgatgggcccgagagagtgatccttgccggacctatgccggtcacagctgccagcgcggcccagcggcgcggcagagtggggcggaacccccagaaggaaaatgaccaatacatcttcaccggacagcctctgaacaatgatgaggaccatgctcactggacggaagccaagatgctgctcgacaacattaatacacccgagggcatcattcctgctctgttcgaacccgagagagagaaatctgccgctatcgatggggaatatcgccttaagggcgagtcccggaaaacctttgttgaactgatgagacgcggagacctcccggtgtggctggcccacaaggtcgcgagcgagggcattaaatacaccgatcggaagtggtgcttcgacggggaaagaaacaatcagatcctggaggagaacatggatgtggaaatctggacaaaagagggagaacgcaagaagctccggcctagatggcttgacgcccgcacctattctgatcccctggctctgaaagagtttaaggacttcgccgctggcagaaaatccattgccctcgatctggtcacagaaatcgggcgggtgcctagccatcttgcccaccgcacgagaaatgctctggacaacctcgttatgctgcatacctccgagcacggaggccgggcgtaccgccacgccgtggaggaactgcccgagacaatggaaaccctccttctgctgggcctcatgattctgcttacagggggagctatgctgtttctcatctctggcaaggggattggaaaaaccagcatcggcctgatctgtgtgattgcctccagcgggatgctgtggatggccgatgtccctctccagtggatcgcttctgccattgttcttgagttctttatgatggtgctgctgatccccgagccggaaaagcaaagaacgcctcaggacaatcagctcgcgtatgtggtcattggaatcctgacccttgccgctattgtggccgctaacgagatgggcctgctcgaaacaaccaagcgggatctgggcatgtccaaagagcccggggttgtgagccccacatcttacctggacgtcgacctccatcctgccagcgcgtggaccctttatgccgtggctacgacagtcatcaccccgatgctgagacacacaatcgaaaattccaccgccaacgtgtctctggctgccattgctaatcaagccgttgtgctcatgggactggataagggctggcccatcagcaaaatggaccttggggtccctctgctcgcgctgggatgctactcccaggtgaaccccctgaccctcacagccgctgttcttctgctggtgacgcattacgccattatcggccctgggctccaggctaaggccacccgcgaggcccagaaacggacagcggctggaattatgaagaaccccaccgtcgatggcatcatgacaatcgacctggatcctgtgatttatgactctaagttcgagaaacaacttggccaggtgatgctgctcgttctgtgtgccgtccagctgctccttatgagaaccagctgggctctgtgcgaagccctgacgctcgccacagggccgatcaccaccctgtgggagggatcccccggcaagttttggaatacaaccattgctgtgagcatggccaacatcttccgcgggtcttaccttgcgggagccggcctggctttttccattatgaaaagcgtggggacaggacggagaggcacgggctcccagggggaaaccctcggagagaagtggaaaaagaagctgaatcaactgtctcggaaagagttcgatctctataagaaaagcggcatcacagaggtcgaccgcaccgaggccaaggaagggcttaaaagaggagagacaacccaccatgctgtttcccggggctctgccaagctgcagtggtttgtggaacgcaacatggtgatccctgaggggagagtcattgatctgggatgtggccggggcgggtggagctactattgcgcgggactcaaaaaggtgacggaagttcgcggctacaccaaaggcgggcccgggcacgaggagcctgtgcccatgtccacatatgggtggaatatcgtcaaactgatgagcggaaaggacgtgttctaccttccgcctgaaaaatgtgataccctgctctgcgacattggcgagtcttcccccagccccacagttgaagagtctagaaccatccgggtgctgaagatggtcgagccttggctgcgcaacaatcagttctgtattaaagtgctcaacccctacatgcctacagtgatcgaacaccttgagagactgcagcggaagtatggcgggatgctggtcagaaatccgctctcccgcaacagcacccatgaaatgtactggatttctaatggaacgggcaacatcgttagctccgtgaatatggtgtctcggctgcttctgaacagatttacaatgacccaccgccggcccaccatcgagaaggatgtcgacctcggggccggaacaagacatgtgaatgctgaacctgagacgcccaacatggacgttattggcgagcgcatcaaacggattaaggaagaacacagctccacctggcactatgatgacgaaaacccttacaaaacatgggcctatcatgggagctacgaggtgaaggctaccggatccgcctctagcatgatcaatggcgtcgtgaaactgctgacaaagccctgggatgttgtgccgatggtcacccaaatggctatgacagacaccacgcctttcggccagcagagagtgtttaaggaaaaagttgatacccgcacaccccggcctatggccgggaccagaaaggtgatggagattacagcggagtggctctggcgcaccctgggacggaacaaaaagcccagactttgcacgcgcgaagagttcaccaagaaggtcagaaccaatgccgctatgggcgccgtgtttacagaagagaaccaatgggactccgctcgggccgccgtcgaagatgaggagttctggaagctggtggaccgcgaaagagagctccacaaactggggaagtgtggatcttgcgtttataatatgatgggcaaacgggaaaagaaacttggggagtttggcaaggcgaaaggaagcagagctatctggtacatgtggctgggcgcccggtacctcgagttcgaagccctggggtttctgaacgaggatcattggttctcccgcgaaaattcttatagcggagtggagggcgaagggctccacaagctgggatacatccttagagacatttccaagatccctggcggggctatgtatgccgatgacaccgctggctgggacacgcggattaccgaggatgacctgcataacgaggagaaaatcacacagcagatggatcccgagcaccgccagctcgccaatgcgatttttaagctgacctaccaaaacaaagtcgtgaaggtgcagagaccgacacctaaaggaaccgttatggacatcatcagccggaaggatcagcgcggctctggacaggtgggaacatatggccttaataccttcacgaacatggaagcccaactggtcagacagatggagggggaaggagtgctctccaaggctgacctggagaatccccatctgctcgagaaaaagattacacagtggctggaaaccaaaggcgttgagcggcttaagcgcatggccatcagcggggatgactgcgtggtcaaacccattgatgacagatttgctaacgccctgctcgcgctgaatgatatgggcaaggtgcggaaggacatccctcagtggcaaccgtctaaaggatggcatgattggcagcaggtccccttctgttcccaccatttccacgaacttattatgaaggacggccgcaaactggtggttccttgcagaccccaggacgagctcatcgggcgggcccgcatcagccaaggagctggctggtctctgaaggaaaccgcctgtctggggaaggcttacgcccagatgtggtccctcatgtattttcacagacgggatctgagacttgctagcaacgccatttgctccgcggtgcctgtccattggatccccacaagccgcaccacatggtctattcacgcccatcaccagtggatgacgaccgaggacatgctgacagtgtggaaccgggtttggatcgaggataatccttggatggaagacaagacccccgtgacaacctgggaggatgtcccgtacctcggaaagagagaagaccaatggtgtggcagcctgattgggcttacgtcccgcgctacctgggcccagaacatcctgacagccattcaacaggtgcggtctctcatcggcgatgaggagttcctggactacatgcctagcatgaaaagatttcgcaaggaagaggaatccgagggagctatctggtga

SEQ ID NO: 20478 - RNA, 9873 nt, synthetic construct
  misc_feature 1..9873: note = derived and/or modified CDS sequence (opt5) from DENV-3__GU131934__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctggatcgatgtggtgctggagcatggcgggtgcgtcaccacaatggccaagtccaaacccacgctcgacattgagctgcagaagaccgaagctacacaacttgccaccctgcgcaaactctgtatcgagggaaagattacaaatatcaccacggatagcagatgccctacacagggcgaagcgaccctgccggaggaacaggaccagaactatgtttgtaaacacacctacgtggatcggggctgggggaatggatgcggccttttcgggaagggatctctggtgacatgcgccaagtttcaatgtctcgagcccattgagggcaaagtcgtgcagtatgaaaacctgaagtacaccgttatcatcacagtgcacacgggggaccagcatcaggtcggaaatgacacccaaggcgtgacagttgagattacccctcaggcttccacagtggaagccgtcctgcccgagtatggcaccctcgggctggaatgcagccctcgcacgggacttgatttcaacgagatgatcctgctcaccatgaaaaataaggcttggatggtgcacagacagtggtttttcgacctgccccttccgtggacatctggcgccaccacagagacccctacgtggaaccggaaagaactgctcgtcacatttaagaatgcccatgctaaaaagcaagaggtggttgtgctggggtcccaggaaggagcgatgcacaccgccctgacaggcgctaccgagattcagaacagcgggggcacctctatcttcgccggacacctcaagtgtcgcctgaaaatggataagcttgaactgaaaggcatgtcctacgccatgtgcctcaatacatttgtcctgaagaaagaggtgagcgagacgcagcatgggaccattctgatcaaggttgaatacaagggagaggacgctccctgtaaaatccctttctccacagaagatggccaagggaaggcccacaacggaagacttattaccgcgaaccccgtggtcacaaaaaaggaggagcccgtgaatatcgaagctgagcctccgttcggcgaatctaacattgtgatcgggattggcgacaaagccctcaagatcaattggtataagaaaggaagctccatcggcaagatgtttgaggccaccgctcggggggccagacgcatggctattctgggagatacggcctgggacttcggcagcgttgggggagtcctgaactctctcggcaaaatggtgcatcagatctttgggtccgcgtacacagccctgttcagcggcgtgtcttggattatgaagatcggaattggcgtccttctgacctggatcgggctcaatagcaaaaacacctccatgtcttttagctgcattgtgatcggagttatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagaaccaaaactccagcttcatcattgacggacctaatacccccgaatgcccgtctgcctccagagcttggaacgtgtgggaggtcgaagactatggctttggcgttttcacaaccaatatctggctgaagcttcgcgaggtgtacacacagagctgtgatcatcggctcatgtccgcggccatcaaagacgaaagagctgtgcacgccgatatggggtactggattgagtctcagaagaacggaagctggaaactggagaaggcctcctttatcgaagtcaagacctgcacgtggcctaaatctcacacactgtggagcaatggcgtgctcgagtccgacatgattatccccaagagcctggctgggcctatttctcagcataaccaccgccccggatatcatacccaaaccgccggcccttggcaccttgggaaactggaactcgatttcaattactgcgagggaacaaccgttgtgatcgcggagaactgtggcacgcggggcccctccctgagaacaaccacagtcagcgggaagctgatccacgaatggtgctgtcgctcttgcacccttccgcctctccggtatatgggagaggacggctgttggtacgggatggaaattagacccatcaatgagaaagaagagaacatggtgaagtccctggttagcgctggatctggcaaggtggataattttacaatgggggtcctgtgcctcgccattctgttcgaggaagtgatgcggggaaaattcggcaagaaacatatgatcgccggcgttctttttaccttcgtgctgctcctgagcgggcagattacgtggcgcgacatggctcacaccctgatcatgattggatccaacgccagcgatagaatgggcatgggggtcacatatcttgcgctgatcgctacctttaagatccagcccttcctcgccctgggatttttcctccggaaactgacatctagagagaatcttctgctcggcgtggggctggccatggctaccacgctgcaacttcctgaagacattgagcagatggccaacggaatcgctctgggcctcatgacactgaagctcattacccagtttgaaacataccagctgtggaccgcccttgtgtccctgacctgtagcaatacaatcttcacgctcaccgtcgcgtggcgcacagccaccctgattctggctggcgtttcccttctgccgctctgccaatctagctccatgcggaagacagattggctgcccatgaccgtggccgctatgggggtgcctcccctccctctgtttatcttctctcttaaagacacgcccaagagacgcagctggcctctgaacgagggagtcatggccgtgggcctggtttccatcctcgcctctagcctgcttagaaacgatgtgcccatggctgggccgctggtcgcgggaggcctcctgattgcctgttatgtgatcacagggacctccgctgacctcaccgttgagaaagccgccgacgtgacatgggaagaggaagctgagcagaccggagtcagccataatctgatgattacagtggatgacgatggcacgatgcggatcaaggacgatgaaaccgagaacattcttacagtcctgctgaaaaccgccctcctgatcgtgtctggcatctttccttactccattcccgcgacacttctggtttggcacacctggcagaagcagacgcaacgcagcggggtgctctgggacgtcccttctcccccggagacccagaaagctgaactggaggaaggagtgtacagaatcaagcagcagggcattttcgggaagacacaagttggagtgggcgtccagaaagagggggtgtttcataccatgtggcacgtgacacggggagccgttctcacccacaatggcaagcgcctggagcctaactgggcctccgtcaaaaaggatcttatcagctatggcgggggatggagactgtctgctcagtggcaaaaaggcgaagaggtgcaggtgattgccgtcgaacccgggaagaatcctaagaacttccagacaatccccggaattttccagacgaccacaggcgagatcggggcgatcgctctggactttaaacccggaacctccggcagccctattatcaatcgggaaggcaaggtggttgggctctacggaaacggcgtggtcaccaaaaatgggggatatgtgtccggcattgcccaaacaaacgccgagccggatgggcccacgcctgagctggaagaggaaatgttcaagaaacgcaatcttaccatcatggacctgcatcccggcagcggaaagacaagaaagtacctccctgctattgttcgggaggccatcaaacgcagactgcggaccctcatcctggctcccacaagagtggtcgccgcggaaatggaggaggcccttaagggcctgcctattcgctatcagaccacggctacaaaatctgaacacaccgggcgggagatcgtggatctgatgtgccatgccacctttacaatgagactcctgagcccggttcgcgtgcccaactacaatcttgtcattatggacgaagctcacttcaccgatcctgcctccatcgccgctcggggatatatttctacaagagtgggcatgggggaggcggccgctatctttatgaccgccacgccccctggaacagccgaagctttcccccagagcaacgccccgatccaggacgaggagcgcgacattcctgaacggtcctggaattctggcaacgagtggatcaccgattttgtggggaagacagtctggttcgttcccagcattaaagcgggcaacgacatcgctaattgtctgagaaagaacggaaagaaagtgattcaactctcccgcaagacctttgatacggaataccagaaaacccggctgaatgactgggatttcgtggtcacaaccgacatctctgagatgggcgccaactttaaggccgatagagtgattgacccccggcgctgcctgaaacctgttatcctcacagatgggcccgagagagtgatccttgctggacctatgccggtcaccgccgcgagcgccgctcagcggcgcggcagagtggggcggaatccccagaaggaaaacgaccaatacattttcacaggacagcctctgaataacgatgaggaccatgcccactggaccgaagctaagatgctgctcgacaatatcaacacgcccgagggcattatccctgccctgttcgaacccgagagagagaaatccgctgccattgatggggaatatcgccttaagggcgagagccggaaaacatttgttgaactgatgagacgcggagacctcccggtgtggctggcgcacaaggtcgcctctgagggcatcaaatacaccgatcggaagtggtgcttcgacggggaaagaaataaccagatcctggaggagaatatggatgtggaaatttggaccaaagagggagaacgcaagaagctccggcctagatggcttgacgctcgcacatattccgatcccctggccctgaaagagtttaaggacttcgctgccggcagaaaaagcatcgccctcgatctggtcaccgaaattgggcgggtgccttctcatcttgctcaccgcacaagaaacgcgctggacaatctcgttatgctgcatacgtccgagcacggaggccgggcctaccgccacgctgtggaggaactgcccgagaccatggaaacactccttctgctgggcctcatgatcctgcttaccgggggagccatgctgtttctcattagcggcaaggggatcggaaaaacatccatcggcctgatttgtgtgatcgtctctagcgggatgctgtggatggccgatgttcctctccagtggattgcttccgccatcgtgcttgagttctttatgatggtgctgctgattcccgagccggaaaagcaaagaacccctcaggacaaccagctcgcgtatgtcgtgatcggaattctgacgcttgccgctatcgttgccgctaatgagatgggcctgctcgaaaccacaaagcgggatctgggcatgagcaaagagcccggggtggtctctcccacctcctacctggacgtggacctccatcctgccagcgcgtggacactttatgccgtcgctaccacggtgatcacaccgatgctgagacacaccattgaaaactctacagccaacgttagcctggctgccatcgctaatcaagccgtggtcctcatgggactggataagggctggcccatttccaaaatggaccttggggtgcctctgctcgcgctgggatgctactctcaggttaaccccctgaccctcaccgccgctgtgcttctgctggtcacacattacgccatcattggccctgggctccaggctaaggccacgcgcgaggcccagaaacggaccgcggctggaatcatgaagaatcccacagtggatggcatcatgaccattgacctggatcctgtgatctatgacagcaagttcgagaaacaacttggccaggttatgctgctcgtcctgtgtgccgtgcagctgctccttatgagaacatcctgggctctgtgcgaagccctgaccctcgccacggggccgattacaaccctgtgggagggatctcccggcaagttttggaacaccacaatcgctgtgagcatggccaatattttccgcgggtcctaccttgcgggagccggcctggcttttagcatcatgaaatctgtcgggaccggacggagaggcacaggctcccagggggaaacgctcggagagaagtggaaaaagaagctgaaccaactgagccggaaagaattcgatctctataagaaatccggcatcaccgaggttgaccgcacagaggccaaggaagggcttaaaagaggagagaccacacaccatgctgtgtctcggggcagcgccaagctgcagtggtttgtggaacgcaatatggtcattcctgaggggagagtgatcgatctgggatgtggccggggcgggtggtcctactattgcgcgggactcaaaaaggttaccgaagtgcgcggctacacgaaggggggacccggccacgaggagcctgtccccatgtctacctatgggtggaacattgtgaaactgatgagcggaaaggacgttttctaccttccgcctgaaaaatgtgatacactgctctgcgacatcggcgagtccagcccctctcccaccgtggaagagtccagaacaattcgggtcctgaagatggtggagccttggctgcgcaataaccagttctgtatcaaagtgctcaatccctacatgcctaccgtcattgaacaccttgagagactgcagcggaagtatggcgggatgctggttagaaacccgctcagccgcaattctacacatgaaatgtactggatctccaacggaaccggcaatatcgtgagctctgtgaacatggtcagccggctgcttctgaacagatttacgatgacacaccgccggcccaccattgagaaggatgtggacctcggggccggaaccagacatgttaatgctgaacctgagacacccaacatggacgtgatcggcgagcgcattaaacggatcaaggaagagcactcctctacgtggcactatgatgacgaaaatccttacaaaacctgggcctatcatgggagctacgaggtcaaggctacaggatccgccagctccatgattaacggcgtggttaaactgctgaccaagccctgggatgtggtcccgatggtgacacaaatggctatgaccgacacaacccctttcggccagcagagagtttttaaggaaaaagtggatacgcgcaccccccggcctatgcccgggacaagaaaggtcatggagatcaccgccgagtggctctggcgcacactgggacggaataaaaagcctagactttgcacccgcgaagagttcacgaaaaaggtgagaacaaacgcggccatgggcgctgtctttaccgaagagaatcaatgggactctgcccgggctgccgtggaagatgaggagttctggaagctggttgacaaagaacgcgagctccacaagctggggaaatgtggaagctgcgtgtataacatgatgggcaagagagaaaaaaagcttggggagtttggcaaagccaagggatcccgggcgatctggtacatgtggctgggcgctagatacctcgagttcgaagccctggggtttctgaatgaggatcattggttctctcgggaaaacagctattccggagtcgagggcgaagggctccacaagctgggatacattcttcgcgacatctctaaaattcccggcggggccatgtatgctgatgacacagccggctgggacaccagaatcacggaggatgacctgcataatgaggaaaagattacccagcagatggatccggagcaccggcagctcgctaacgccatctttaaactgacataccaaaataaggtggtgaaagttcagcgccctacccccaagggaacagtgatggacatcattagcagaaaggatcagcggggctccgggcaggtcggaacctatggccttaacacattcaccaatatggaagcgcaactggtgcgccagatggagggggaaggagttctcagcaaagccgacctggagaacccccacctgctcgagaagaaaatcacgcagtggctggaaacaaagggcgtggagagacttaaacggatggctatttctggggatgactgcgtcgtgaagcctatcgatgaccgctttgccaacgctctgctcgccctgaatgatatgggcaaggtcagaaaagacattccgcagtggcaaccctccaagggatggcatgattggcagcaggtgcctttctgtagccaccatttccacgaacttatcatgaaagacggccggaagctggttgtgccctgccgccctcaggacgagctcatcgggagagcgcggatttctcaaggagccggctggtccctgaaagaaaccgcttgtctggggaaggcctacgctcagatgtggagcctcatgtattttcaccgcagagatctgcggcttgcctctaacgctatctgctccgccgtccccgtgcattggattcctaccagcagaacaacctggtccatccacgcgcatcaccagtggatgacaacggaggacatgctgaccgtttggaatcgcgtgtggattgaggataacccctggatggaagacaagacaccggtcaccacatgggaggatgtgccttacctcggaaaacgggaagaccaatggtgtggcagcctgatcgggcttacctctagagccacgtgggctcagaatattctgaccgccatccagcaggtgcgcagcctcatcggcgatgaggagttcctggactacatgccctccatgaagcggtttagaaaagaagaggaaacagagggagccatttggtga

SEQ ID NO: 20479 - RNA, 9873 nt, synthetic construct
  misc_feature 1..9873: note = derived and/or modified CDS sequence (opt5) from DENV-3__GU131935__SS-prME
  source 1..9873: mol_type = other RNA
acaagcctgtgcctcatgatgatgctgcccgccacccttgctttccacctgacgtcccgggacggcgaacctcggatgatcgtggggaagaacgaacgcggaaaatctctcctgtttaagaccgcctccggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctgggaaaatggagtgtgtggcatcagatctacaacccgcatggagaacctgctgtggaagcagattgctaatgaactcaactatatcctgtgggagaataacatcaaacttacagtcgtggttggggatattatcggagtgctggaacagggcaagcggaccctcacgcctcagcccatggagctgaaatactcctggaagacctgggggaaggccaaaattgtcacagccgagacccaaaatagctctttcatcattgacggacctaacacacccgaatgcccgtccgctagcagagcgtggaacgtgtgggaggtggaagactatggctttggcgtcttcaccacaaatatctggctgaaacttcgcgaggtttacacccagtcctgtgatcatcggctcatgtctgccgctatcaaagacgaaagagccgtgcacgccgatatggggtactggattgagagccagaagaacggatcctggaaactggagaaggcttcttttatcgaagtgaagacgtgcacatggcctaaaagccacaccctgtggtccaatggcgtcctcgagagcgacatgattatccccaagtctctggccgggcctatttcccagcataaccaccgccccggatatcatacccaaacagcgggcccttggcaccttgggaaactggaactcgatttcaattactgcgagggaaccacggtggttatcacagagaactgtggcacccggggccccagcctgagaacaaccacagtgtctgggaagctgatccacgaatggtgctgtcgctcctgcacccttccgcctctccggtatatgggagaggacggctgttggtacgggatggaaattagacccatcaatgagaaagaagagaacatggtcaagagcctggtgtctgctggaagcggcaaggttgataattttacgatgggggtgctgtgcctcgccattctgttcgaggaagtcatgcggggaaaattcggcaagaaacatatgatcgccggcgtgctttttaccttcgttctgctcctgtccgggcagattacatggcgcgacatggctcacaccctgatcatgattggaagcaacgcctctgatagaatgggcatgggggtgacatatcttgcgctgatcgctacctttaagatccagcccttcctcgccctgggatttttcctccggaaactgacgtccagagagaatcttctgctcggcgtcgggctggccatggctacaaccctgcaacttcctgaagacattgagcagatggccaacggaatcgctctgggcctcatgacactgaagctcattacccagtttgaaacctaccagctgtggacagcccttgtgagcctgacgtgttccaataccatcttcacactcaccgtggcgtggcgcacagccaccctgattctggctggcgtctctcttctgccgctctgccaaagctcctctatgcggaagacggattggctgcccatgacagttgccgctatgggggtgcctcccctccctctgtttatcttcagccttaaagacacccccaagagacgctcctggcctctgaacgagggagtgatggccgtcggcctggtgtctatcctcgccagctccctgcttagaaatgatgttcccatggctgggccgctggtggcgggaggcctcctgattgcctgttatgtcatcaccgggacaagcgctgacctcaccgtggagaaagccgccgacgttacatgggaagaggaagctgagcagacgggagtgtctcataacctgatgattaccgtcgatgacgatggcacaatgcggatcaaggacgatgaaaccgagaacattcttacagtgctgctgaaaaccgccctcctgatcgtctccggcatctttccttacagcattcccgcgacgcttctggtgtggcacacctggcagaagcagacacaacgctctggggttctctgggacgtgccttctcccccggagacccagaaagctgaactggaggaaggagtctacagaatcaagcagcagggcattttcgggaagacacaagtgggagttggcgtgcagaaagagggggtctttcataccatgtggcacgtgacacggggagccgtgctcacgcacaatggcaagcgcctggagcctaactgggccagcgttaaaaaggatcttatcagctatggcgggggatggagactgaatgctcagtggcaaaaaggcgaagaggtccaggtgattgccgtggaacccgggaagaaccctaagaatttccagaccatgcccggaatcttccagacaaccaccggcgagattggggcgatcgctctggactttaaacccggaacatccggcagccctatcattaaccgggaaggcaaggtcgtggggctctacggaaatggcgttgtgacgaaaaacgggggatatgtctccggcatcgcccaaaccaatgccgagccggatgggcccacacctgagctggaagaggaaatgttcaagaaacgcaaccttaccattatggacctgcatcccggcagcggaaagacaagaaagtacctccctgctatcgtgcgggaggccattaaacgcagactgcggaccctcatcctggctcccacgagagttgtggccgcggaaatggaggaggcccttaagggcctgcctatccgctatcagacaaccgctaccaaatctgaacacacagggcgggagattgtcgatctgatgtgccatgccacctttacaatgagactcctgagcccggtgcgcgttcccaattacaaccttgtgatcatggacgaagctcacttcaccgatcctgcctccattgccgctcggggatatatctctacgagagtcggcatgggggaggcggccgctatttttatgacagccacaccccctggaacagccgaggctttcccccagagcaatgccccgatccaggacgaggagcgcgacatccctgaacggtcctggaactctggcaatgagtggattaccgattttgtggggaagacggtgtggttcgtccccagcatcaaagcgggcaacgacattgctaactgtctgagaaagaatggaaagaaagttatccaactctcccgcaagacctttgatacagaataccagaaaacccggctgaacgactgggatttcgtggtgacaaccgacatttctgagatgggcgccaattttaaggccgatagagtcatcgacccccggcgctgcctgaaacctgtgattctcacagatgggcccgagagagttatccttgctggacctatgccggtgaccgccgcgagcgccgctcagcggcgcggcagagtcgggcggaacccccagaaggaaaatgaccaatacatcttcacgggacagcctctgaacaatgatgaggaccatgcccactggacagaagctaagatgctgctcgacaacattaatacccccgagggcatcattcctgccctgttcgaacccgagagagagaaatccgctgccatcgatggggaatatcgccttaagggcgagagccggaaaacctttgtggaactgatgagacgcggagacctcccggtttggctggcgcacaaggtggcctctgagggcattaaatacacagatcggaagtggtgcttcgacggggaaagaaacaatcagatcctggaggagaacatggatgtcgaaatctggaccaaagagggagaacgcaagaagctccggcctagatggcttgacgctcgcacatattccgatcccctggccctgaaagagtttaaggacttcgctgccggcagaaaaagcattgccctcgatctggtgacggaaatcgggcgggtcccttctcatcttgctcaccgcaccagaaatgcgctggacaacctcgtgatgctgcatacatccgagcacggaggccgggcctaccgccacgctgttgaggaactgcccgagaccatggaaacactccttctgctgggcctcatgattctgcttaccgggggagtgatgctgtttctcatcagcggcaaggggattggaaaaacgtccatcggcctgatctgtgtgattgtctctagcgggatgctgtggatggccgatgttcctctccagtggatcgcctccgctattgtgcttgagttctttatgatggtgctgctgatccccgagccggaaaagcaaagaacccctcaggacaatcagctcgcctatgtcgtgattggaatcctgacacttgcggccattgttgctgccaacgagatgggcctgctcgaaaccacaaagcgggatctgggcatgagcaaagagcccggggtggtctctcccacctcctacctggacgtggacctccatcctgctagcgcctggacgctttatgcggtcgccacaaccgtgatcacaccgatgctgagacacaccatcgaaaattctaccgctaacgttagcctggccgctattgccaaccaagctgtggtcctcatgggactggataagggctggcccatctccaaaatggaccttggggtgcctctgctcgccctgggatgctactctcaggttaatcccctgacactcacggcggccgtgcttctgctggtcacccattacgctattatcggccctgggctccaggccaaggctacacgcgaggcccagaaacggaccgccgcgggaattatgaagaaccccacagtggatggcatcatgaccatcgacctggatcctgtgatttatgacagcaagttcgagaaacaacttggccaggttatgctgctcgtcctgtgtacggtgcagctgctccttatgagaacatcctgggctctgtgcgaagccctgaccctcgctaccgggccgatcacaaccctgtgggagggatctcccggcaagttttggaatacaacgattgccgtgagcatggccaacatcttccgcgggtcctaccttgctggagccggcctggcgtttagcattatgaaatctgtcgggaccggacggagaggcacaggctcccagggggaaaccctcggagagaagtggaaaaagaagctgaatcaactgagccggaaagagttcgatctctataagaaatccggcatcacagaggttgaccgcaccgaggccaaggaagggcttaaaagaggagagacgacccaccatgctgtgtctcggggcagcgccaagctgcagtggtttgtggaacgcaacatggtcatccctgaggggagagtgattgatctgggatgtggccggggcgggtggtcctactattgcgctggactcaaaaaggttacagaagtgcgcggctacaccaaagggggacccggccacgaggagcctgtccccatgtctacatatgggtggaatatcgtgaaactgatgagcggaaaggacgttttctaccttccgcctgaaaaatgtgataccctgctctgcgacattggcgagtccagcccctctcccacagtggaagagtccagaaccatccgggtcctgaagatggtggagccttggctgcgcaacaatcagttctgtattaaagtgctcaacccctacatgcctacggtcatcgaacaccttgagagactgcagcggaagtatggcgggatgctggttagaaatccgctcagccgcaactctacacatgaaatgtactggatttccaatggaaccggcaacatcgtgagctctgtgaatatggtcagccggctgcttctgaacagatttaccatgacacaccgccggcccacgatcgagaaggatgtggacctcggggccggaaccagacatgttaacgcggaacctgagacacccaatatggacgtgattggcgagcgcatcaaacggattaaggaagaacactcctctacctggcactatgatgacgaaaacccttacaaaacatgggcctatcatgggagctacgaggtcaaggctaccggatccgccagctccatgatcaatggcgtggttaaactgctgacaaagccctgggatgtggtcccgatggtgacccaaatggctatgacggacaccacacctttcggccagcagagagtttttaaggaaaaagtggatacccgcacaccccggcctatgcccgggaccagaaaggtcatggagattacggccgagtggctctggcgcacactgggacggaacaaaaagcctagactttgcacccgcgaagagttcaccaagaaggtgagaaccaatgctgccatgggcgcggtctttacggaagagaaccaatgggactctgcccgggctgccgtggaagatgaggagttctggaagctggttgaccgcgaaagagagctccacaaactggggaagtgtggaagctgcgtgtataatatgatgggcaaacgggaaaagaaacttggggagtttggcaaggctaaaggatccagagccatctggtacatgtggctgggcgcccggtacctcgagttcgaagcgctggggtttctgaacgaggatcattggttctctcgcgaaaatagctattccggagtcgagggcgaagggctccacaagctgggatacatccttagagacatttctaagatccccggcggggctatgtatgccgatgacaccgccggctgggacacacggattaccgaggatgacctgcataacgaggagaagatcacacagcagatggatccggagcaccgccagctcgctaatgccatttttaagctgacctaccaaaacaaagtggtgaaggttcagagacctacacccaaaggaaccgtgatggacatcatcagccggaaggatcagcgcggctccgggcaggtcggaacgtatggccttaatacattcaccaacatggaagctcaactggtgagacagatggagggggaaggagttctcagcaaggccgacctggagaatccccatctgctcgagaaaaagattacccagtggctggaaacaaaaggcgtggagcggcttaagcgcatggcgatctctggggatgactgcgtcgtgaaacctattgatgacagatttgccaacgctctgctcgccctgaacgatatgggcaaggtccggaaggacatcccgcagtggcaaccctccaaaggatggcatgattggcaacaggtgcctttctgtagccaccatttccacgaacttattatgaaggacggccgcaaactggttgtgccctgcagacctcaggacgagctcatcgggcgggctcgcatctctcaaggagccggctggtccctgaaggaaaccgcgtgtctggggaaagcctacgctcagatgtggagcctcatgtattttcacagacgggatctgagacttgcctctaatgctatttgctccgccgtccccgtgcattggatccctacaagccgcacgacctggtccattcacgctcatcaccagtggatgacaaccgaggacatgctgacagtttggaaccgggtgtggatcgaggataatccctggatggaagacaagaccccggtcacgacctgggaggatgtgccttacctcggaaagagagaagaccaatggtgtggcagcctgattgggcttacatctcgcgccacctgggcgcagaacatcctgacagccattcaacaggtgcggagcctcatcggcaatgaggagttcctggattacatgccctccatgaaaagatttcgcaaggaagaggaatctgagggagctatctggtga

SEQ ID NO: 20480 - RNA, 9873 nt, synthetic construct
  misc_feature 1..9873: note = derived and/or modified CDS sequence (opt5) from DENV-3__GU131936__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtggggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagtccatcgagggcaaagtggttcagtatgaaaacctgaagtacaccgtgattatcacagtccacacgggggaccagcatcaggtgggaaatgacacccaaggcgttacagtggagatcacaccccaggctagcacagtcgaagccgtgctgcctgagtatggcaccctcgggctggaatgctctccccgcacgggacttgatttcaacgagatgattctgctcaccatgaaaaataaggcttggatggtccacagacagtggtttttcgacctgcctcttccctggacatccggcgccaccacagagaccccgacgtggaaccggaaagaactgctcgtgacatttaagaatgcccatgctaaaaagcaagaggttgtggtcctggggagccaggaaggagcgatgcacaccgccctgacaggcgctaccgagatccagaactctgggggcacctccattttcgccggacacctcaagtgtcgcctgaaaatggataaacttgaactgaaaggcatgagctacgccatgtgcctcaatacatttgtgctgaagaaagaggtttccgagacgcagcatgggaccatcctgattaaggtggaatacaagggagaggacgctccttgtaaaatccccttctctacagaagatggccaagggaaggcccacaacggaagacttatcaccgcgaaccctgtcgtgaccaagaaggaggagcccgtgaatattgaagctgagccccctttcggcgaaagcaacatcgttattgggatcggcgacaaagccctcaagattaattggtataagaaaggatccagcatcggcaagatgtttgaggccaccgctagaggggccagacgcatggctatcctgggagatacggcctgggacttcggctctgtcgggggagtgctgaactccctcggcaaaatggtgcatcagatttttgggagcgcgtacacagccctgttctctggcgtcagctggatcatgaagattggaatcggcgtgcttctgacctggattgggctcaattccaaaaacacctctatgagcttttcctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgacagcccgaaacggctcgccaccgcgattgccggcgcttgggaaaacggagtctgtggcatcagatctacaacccgcatggagaatctgctgtggaagcagattgccaacgaactcaattatatcctgtgggagaacaatatcaaacttacagtggttgtgggggatattatcggagtcctggaacagggcaagcgggctctcacaccccagcctatggagctgaaatactcctggaagacgtgggggaaggccaaaattgtgaccgccgagacacaaaacagctctttcatcattgacggacccaacacccctgaatgcccctccgctagcagagcgtggaatgtgtgggaggtcgaagactatggctttggcgttttcacaaccaacatctggctgaaacttcgcgaggtgtacacacagtcctgtgatcatcggctcatgtctgccgctatcaaagacgaaagagccgtgcacgccgatatggggtactggattgagagccagaagaatggatcctggaaactggagaaggcttcttttatcgaagtcaagacctgcacgtggccgaaaagccacacactgtggtccaacggcgtgctcgagagcgacatgattatccctaagtctctggccgggcccatttcccagcataatcaccgccctggatatcatacccaaaccgcgggcccctggcaccttgggaaactggaactcgatttcaactactgcgagggaacaaccgttgtgatcgctgagaattgtggcacgcggggccctagcctgagaacaaccacagtctctgggaagctgatccacgaatggtgctgtcgctcctgcacccttcccccgctccggtatatgggagaggacggctgttggtacgggatggaaattagacctatcaacgagaaagaagagaatatggtcaagagcctggtttctgccggaagcggcaaggtggataactttacaatgggggtcctgtgcctcgccattctgttcgaggaagtgatgcggggaaaattcggcaagaaacatatgatcgctggcgttctttttaccttcgtgctgctcctgtccgggcagattacgtggcgcgacatggcccacaccctgatcatgattggaagcaatgcgtctgatagaatgggcatgggggtcacatatcttgctctgatcgccacctttaagatccagcccttcctcgccctgggatttttcctccggaaactgacatccagagagaaccttctgctcggcgtggggctggctatggccaccacgctgcaacttcccgaagacattgagcagatggctaatggaatcgccctgggcctcatgacactgaagctcattacccagtttgaaacataccagctgtggaccgcgcttgtgagcctgacctgttccaacacaatcttcacgctcaccgtcgcctggcgcacagctaccctgattctggccggcgtttctcttctgcctctctgccaaagctcctctatgcggaagacagattggctgccgatgaccgtggctgccatgggggtgccccctctccccctgtttatcttcagccttaaagacacgcctaagagacgctcctggcccctgaatgagggagtcatggccgtgggcctggtttctatcctcgctagctccctgcttagaaacgatgtgcctatggcggggcccctggtcgccggaggcctcctgattgcttgttatgtgatcacagggaccagcgccgacctcaccgttgagaaagccgctgacgtgacatgggaagaggaagccgagcagaccggagtctctcataacctgatgattacagtggatgacgatggcacgatgaagatcaaagacgatgaaaccgagaatattcttacagtcctgctgaagaccgcgctcctgatcgtgtccggcatctttccgtacagcattcctgctacacttctggtttggcacacctggcagaaacagacgcaacggtctggggtgctctgggacgtcccctcccctcccgagacccagaaggccgaactggaggaaggagtgtaccgcatcaagcagcagggcattttcgggaaaacacaagttggagtgggcgtccagaaggagggggtgtttcataccatgtggcacgtgacaagaggagccgttctcacccacaacggcaaacggctggagccgaattgggctagcgtcaagaaagatcttatctcttatggcgggggatggcgcctgtccgcccagtggcaaaagggcgaagaggtccaggtgattgcggtcgaacctgggaagaaccccaaaaatttccagacaatgcctggaatcttccagacgaccacaggcgagattggggctatcgccctggactttaagcccggaaccagcggctcccccatcattaacagagaaggcaaagtggttgggctctacggaaatggcgtggtcaccaagaacgggggatatgtgagcggcatcgcccaaacaaatgctgagcctgatgggccgacgcccgagctggaagaggaaatgttcaaaaagcggaaccttaccattatggacctgcatcctggctctggaaagacacgcaaatacctccccgccatcgttagagaggctattaagcggcgcctgagaaccctcatcctggcccctacacgggtggtcgcggccgaaatggaggaggctcttaaaggcctgcccatcagatatcagaccacggccacaaagagcgaacacaccgggcgcgagattgtggatctgatgtgccatgctacctttacaatgcggctcctgtcccctgttagagtgccgaattacaaccttgtcatcatggacgaagcccacttcaccgatcccgcctctattgctgcgcgcggatatatcagcacacgggtgggcatgggggaggccgctgccatttttatgaccgccacgcctcccggaacagctgaagccttccctcagtccaatgcgcccatccaggacgaggagagagacatcccggaacgctcttggaacagcggcaatgagtggattaccgattttgtggggaaaacagtctggttcgttccttccatcaaggctggcaacgacattgccaactgtctgcggaagaatggcaaaaaggtgatccaactctctagaaaaacctttgatacggaataccagaagacccgcctgaacgactgggatttcgtggtcacaaccgacattagcgagatgggagccaattttaaagctgatcgggtgatcgaccccagacggtgcctgaagcccgttattctcacagatgggcctgagcgcgtgatccttgccggacccatgcctgtcaccgcggcctccgctgcccagagacggggccgcgtggggagaaacccgcagaaggaaaatgaccaatacatcttcatgggacagcccctgaacaatgatgaggaccatgctcactggacagaagccaaaatgctgctcgacaacattaatacccctgagggcatcattcccgctctgttcgaacctgagcgggaaaagagcgccgcgatcgatggggaatatagacttaaaggcgagtctcgcaagacgtttgttgaactgatgcggagaggagacctccccgtgtggctggcccacaaagtcgcttccgagggcattaagtacacagatcgcaaatggtgcttcgacggggaacggaacaatcagatcctggaggagaacatggatgtggaaatctggaccaaggagggagaaagaaagaaactccgcccgcggtggcttgacgccagaacctatagcgatcctctggctctgaaggagtttaaagacttcgccgccggccgcaagtctattgctctcgatctggtcacagaaatcgggagagtgccctcccatcttgcgcaccggacccgcaatgccctggacaacctcgttatgctgcatacaagcgagcacggaggcagagcttaccggcacgccgtggaggaactgcctgagacgatggaaaccctccttctgctgggcctcatgattctgcttacagggggagccatgctgtttctcatctccggcaaagggattggaaagacctctatcggcctgatctgtgtgattgtcagctccgggatgctgtggatggctgatgttcccctccagtggatcgccagcgcgattgtgcttgagttctttatgatggtgctgctgatccctgagcccgaaaagcaacgcacaccgcaggacaatcagctcgcctatgtcgtgattggaatcctgacccttgctgccattgttgctgccaacgagatgggcctgctcgaaacgaccaaaagagatctgggcatgtctaaggagcctggggtggtctcccccacaagctacctggacgtggacctccatcccgcgtctgcctggaccctttatgctgtcgccacaaccgtgatcacgcctatgctgcggcacacaatcgaaaatagcaccgctaacgtttccctggccgctattgccaaccaagcggtggtcctcatgggactggataaaggctggccgatctctaagatggaccttggggtgcccctgctcgccctgggatgctacagccaggttaatcctctgacactcaccgctgccgtgcttctgctggtcacccattacgctattatcggccccgggctccaggccaaagccacaagagaggcgcagaagcgcacggctgccggaattatgaagaaccctaccgtggatggcatcatgacaatcgacctggatcccgtgatttatgactccaaattcgagaagcaacttggccaggttatgctgctcgtcctgtgtgctgtgcagctgctccttatgcggacctcttgggccctgtgcgaagccctgacactcgctaccgggcctatcacgacactgtgggagggaagcccgggcaaattttggaataccaccattgccgtgtccatggcgaacatcttcagagggagctaccttgccggagctggcctggccttttctattatgaagtccgtcgggacaggacgccggggcaccggcagccagggggaaacactcggagagaaatggaagaagaaactgaatcaactgtccagaaaggagttcgatctctataaaaagtctggcatcacggaggttgaccggaccgaggctaaagaagggcttaagcgcggagagacaacccaccatgccgtgagcagaggctccgcgaaactgcagtggtttgtggaacggaacatggtcatccccgaggggcgcgtgattgatctgggatgtggcagaggcgggtggtcttactattgcgccggactcaagaaggttacagaagtgcggggctacaccaaagggggacctggccacgaggagcccgtccctatgagcacgtatgggtggaatatcgtgaagctgatgtccggaaaagacgttttctaccttcccccggaaaagtgtgataccctgctctgcgacattggcgagagctctccttcccccacagtggaagagagccgcaccatcagagtcctgaaaatggtggagccctggctgcggtctaaccagttctgtattaaggtgctcaatccttacatgcccacagtcatcgaacaccttgagcgcctgcagagaaagtatggcgggatgctggttcggaaccctctctccagaaatagcacccatgaaatgtactggatttctaacggaacaggcaatatcgtgagctccgtgaacatggtctctcgcctgcttctgaatcggtttaccatgacgcacagacgcccgacaatcgagaaagatgtggacctcggggctggaacccggcatgttaacgccgaacccgagacccctaacatggacgtgattggcgagagaatcaagcgcattaaagaagaacacagctccacatggcactatgatgacgaaaatccctacaagacgtgggcttatcatgggagctacgaggtcaaagccaccggatccgcttctagcatgatcaacggcgtggttaagctgctgacaaagccttgggatgtggtccccatggtgacccaaatggccatgacagacaccacaccgttcggccagcagcgggtttttaaagaaaaggtggataccagaacgcctcgccccatgcctgggacccggaaagtcatggagattacagcggagtggctctggagaaccctgggacgcaataagaaaccccggctttgcacaagagaagagttcaccaagaaggtgcgcacgaacgccgctatgggcgccgtctttacagaagagaatcaatgggactccgctagagccgccgtggaagatgaggagttctggaaactggttgacaaggaacgggagctccacaaactggggaagtgtggatcttgcgtgtataacatgatgggcaaacgcgaaaagaaacttggggagtttggcaaggcgaagggaagcagagctatctggtacatgtggctgggcgcccggtacctcgagttcgaagccctggggtttctgaatgaggatcattggttctccagagaaaactcttatagcggagtcgagggcgaagggctccacaaactgggatacatccttcgggacatttccaagatccctggcggggctatgtatgccgatgacaccgctggctgggacacacgcattaccgaggatgacctgcataatgaggagaagatcacgcagcagatggatcccgagcacagacagctcgccaacgcgatttttaagctgacctaccaaaataaagtggtgaaggttcagcggccgacacctaagggaaccgtgatggacatcatcagccgcaaagatcagagaggctctgggcaggtcggaacatatggccttaacaccttcacaaatatggaagcccaactggtgcggcagatggagggggaaggagttctctccaaggctgacctggagaacccccatctgctcgagaaaaagattacccagtggctggaaacgaaaggcgtggagcgccttaagagaatggccatcagcggggatgactgcgtcgtgaagcccattgatgaccggtttgctaatgccctgctcgcgctgaacgatatgggcaaagtccgcaaggacatccctcagtggcaaccgtctaaaggatggcatgattggcaacaggtgcccttctgttcccaccatttccacgaacttattatgaaggacggcagaaaactggttgtgccttgccggccccaggacgagctcatcgggcgcgccagaatcagccaaggagctggctggtctctgaaggaaacagcctgtctggggaaggcttacgcccagatgtggtccctcatgtattttcaccggcgcgatctgagacttgctagcaacgccatttgctccgcggtccctgtgcattggatccccaccagccggaccacatggtctattcacgcccatcaccagtggatgaccacagaggacatgctgacggtttggaatagagtgtggatcgaggataacccttggatggaagacaaaacccccgtcacaacctgggaggatgtgccgtacctcggaaagcgcgaagaccaatggtgtggcagcctgattgggcttacatcccgggctacctgggcccagaatatcctgacggccattcaacaggtgagatctctcatcggcgatgaggagttcctggactacatgcctagcatgaaacgctttcggaaggaagaggaaaccgagggagctatctggtga

SEQ ID NO: 20481 - RNA, 9873 nt, synthetic construct
  misc_feature 1..9873: note = derived and/or modified CDS sequence (opt5) from DENV-3__GU131937__SS-prME
  source 1..9873: mol_type = other RNA
acaagcctgtgcctcatgatgatgctgcccgccacgcttgctttccacctgacgtcccgggacggcgagcctcggatgatcgtggggaagaatgaacgcggaaagtctctcctgtttaagacagccagcggcatcaatatgtgtacacttatcgcgatggatctgggggagatgtgcgacgataccgtgacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccaccctgagagcctggaacgtgtgggaggtcgaagactatggctttggcgttttcacaaccaatatctggcttaagctccgcgaggtgtacacgcagagctgtgatcatcggctgatgtccgctgcgatcaaagacgaaagagccgtgcacgctgatatggggtactggattgagtctcagaagaacggaagctggaaactggagaaggcctcctttatcgaagtcaagacatgcacctggcctaaatctcacaccctctggagcaatggcgtgctggagtccgacatgattatccccaagagccttgccgggcctatttctcagcataactatcgccccggataccacacacaaaccgctggcccttggcatctggggaaactcgaactggatttcaattattgcgagggaacgacagttgtgatcaccgagaactgtggcacacggggcccctccctgagaaccacaaccgtcagcgggaaacttatccacgaatggtgctgtcgctcttgcacgctcccgcctctgcggtacatgggagaggacggctgttggtatgggatggaaattagacccatcaatgagaaagaagagaacatggtgaagtccctggttagcgccggatctggcaaggtggataattttaccatgggggtcctctgcctggcgattcttttcgaggaagtgatgcggggaaaattcggcaagaaacacatgatcgctggcgttctgtttacattcgtgctcctgctgagcgggcagattacctggcgcgacatggcccatacacttatcatgattggatccaacgccagcgatagaatgggcatgggggtcacctacctggctctcatcgccacgtttaagatccagcccttcctggcgctcggatttttcctgcggaaacttacatctagagagaatctgctcctgggcgtggggctggctatggccaccacacttcaactgcctgaagacattgagcagatggccaacggaatcgctctcggcctgatgaccctcaagctgattacccagtttgaaacatatcagctttggacggccctggtgtccctcacctgtagcaatacaatcttcaccctgacagtcgcttggcgcaccgccacgctgattcttgcgggcgtttccctgctcccgctgtgccaatctagctccatgcggaagacagattggctccccatgaccgtggccgctatgggggtgcctcccctgcctctttttatcttctctctgaaagacacccccaagagacgcagctggcctctgaacgagggagtcatggccgtgggcctcgtttccatcctggcttctagccttctgagaaatgatgtgcccatggccgggccgctcgtcgccggaggcctgctcattgcttgttacgtgatcacagggacctccgcggacctgacagttgagaaagccgctgacgtgacgtgggaagaggaagccgagcagaccggagtcagccacaaccttatgattacagtggatgacgatggcaccatgcggatcaaggacgatgaaacagagaacattctgaccgtcctgctcaaaacggccctgcttatcgtgtctggcatctttccttactccattcccgctaccctgctcgtttggcatacatggcagaagcagacccaacgcagcggggtgctgtgggacgtcccttctcccccggagacacagaaagccgaactcgaggaaggagtgtatagaatcaagcagcagggcattttcgggaagacccaagttggagtgggcgtccagaaagagggggtgtttcacacaatgtggcatgtgacgcggggagcggttctgacccacaatggcaagcgccttgagcctaactgggcttccgtcaaaaaggatctgatcagctacggcgggggatggagactgtctgcccagtggcaaaaaggcgaagaggtccaggtgattgccgtcgaacccgggaagaatcctaagaacttccagacaatgcccggaatcttccagaccaccacaggcgagattggggctatcgccctcgactttaaacccggaacgtccggcagccctatcattaatcgggaaggcaaggtggttgggctgtatggaaacggcgtggtcaccaaaaatgggggatacgtgtccggcatcgcgcaaacaaacgctgagccggatgggcccacccctgagcttgaagaggaaatgttcaagaaacgcaatctgacaattatggacctccaccccggcagcggaaagaccagaaagtatctgcctgccatcgttcgggaggccattaaacgcagactccggacgctgatccttgctcccacaagagtggtcgccgctgaaatggaggaggccctgaagggcctgcctatccgctaccagaccaccgcgacaaaatctgaacataccgggcgggagattgtggatctcatgtgccacgccacatttaccatgagactgcttagcccggttcgcgtgcccaactataatctggtcatcatggacgaagctcatttcacggatcctgcctccattgctgcccggggatacatctctacaagagtgggcatgggggaggccgctgcgatttttatgaccgccacaccccctggaaccgctgaagccttcccccagagcaacgccccgatccaggacgaggagcgcgacatccctgaacggtcctggaactctggcaacgagtggattacggattttgtggggaagaccgtctggttcgttcccagcatcaaagctggcaatgacattgccaactgtctcagaaagaacggaaagaaagtgatccaactgtcccgcaagacatttgataccgaataccagaaaacacggctgaatgactgggatttcgtggtcaccacagacatttctgagatgggcgcgaactttaaggctgatagagtgatcgacccccggcgctgcctcaaacctgttattcttaccgatgggcccgagagagtgatcctggccggacctatgccggtcacggccgctagcgccgcgcagcggcgcggcagagtggggcggaatccccagaaggaaaacgaccaatatatcttcacaggacagcctctgaataacgatgaggaccacgcccattggaccgaagctaagatgctcctggacaatattaacacccccgagggcatcattcctgcccttttcgaacccgagagagagaaatccgctgccatcgatggggaataccgcctgaagggcgagagccggaaaacatttgttgaactcatgagacgcggagacctgccggtgtggctggctcacaaggtcgcctctgagggcattaaatataccgatcggaagtggtgcttcgacggggaaagaaataaccagatcctcgaggagaatatggatgtggaaatctggacaaaagagggagaacgcaagaaacttcggcctagatggctggacgcgcgcacgtactccgatcccctggccctcaaagagtttaaggacttcgctgccggcagaaaaagcattgctctggatcttgtcaccgaaatcgggcgggtgccttctcacctggcccatcgcacaagaaacgccctcgacaatctggttatgctgcacacctccgagcatggaggccgggcttatcgccacgcggtggaggaactccccgagacaatggaaacccttctgctgctcggcctgatgattagccttacagggggagccatgctgtttctcatctccggcaaggggattggaaaaacctctatcggcctgatctgtgtgattgtcagctccgggatgctgtggatggctgatgttcctctccagtggatcgccagcgccattgtgcttgagttctttatgatggtgctgctgatccccgagccggaaaagcaaagaacacctcaggacaaccagctcgcttacgtcgtgattggaatcctgacccttgccgcgattgttgccgctaatgagatgggcctgctcgaaacaaccaagcgggatctgggcatgtctaaagagcccggggtggtctcccccacgagctatctggacgtggacctccaccctgcctctgcttggacactttacgccgtcgcgaccacagtgatcaccccgatgctgagacataccatcgaaaacagcacagccaatgtttccctggctgccattgctaaccaagccgtggtcctcatgggactggataagggctggcccatctctaaaatggaccttggggtgcctctgctcgctctgggatgctacagccaggttaaccccctgacgctcaccgccgcggtgcttctgctggtcacacactatgccattatcggccctgggctccaggctaaggccacccgcgaggctcagaaacggacagccgccggaattatgaagaatcccaccgtggatggcatcatgacgatcgacctggatcctgtgatttacgactccaagttcgagaaacaacttggccaggttatgctgctcgtcctgtgtgcggtgcagctgctccttatgagaacatcttgggctctgtgcgaagccctgaccctcgctaccgggccgatcacaaccctgtgggagggaagccccggcaagttttggaacacaacgattgccgtgtccatggccaatatcttccgcgggagctatcttgctggagccggcctggcgttttctattatgaaatccgtcgggaccggacggagaggcacaggcagccagggggaaaccctcggagagaagtggaaaaagaagctgaaccaactgtcccggaaagagttcgatctctacaagaaatctggcatcacagaggttgaccgcaccgaggccaaggaagggcttaaaagaggagagacgacccatcacgctgtgagccggggctccgccaagctgcagtggtttgtggaacgcaatatggtcatccctgaggggagagtgattgatctgggatgtggccggggcgggtggtcttattactgcgctggactcaaaaaggttacagaagtgcgcggctataccaaagggggacccggccatgaggagcctgtccccatgagcacatacgggtggaacatcgtgaaactgatgtccggaaaggacgttttctaccttccgcctgaaaaatgtgataccctgctctgcgacattggcgagagctctccctcccccacagtggaagagaatagaaccatccgggtcctgaagatggtggagccttggctgcgcaacaatcagttctgtattaaagtgctcaacccctatatgcctacggtcatcgaacaccttgagagactgcagcggaagtacggcgggatgctggttagaaatccgctcagccgcaactctacacacgaaatgtattggatttccaatggaaccggcaacatcgtgagctctgtgaatatggtcagccggctgcttctgaacagatttaccatgacacatcgccggcccacgatcgagaaggatgtggacctcggggccggaaccagacacgttaacgcggaacctgagacacccaatatggacgtgattggcgagcgcatcaaacggattaaggaagaacactcctctacctggcactacgatgacgaaaacccttataaaacatgggcctaccacgggagctatgaggtcaaggctaccggatccgccagctccatgatcaatggcgtggttaaactgctgacaaagccctgggatgtggtcccgatggtgacccaaatggctatgacggacaccacacctttcggccagcagagagtttttaaggaaaaagtggatacccgcacaccccggcctatgcccgggaccagaaaggtcatggagattacggccgagtggctctggcgcacactgggacggaacaaaaagcctagactttgcacccgcgaagagttcaccaagaaggtgagaaccaatgctgccatgggcgcggtctttacggaagagaaccaatgggactctgcccgggctgccgtggaagatgaggagttctggaagctggttgaccgcgaaagagagctccataaactggggaagtgtggaagctgcgtgtacaatatgatgggcaaacgggaaaagaaacttggggagtttggcaaggctaaaggatccagagccatctggtacatgtggctgggcgcccggtatctcgagttcgaagcgctggggtttctgaacgaggatcactggttctctcgcgaaaatagctactccggagtcgagggcgaagggctccataagctgggatatatccttagagacatttctaagatccccggcggggctatgtacgccgatgacaccgccggctgggacacacggattaccgaggatgacctgcacaacgaggagaaaattacacagcagatggatccggaacatcgccagctcgctaatgccatttttaagctgacctatcaaaacaaagtggtgaaggttcagagacctacacccaaaggaaccgtgatggacatcatcagccggaaggatcagcgcggctccgggcaggtcggaacgtacggccttaatacattcaccaacatggaagctcaactggtgagacagatggagggggaaggagttctcagcaaggccgacctggagaatccccatctgctcgagaaaaagattacccagtggctggaaacaaaaggcgtggagcggcttaagcgcatggcgatctctggggatgactgcgtcgtgaaacctattgatgacagatttgccaacgctctgctcgccctgaacgatatgggcaaggtccggaaggacatcccgcagtggcaaccctccaaaggatggcacgattggcaacaggtgcctttctgtagccatcacttccatgaacttattatgaaggacggccgcaaactggttgtgccctgcagacctcaggacgagctcatcgggcgggctcgcatctctcaaggagccggctggtccctgaaggaaaccgcgtgtctggggaaagcctatgctcagatgtggagcctcatgtactttcacagacgggatctgagacttgcctctaatgctatttgctccgccgtccccgtgcactggatccctacaagccgcacgacctggtccattcatgctcaccatcagtggatgacaaccgaggacatgctgacagtttggaaccgggtgtggatcgaggataatccctggatggaagacaagaccccggtcacgacctgggaggatgtgccttacctcggaaagagagaagaccaatggtgtggcagcctgattgggcttacatctcgcgccacctgggcgcagaacatcctgacagccattcaacaggtgcggagcctcatcggcgatgaggagttcctggactatatgccctccatgaaaagatttcgcaaggaagaggaatctgagggagctatctggtga

SEQ ID NO: 20482 - RNA, 9873 nt, synthetic construct
  misc_feature 1..9873: note = derived and/or modified CDS sequence (opt5) from DENV-3__GU131938__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtggggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagtccatcgagggcaaagtggttcagtatgaaaacctgaagtacaccgtgattatcacagtccacacgggggaccagcatcaggtgggaaatgacacccaaggcgttacagtggagatcacaccccaggctagcacagtcgaagccgtgctgcctgagtatggcaccctcgggctggaatgctctccccgcacgggacttgatttcaacgagatgattctgctcaccatgaaaaataaggcttggatggtccacagacagtggtttttcgacctgcctcttccctggacatccggcgccaccacagagaccccgacgtggaaccggaaagaactgctcgtgacatttaagaatgcccatgctaaaaagcaagaggttgtggtcctggggagccaggaaggagcgatgcacaccgccctgacaggcgctaccgagatccagaactctgggggcacctccattttcgccggacacctcaagtgtcgcctgaaaatggataaacttgaactgaaaggcatgagctacgccatgtgcctcaatacatttgtgctgaagaaagaggtttccgagacgcagcatgggaccatcctgattaaggtggaatacaagggagaggacgctccttgtaaaatccccttctctacagaagatggccaagggaaggcccacaacggaagacttatcaccgcgaaccctgtcgtgaccaagaaggaggagcccgtgaatattgaagctgagccccctttcggcgaaagcaacatcgttattgggatcggcgacaaagccctcaagattaattggtataagaaaggatccagcatcggcaagatgtttgaggccaccgctagaggggccagacgcatggctatcctgggagatacggcctgggacttcggctctgtcgggggagtgctgaactccctcggcaaaatggtgcatcagatttttgggagcgcgtacacagccctgttctctggcgtcagctggatcatgaagattggaatcggcgtgcttctgacctggattgggctcaattccaaaaacacctctatgagcttttcctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgacagcccgaaacggctcgccaccgcgattgccggcgcttgggaaaacggagtctgtggcatcagatctacaacccgcatggagaatctgctgtggaagcagattgccaacgaactcaattatatcctgtgggagaacaatatcaaacttacagtggttgtgggggatattatcggagtcctggaacagggcaagcgggctctcacaccccagcctatggagctgaaatactcctggaagacgtgggggaaggccaaaattgtgaccgccgagacacaaaacagctctttcatcattgacggacccaacacccctgaatgcccctccgctagcagagcgtggaatgtgtgggaggtcgaagactatggctttggcgttttcacaaccaacatctggctgaaacttcgcgaggtgtacacacagtcctgtgatcatcggctcatgtctgccgctatcaaagacgaaagagccgtgcacgccgatatggggtactggattgagagccagaagaatggatcctggaaactggagaaggcttcttttatcgaagtcaagacctgcacgtggccgaaaagccacacactgtggtccaacggcgtgctcgagagcgacatgattatccctaagtctctggccgggcccatttcccagcataatcaccgccctggatatcatacccaaaccgcgggcccctggcaccttgggaaactggaactcgatttcaactactgcgagggaacaaccgttgtgatcgctgagaattgtggcacgcggggccctagcctgagaacaaccacagtctctgggaagctgatccacgaatggtgctgtcgctcctgcacccttcccccgctccggtatatgggagaggacggctgttggtacgggatggaaattagacctatcaacgagaaagaagagaatatggtcaagagcctggtttctgccggaagcggcaaggtggataactttacaatgggggtcctgtgcctcgccattctgttcgaggaagtgatgcggggaaaattcggcaagaaacatatgatcgctggcgttctttttaccttcgtgctgctcctgtccgggcagattacgtggcgcgacatggcccacaccctgatcatgattggaagcaatgcgtctgatagaatgggcatgggggtcacatatcttgctctgatcgccacctttaagatccagcccttcctcgccctgggatttttcctccggaaactgacatccagagagaaccttctgctcggcgtggggctggctatggccaccacgctgcaacttcccgaagacattgagcagatggctaatggaatcgccctgggcctcatgacactgaagctcattacccagtttgaaacataccagctgtggaccgcgcttgtgagcctgacctgttccaacacaatcttcacgctcaccgtcgcctggcgcacagctaccctgattctggccggcgtttctcttctgcctctctgccaaagctcctctatgcggaagacagattggctgccgatgaccgtggctgccatgggggtgccccctctccccctgtttatcttcagccttaaagacacgcctaagagacgctcctggcccctgaatgagggagtcatggccgtgggcctggtttctatcctcgctagctccctgcttagaaacgatgtgcctatggcggggcccctggtcgccggaggcctcctgattgcttgttatgtgatcacagggaccagcgccgacctcaccgttgagaaagccgctgacgtgacatgggaagaggaagccgagcagaccggagtctctcataacctgatgattacagtggatgacgatggcacgatgaagatcaaagacgatgaaaccgagaatattcttacagtcctgctgaagaccgcgctcctgatcgtgtccggcatctttccgtacagcattcctgctacacttctggtttggcacacctggcagaaacagacgcaacggtctggggtgctctgggacgtcccctcccctcccgagacccagaaggccgaactggaggaaggagtgtaccgcatcaagcagcagggcattttcgggaaaacacaagttggagtgggcgtccagaaggagggggtgtttcataccatgtggcacgtgacaagaggagccgttctcacccacaacggcaaacggctggagccgaattgggctagcgtcaagaaagatcttatctcttatggcgggggatggcgcctgtccgcccagtggcaaaagggcgaagaggtccaggtgattgcggtcgaacctgggaagaaccccaaaaatttccagacaatgcctggaatcttccagacgaccacaggcgagattggggctatcgccctggactttaagcccggaaccagcggctcccccatcattaacagagaaggcaaagtggttgggctctacggaaatggcgtggtcaccaagaacgggggatatgtgagcggcatcgcccaaacaaatgctgagcctgatgggccgacgcccgagctggaagaggaaatgttcaaaaagcggaaccttaccattatggacctgcatcctggctctggaaagacacgcaaatacctccccgccatcgttagagaggctattaagcggcgcctgagaaccctcatcctggcccctacacgggtggtcgcggccgaaatggaggaggctcttaaaggcctgcccatcagatatcagaccacggccacaaagagcgaacacaccgggcgcgagattgtggatctgatgtgccatgctacctttacaatgcggctcctgtcccctgttagagtgccgaattacaaccttgtcatcatggacgaagcccacttcaccgatcccgcctctattgctgcgcgcggatatatcagcacacgggtgggcatgggggaggccgctgccatttttatgaccgccacgcctcccggaacagctgaagccttccctcagtccaatgcgcccatccaggacgaggagagagacatcccggaacgctcttggaacagcggcaatgagtggattaccgattttgtggggaaaacagtctggttcgttccttccatcaaggctggcaacgacattgccaactgtctgcggaagaatggcaaaaaggtgatccaactctctagaaaaacctttgatacggaataccagaagacccgcctgaacgactgggatttcgtggtcacaaccgacattagcgagatgggagccaattttaaagctgatcgggtgatcgaccccagacggtgcctgaagcccgttattctcacagatgggcctgagcgcgtgatccttgccggacccatgcctgtcaccgcggcctccgctgcccagagacggggccgcgtggggagaaacccgcagaaggaaaatgaccaatacatcttcatgggacagcccctgaacaatgatgaggaccatgctcactggacagaagccaaaatgctgctcgacaacattaatacccctgaggctatcattcccgccctgttcgaacctgagcgggaaaagagcgcggccatcgatggcgaatatagacttaaaggggagtctcgcaagacgtttgttgaactgatgcggagaggcgacctccccgtgtggctggctcacaaagtcgcctccgagggaattaagtacacagatcgcaaatggtgcttcgacggcgaacggaacaatcagatcctggaggagaacatggatgtggaaatctggaccaaggagggggaaagaaagaaactccgcccgcggtggcttgacgctagaacctatagcgatcctctggccctgaaggagtttaaagacttcgccgctggacgcaagtctattgcgctcgatctggtcacagaaatcggcagagtgccctcccatcttgcccaccggacccgcaatgctctggacaacctcgttatgctgcatacaagcgagcacgggggacgggcctaccggcacgccgtggaggaactgcctgagacgatggaaaccctccttctgctgggcctcatgattctgcttacaggcggggctatgctgtttctcatctccggaaaaggcattgggaagacctctatcggactgatctgtgtgattgtcagctccggcatgctgtggatggccgatgttcccctccagtggatcgcgagcgccattgtgcttgagttctttatgatggtgctgctgatccctgagcccgaaaagcaacgcacaccgcaggacaatcagctcgcttatgtcgtgattgggatcctgacccttgccgctattgttgccgcgaacgagatgggactgctcgaaacgaccaaaagagatctgggcatgtctaaggagcctggcgtggtctcccccacaagctacctggacgtggacctccatcccgcctctgcttggaccctttatgccgtcgctacaaccgtgatcacgcctatgctgcggcacacaatcgaaaatagcaccgccaacgtttccctggctgccattgcgaaccaagccgtggtcctcatggggctggataaaggatggccgatctctaagatggaccttggcgtgcccctgctcgctctggggtgctacagccaggttaatcctctgacactcaccgccgctgtgcttctgctggtcacccattacgccattatcggacccggcctccaggccaaagcgacaagagaggctcagaagcgcacggccgctgggattatgaagaaccctaccgtggatggaatcatgacaatcgacctggatcccgtgatttatgactccaaattcgagaagcaacttggccaggttatgctgctcgtcctgtgtgccgtgcagctgctccttatgcggacctcttgggccctgtgcgaagctctgacactcgccaccggccctatcacgacactgtgggaggggagcccgggaaaattttggaataccaccattgcggtgtccatggccaacatcttcagaggcagctaccttgctggggccggactggctttttctattatgaagtccgtcggcacagggcgccggggaaccggcagccagggcgaaacactcggggagaaatggaagaagaaactgaatcaactgtccagaaaggagttcgatctctataaaaagtctggaatcacggaggttgaccggaccgaggccaaagaaggccttaagcgcggggagacaacccaccatgcggtgagcagaggatccgccaaactgcagtggtttgtggaacggaacatggtcatccccgagggccgcgtgattgatctggggtgtggaagaggcggctggtcttactattgcgctgggctcaagaaggttacagaagtgcggggatacaccaaaggcgggcctggacacgaggagcccgtccctatgagcacgtatggctggaatatcgtgaagctgatgtccgggaaagacgttttctaccttcccccggaaaagtgtgataccctgctctgcgacattggagagagctctccttcccccacagtggaagagagccgcaccatcagagtcctgaaaatggtggagccctggctgcggtctaaccagttctgtattaaggtgctcaatccttacatgcccacagtcatcgaacaccttgagcgcctgcagagaaagtatggcggcatgctggttcggaaccctctctccagaaatagcacccatgaaatgtactggatttctaacgggacaggaaatatcgtgagctccgtgaacatggtctctcgcctgcttctgaatcggtttaccatgacgcacagacgcccgacaatcgagaaagatgtggacctcggcgccgggacccggcatgttaacgctgaacccgagacccctaacatggacgtgattggagagagaatcaagcgcattaaagaagaacacagctccacatggcactatgatgacgaaaatccctacaagacgtgggcctatcatggcagctacgaggtcaaagctaccgggtccgcctctagcatgatcaacggagtggttaagctgctgacaaagccttgggatgtggtccccatggtgacccaaatggcgatgacagacaccacaccgttcggccagcagcgggtttttaaagaaaaggtggataccagaacgcctcgccccatgcctggcacccggaaagtcatggagattacagccgagtggctctggagaaccctggggcgcaataagaaaccccggctttgcacaagagaagagttcaccaagaaggtgcgcacgaacgctgccatgggagctgtctttacagaagagaatcaatgggactccgccagagccgcggtggaagatgaggagttctggaaactggttgacaaggaacgggagctccacaaactgggcaagtgtgggtcttgcgtgtataacatgatgggaaaacgcgaaaagaaacttggcgagtttgggaaggctaagggcagcagagccatctggtacatgtggctgggagcccggtacctcgagttcgaagctctgggctttctgaatgaggatcattggttctccagagaaaactcttatagcggggtcgagggagaaggcctccacaaactggggtacatccttcgggacatttccaagatccctggaggcgccatgtatgctgatgacaccgccgggtgggacacacgcattaccgaggatgacctgcataatgaggagaagatcacgcagcagatggatcccgagcacagacagctcgcgaacgccatttttaagctgacctaccaaaataaagtggtgaaggttcagcggccgacacctaagggcaccgtgatggacatcatcagccgcaaagatcagagaggatctggccaggtcgggacatatggacttaacaccttcacaaatatggaagctcaactggtgcggcagatggagggcgaaggggttctctccaaggccgacctggagaacccccatctgctcgagaaaaagattacccagtggctggaaacgaaaggagtggagcgccttaagagaatggctatcagcggcgatgactgcgtcgtgaagcccattgatgaccggtttgccaatgcgctgctcgccctgaacgatatggggaaagtccgcaaggacatccctcagtggcaaccgtctaaaggctggcatgattggcaacaggtgcccttctgttcccaccatttccacgaacttattatgaaggacggaagaaaactggttgtgccttgccggccccaggacgagctcatcggccgcgctagaatcagccaaggggccggatggtctctgaaggaaacagcttgtctgggcaaggcctacgctcagatgtggtccctcatgtattttcaccggcgcgatctgagacttgccagcaacgcgatttgctccgccgtccctgtgcattggatccccaccagccggaccacatggtctattcacgctcatcaccagtggatgaccacagaggacatgctgacggtttggaatagagtgtggatcgaggataacccttggatggaagacaaaacccccgtcacaacctgggaggatgtgccgtacctcgggaagcgcgaagaccaatggtgtggaagcctgattggccttacatcccgggccacctgggcccagaatatcctgacggctattcaacaggtgagatctctcatcggggatgaggagttcctggactacatgcctagcatgaaacgctttcggaaggaagaggaaaccgagggcgccatctggtga

SEQ ID NO: 20483 - RNA, 9873 nt, synthetic construct
  misc_feature 1..9873: note = derived and/or modified CDS sequence (opt5) from DENV-3__GU131939__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataagcttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgacaaaaaaggaggagcccattaatatcgaagctgagcctccgttcggcgaatctaacattgtgatcgggattggcgacaaagccctcaagatcaattggtataagaaaggaagctccatcggcaagatgtttgaggccaccgctcggggggccagacgcatggctattctgggagatacggcctgggacttcggcagcgttgggggagtcctgaactctctcggcaaaatggtgcatcagatctttgggtccgcgtacacagccctgttcagcggcgtgtcttggattatgaagatcggaattggcgtccttctgacctggatcgggctcaatagcaaaaacacctccatgtcttttagctgcattgtgatcggaatcattacactgtatctgggcgctgttgtgcaggccgatatggggtgtgtcatcaattggaagggaaaggaacttaaatgcggcaacgggattttcgtgaccaatgaggttcacacatggacggagcagtacaagtttcaagctgactcccccaaacggctcgccaccgcgatcgccggcgcttgggaaaacggagtgtgtggcattagaagcacaacccgcatggagaatctgctgtggaagcagatcgccaacgaactcaattatatcctgtgggagaacaatattaaacttacagtcgtggttggggatatcattggagtgctggaacagggcaagcggaccctcacgcctcagcccatggagctgaaatactcttggaagacctgggggaaggctaaaatcgtcacagccgagacccaaaactccagcttcattatcgacggacctaacacacccgaatgcccgtctgcctccagagcttggaatgtgtgggaggtggaagactatggctttggcgtcttcaccacaaacatctggctgaagcttcgcgaggtttacacccagagctgtgatcatcggctcatgtccgcggccattaaagacgaaagagctgtgcacgccgatatggggtactggatcgagtctcagaagaatggaagctggaaactggagaaggcctcctttattgaagtgaagacgtgcacatggcctaaatctcacaccctgtggagcaacggcgtcctcgagtccgacatgatcattcccaagagcctggctgggcctatctctcagcataatcaccgccccggatatcatacccaaacagccggcccttggcaccttgggaaactggaactcgatttcaactactgcgagggaaccacggtggttatcgcggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagaaaaagctggcctctgaatgagggagtgatggccgtcggcctggtgtccattctcgcctctagcctgcttcgcaacgatgttcccatggctgggccgctggtggcgggaggcctcctgatcgcctgttatgtcattaccgggacctccgctgacctcacagtggagaaggccgccgacgttacctgggaagaggaagctgagcagacaggagtgagccataacctgatgatcacggtcgatgacgatggcaccatgagaattaaagacgatgaaacagagaatatccttaccgtgctgctgaagacagccctcctgatcgtctctggcatttttccttactccatccccgcgacccttctggtgtggcacacgtggcagaaacagacccaacggagcggggttctctgggacgtgccttctcccccggagacacagaaggctgaactggaggaaggagtctaccgcattaagcagcagggcatcttcgggaaaacccaagtgggagttggcgtgcagaaggagggggtctttcatacaatgtggcacgtgaccagaggagccgtgctcacacacaacggcaaacggctggagcctaattgggcctccgttaagaaagatcttattagctatggcgggggatggcgcctgtctgctcagtggcaaaagggcgaagaggtccaggtgatcgccgtggaacccgggaagaaccctaaaaatttccagacgatgcccggaattttccagaccacaaccggcgagatcggggcgatcgctctggactttaagcccggaacctccggcagccctattatcaacagagaaggcaaagtcgtggggctctacggaaatggcgttgtgacaaagaacgggggatatgtctccggcattgcccaaacgaatgccgagccggatgggcccacccctgagctggaagaggaaatgttcaaaaagcggaaccttacaatcatggacctgcatcccggcagcggaaagacccgcaaatacctccctgctattgtgagagaggccatcaagcggcgcctgagaacactcatcctggctcccacccgggttgtggccgcggaaatggaggaggcccttaaaggcctgcctattagatatcagacgacagctaccaagtctgaacacaccgggcgcgagatcgtcgatctgatgtgccatgccacatttaccatgcggctcctgagcccggtgagagttcccaattacaaccttattatcatggacgaagctcacttcacagatcctgcctccattgccgctcgcggatatatctctacccgggtgggcatgggggaggcggccgctatctttatgacggccacaccccctggaaccgccgaagctttcccccagagcaatgccccgattcaggacgaggagagagacatccctgaacgctcctggaactctggcaatgagtggattacagattttgtcgggaaaaccgtgtggttcgtgcccagcatcaaggcgggcaacgacattgctaactgtctgcggaagaatggaaaaagagtcatccaactctcccgcaagacgtttgataccgaataccagaaaacacggctgaacgactgggatttcgttgtgaccacagacatttctgagatgggcgccaattttaaggccgatagagtgatcgacccccggcgctgcctgaaacctgtcatcctcaccgatgggcccgagagagtgattcttgctggacctatgccggttacagccgcgagcgccgctcagcggcgcggcagagtggggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtcgaactgatgagacgcggagacctcccggtgtggctggcgcacaaggttgcctctgagggcatcaaatacaccgatcggaagtggtgcttcgacggggaaagaaacaatcagattctggaggagaacatggatgtggaaatctggacaaaagagggagaacgcaagaagctccggcctagatggcttgacgctcgcacctattccgatcccctggccctgaaagagtttaaggacttcgctgccggcagaaaaagcattgccctcgatctggtcacagaaatcgggcgggtgccttctcatcttgctcaccgcacgagaaatgcgctggacaacctcgtcatgctgcatacctccgagcacggaggccgggcctaccgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgatgtgcctctccagtggatcgcttccgccattgtccttgagttctttatgatggttctgctgatccccgagccggaaaagcaaagaacgcctcaggacaatcagctcgcgtatgtggtgattggaatcctgacccttgccgctatcgtcgccgctaacgagatgggcctgctcgaaacaaccaagcgggatctgggcatgagcaaagagcccggggtggtttctcccacatcctacctggacgtggacctccatcctgccagcgcgtggaccctttatgccgtcgctacgacagtgattaccccgatgctgagacacacaatcgaaaattctaccgccaacgtcagcctggctgccattgctaaccaagccgtggttctcatgggactggataagggctggcccatctccaaaatggaccttggggtgcctctgctcgcgctgggatgctactctcaggtcaatcccctgaccctcacagccgctgtgcttctgctggttacgcattacgccattatcggccctgggctccaggctaaggccacccgcgaggcccagaaacggacagcggctggaatcatgaagaaccccaccgtggatggcattatgacaatcgacctggatcctgtcatttatgacagcaagttcgagaaacaacttggccaggtgatgctgctcgtgctgtgtgccgttcagctgctccttatgagaacctcctgggctctgtgcgaagccctgacgctcgccacagggccgatcaccaccctgtgggagggatctcccggcaagttttggaatacaaccattgctgtcagcatggccaacatcttccgcgggtcctaccttgcgggagccggcctggcttttagcatcatgaaatctgtggggacaggacggagaggcacgggctcccagggggaaaccctcggagagaagtggaaaaagaagctgaatcaactgagccggaaagaattcgatctctataagaaatccggcattacagaggtggaccgcaccgaggccaaggaagggcttaaaagaggagagacaacccaccatgctgtctctcggggcagcgccaagctgcagtggtttgttgaacgcaacatggtgatccctgaggggagagtgattgatctgggatgtggccggggcgggtggtcctactattgcgcgggactcaaaaaggtcacggaagtgcgcggctacaccaaggggggacccggccacgaggagcctgttcccatgtctacatatgggtggaatatcgtgaaactgatgagcggaaaggacgtcttctaccttccgcctgaaaaatgtgataccctgctctgcgacattggcgagtccagcccctctcccacagtggaagagtccagaaccatccgggttctgaagatggtggagccttggctgcgcaacaatcagttctgtattaaagtcctcaacccctacatgcctaatgtgatcgaacaccttgagagactgcagcggaagtatggcgggatgctggtgagaaacccgctcagccgcaattctacacatgaaatgtactggatctccaacggaaccggcaatattgtcagctctgttaacatggtgagccggctgcttctgaacagatttacgatgacacaccgccggcccaccatcgagaaggatgtggacctcggggccggaaccagacatgtcaatgctgaacctgagacacccaacatggacgtgattggcgagcgcatcaaacggattaaggaagagcactcctctacgtggcactatgatgacgaaaatccttacaaaacctgggcctatcatgggagctacgaggttaaggctacaggatccgccagctccatgatcaacggcgtggtcaaactgctgaccaagccctgggatgtggttccgatggtgacacaaatggctatgaccgacacaacccctttcggccagcagagagtctttaaggaaaaagtggatacgcgcaccccccggcctatgcccgggacaagaaaggttatggagatcaccgccgagtggctctggcgcacactgggacggaataaaaagcctagactttgcacccgcgaagagttcacgaaaaaggtgagaacaaacgcggccatgggcgctgtctttaccgaagagaatcaatgggactctgcccgggctgccgtggaagatgaggagttctggaagctggtcgacaaagaacgcgagctccacaagctggggaaatgtggaagctgcgtgtataacatgatgggcaagagagaaaaaaagcttggggagtttggcaaagccaagggatcccgggcgatttggtacatgtggctgggcgctagatacctcgagttcgaagccctggggtttctgaatgaggatcattggttctctcgggaaaacagctattccggagttgagggcgaagggctccacaagctgggatacatccttcgcgacatttctaaaatccccggcggggccatgtatgctgatgacacagccggctgggacaccagaattacggaggatgacctgcataatgaggaaaagatcacccagcagatggatccggagcaccggcagctcgctaacgccatctttaaactgacataccaaaataaggtggtcaaagtgcagcgccctacccccaagggaacagtgatggacattatcagcagaaaggatcagcggggctccgggcaggttggaacctatggccttaacacattcaccaatatggaagcgcaactggtgcgccagatggagggggaaggagtcctcagcgaggccgacctggagaacccccacctgctcgaaaaaaagattacgcagtggctggagacaaaaggcgtggaaagacttaagcggatggctatctctggggatgactgcgttgtgaaacctattgatgaccgctttgccaacgctctgctcgccctgaatgatatgggcaaggtcagaaaggacatcccgcagtggcaaccctccaaaggatggcatgattggcagcaggtgcctttctgtagccaccatttccacgagcttatcatgaaggacggccggaaactggtcgtgccctgccgccctcaggacgaactcattgggagagcgcggatctctcaaggagccggctggtccctgaaggagaccgcttgtctggggaaagcctacgctcagatgtggagcctcatgtattttcaccgcagagatctgcggcttgcctctaacgctatttgctccgccgttcccgtgcattggatccctaccagcagaacaacctggtccattcacgcgcatcaccagtggatgacaacggaggacatgctgaccgtctggaatcgcgtgtggatcgaagataacccctggatggaggacaagacaccggttaccacatgggaagatgtgccttacctcggaaagcgggaggaccaatggtgtggcagcctgattgggcttacctctagagccacgtgggctcagaatatcctgaccgccatccagcaggtccgcagcctcattggcgatgaggaattcctggactacatgccctccatgaaacggtttagaaaggaggaagagtctgaaggagccatctggtga

SEQ ID NO: 20484 - RNA, 9873 nt, synthetic construct
  misc_feature 1..9873: note = derived and/or modified CDS sequence (opt5) from DENV-3__GU131940__SS-prME
  source 1..9873: mol_type = other RNA
acaagcctgtgcctcatgatgatgctgcccgccacgcttgctttccacctgacgtcccgggacggcgaacctcggatgatcgtggggaagaacgaacgcggaaaatctctcctgtttaagacagcctccggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaagaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcaccgtggtccaggctgatatggggtgtgccattaattggaagggaaaggaacttaaatgcggctccgggatcttcgtgacaaacgaggttcacacgtggaccgagcagtacaagtttcaagctgacagccccaaacggctcgccacagcgattgccggcgcttgggaaaatggagtgtgtggcatcagatctaccacacgcatggagaacctgctgtggaagcagattgccaatgaactcaactatatcctgtgggagaataacatcaaacttaccgtcgtggttggggatattatcggagtgctggaacagggcaagcggacgctcacccctcagcccatggagctgaaatactcctggaagacatgggggaaggctaaaattgtcaccgccgagacacaaaatagctctttcatcattgacggacctaacacccccgaatgcccgtccgccagcagagcttggaacgtgtgggaggtggaagactatggctttggcgtcttcacaaccaatatctggctgaaacttcgcgaggtttacacgcagtcctgtgatcatcggctcatgtctgcggccatcaaagacgaaagagctgtgcacgccgatatggggtactggattgagagccagaagaacggatcctggaaactggagaaggcctcttttatcgaagtgaagacatgcacctggcctaaaagccacaccctgtggtccaatggcgtcctcgagagcgacatgattatccccaagtctctggctgggcctatttcccagcataaccaccgccccggatatcatacacaaaccgccggcccttggcaccttgggaaactggaactcgatttcaattactgcgagggaacgacagtggttatcaccgagaactgtggcacacggggccccagcctgagaaccacaaccgtgtctgggaagctgatccacgaatggtgctgtcgctcctgcacgcttccgcctctccggtatatgggagaggacggctgttggtacgggatggaaattagacccatcaatgagaaagaagagaacatggtcaagagcctggtgtctgcgggaagcggcaaggttgataattttaccatgggggtgctgtgcctcgctattctgttcgaggaagtcatgcggggaaaattcggcaagaaacatatgatcgccggcgtgctttttacattcgttctgctcctgtccgggcagattacctggcgcgacatggcccacacactgatcatgattggaagcaacgcttctgatagaatgggcatgggggtgacctatcttgccctgatcgcgacgtttaagatccagcccttcctcgctctgggatttttcctccggaaactgacatccagagagaatcttctgctcggcgtcgggctggccatggccaccacactgcaacttcctgaagacattgagcagatggctaacggaatcgccctgggcctcatgaccctgaagctcattacccagtttgaaacataccagctgtggacggctcttgtgagcctgacctgttccaatacaatcttcaccctcacagtggcctggcgcaccgcgacgctgattctggccggcgtctctcttctgccgctctgccaaagctcctctatgcggaagacagattggctgcccatgaccgttgctgccatgggggtgcctcccctccctctgtttatcttcagccttaaagacacccccaagagacgctcctggcctctgaacgagggagtgatggctgtcggcctggtgtctatcctcgccagctccctgcttagaaatgatgttcccatggccgggccgctggtggctggaggcctcctgattgcgtgttatgtcatcacagggaccagcgccgacctcacagtggagaaagctgccgacgttacgtgggaagaggaagccgagcagaccggagtgtctcataacctgatgattacagtcgatgacgatggcaccatgcggatcaaggacgatgaaacagagaacattcttaccgtgctgctgaaaacggctctcctgatcgtctccggcatctttccttacagcattcccgccacccttctggtgtggcacacatggcagaagcagacccaacgctctggggttctctgggacgtgccttctcccccggagacacagaaagcggaactggaggaaggagtctacagaatcaagcagcagggcattttcgggaagacccaagtgggagttggcgtgcagaaagagggggtctttcatacaatgtggcacgtgacgcggggagctgtgctcacccacaatggcaagcgcctggagcctaactgggccagcgttaaaaaggatcttatcagctatggcgggggatggagactgaatgcccagtggcaaaaaggcgaagaggtccaggtgattgctgtggaacccgggaagaaccctaagaatttccagacaatgcccggaatcttccagaccaccacaggcgagattggggccatcgcgctggactttaaacccggaacgtccggcagccctatcattaaccgggaaggcaaggtcgtggggctctacggaaatggcgttgtgaccaaaaacgggggatatgtctccggcatcgctcaaacaaatgccgagccggatgggcccacccctgagctggaagaggaaatgttcaagaaacgcaaccttacaattatggacctgcatcccggcagcggaaagaccagaaagtacctccctgccatcgtgcgggaggctattaaacgcagactgcggacgctcatcctggcccccacaagagttgtggctgccgaaatggaggaggcgcttaagggcctgcctatccgctatcagaccaccgccacaaaatctgaacacaccgggcgggagattgtcgatctgatgtgccatgctacatttaccatgagactcctgagcccggtgcgcgttcccaattacaaccttgtgatcatggacgaagcccacttcacggatcctgcttccattgccgcccggggatatatctctacaagagtcggcatgggggaggctgcggccatttttatgaccgctacaccccctggaaccgccgaagccttcccccagagcaatgctccgatccaggacgaggagcgcgacatccctgaacggtcctggaactctggcaatgagtggattacggattttgtggggaagaccgtgtggttcgtccccagcatcaaagccggcaacgacattgcgaactgtctgagaaagaatggaaagaaagttatccaactctcccgcaagacatttgataccgaataccagaaaacacggctgaacgactgggatttcgtggtgaccacagacatttctgagatgggcgctaattttaaggccgatagagtcatcgacccccggcgctgcctgaaacctgtgattctcaccgatgggcccgagagagttatccttgccggacctatgccggtgacggctgccagcgcggcccagcggcgcggcagagtcgggcggaacccccagaaggaaaatgaccaatacatcttcacaggacagcctctgaacaatgatgaggaccatgctcactggaccgaagccaagatgctgctcgacaacattaatacccccgagggcatcattcctgctctgttcgaacccgagagagagaaatccgccgctatcgatggggaatatcgccttaagggcgagagccggaaaacatttgtggaactgatgagacgcggagacctcccggtttggctggcctacaaggtggcgtctgagggcattaaatataccgatcggaagtggtgcttcgacggggaaagaaacaatcagatcctggaggagaacatggatgtcgaaatctggacaaaagagggagaacgcaagaagctccggcctagatggcttgacgcccgcacgtactccgatcccctggctctgaaagagtttaaggacttcgccgctggcagaaaaagcattgccctcgatctggtgaccgaaatcgggcgggtcccttctcaccttgcccatcgcacaagaaatgctctggacaacctcgtgatgctgcacacctccgagcatggaggccgggcgtatcgccacgccgttgaggaactgcccgagacaatggaaaccctccttctgctgggcctcatgattctgcttacaggcggggctatgctgtttctcatcagcgggaaggggattggaaaaacctccatcggcctgatctgtgtgattgtgtctagcgggatgctgtggatggccgatgtccctctccagtggatcgcctccgctattgttcttgagttctttatgatggtgctgctgatccccgagccggaaaagcaaagaacacctcaggacaatcagctcgcctacgtggtcattggaatcctgacccttgcggccattgtggctgccaacgagatgggcctgctcgaaacaaccaagcgggatctgggcatgagcaaagagcccggggttgtgtctcccacgtcctatctggacgtcgacctccaccctgctagcgcctggacactttacgcggtggccaccacagtcatcaccccgatgctgagacataccatcgaaaattctacagctaacgtgagcctggccgctattgccaaccaagctgttgtgctcatgggactggataagggctggcccatctccaaaatggaccttggggtccctctgctcgccctgggatgctactctcaggtgaatcccctgacgctcaccgcggccgttcttctgctggtgacacactatgctattatcggccctgggctccaggccaaggctacccgcgaggcccagaaacggacagccgcgggaattatgaagaaccccaccgtcgatggcatcatgacgatcgacctggatcctgtgatttacgacagcaagttcgagaaacaacttggccaggtgatgctgctcgttctgtgtgctgtccagctgctccttatgagaacatcctgggccctgtgcgaagctctgaccctcgccaccgggccgatcacaaccctgtgggagggatctcccggcaagttttggaatacaacgattgccgtgagcatggctaacatcttccgcgggtcctatcttgccggagcgggcctggcctttagcattatgaaatctgtggggaccggacggagaggcacaggctcccagggggaaaccctcggagagaagtggaaaaagaagctgaatcaactgagccggaaagagttcgatctctacaagaaatccggcatcacagaggtcgaccgcaccgaggctaaggaagggcttaaaagaggagagacgacccatcacgccgtttctcggggcagcgctaagctgcagtggtttgtggaacgcaacatggtgatccctgaggggagagtcattgatctgggatgtggccggggcgggtggtcctattactgcgccggactcaaaaaggtgacagaagttcgcggctataccaaagggggacccggccatgaggagcctgtgcccatgtctacatacgggtggaatatcgtcaaactgatgagcggaaaggacgtgttctaccttccgcctgaaaaatgtgataccctgctctgcgacattggcgagtccagcccctctcccacagttgaagagtccagaaccatccgggtgctgaagatggtcgagccttggctgcgcaacaatcagttctgtattaaagtgctcaacccctatatgcctacggtgatcgaacaccttgagagactgcagcggaagtacggcgggatgctggtcagaaatccgctcagccgcaactctacacacgaaatgtattggatttccaatggaaccggcaacatcgttagctctgtgaatatggtgagccggctgcttctgaacagatttaccatgacacatcgccggcccacgatcgagaaggatgtcgacctcggggcgggaaccagacacgtgaacgccgaacctgagacacccaatatggacgttattggcgagcgcatcaaacggattaaggaagaacactcctctacctggcactacgatgacgaaaacccttataaaacatgggcttaccacgggagctatgaggtgaaggccaccggatccgctagctccatgatcaatggcgtcgtgaaactgctgacaaagccctgggatgttgtgccgatggtcacccaaatggccatgacggacaccacacctttcggccagcagagagtgtttaaggaaaaagttgatacccgcacaccccggcctatgcccgggaccagaaaggtgatggagattacggctgagtggctctggcgcacactgggacggaacaaaaagcctagactttgcacccgcgaagagttcaccaagaaggtcagaaccaatgccgcgatgggcgccgtgtttacggaagagaaccaatgggactctgctcgggccgctgtcgaagatgaggagttctggaagctggtggaccgcgaaagagagctccataaactggggaagtgtggaagctgcgtttacaatatgatgggcaaacgggaaaagaaacttggggagtttggcaaggccaaaggatccagagccatctggtacatgtggctgggcgcgcggtatctcgagttcgaagctctggggtttctgaacgaggatcactggttctctcgcgaaaatagctactccggagtggagggcgaagggctccataagctgggatatatccttagagacatttctaagatccccggcggggccatgtacgccgatgacaccgctggctgggacacacggattaccgaggatgacctgcacaacgaggagaagatcacacagcagatggatccggagcatcgccagctcgccaatgctatttttaagctgacctatcaaaacaaagtcgtgaaggtgcagagacctacacccaaaggaaccgttatggacatcatcagccggaaggatcagcgcggctccggacaggtgggaacgtacggccttaatacattcaccaacatggaagcccaactggtcagacagatggagggggaaggagtgctcagcaaggcggacctggagaatccccatctgctcgagaaaaagattacccagtggctggaaacaaaaggcgttgagcggcttaagcgcatggccatctctggggatgactgcgtggtcaaacctattgatgacagatttgctaacgccctgctcgctctgaacgatatgggcaaggtgcggaaggacatcccgcagtggcaaccctccaaaggatggcacgattggcagcaggtccctttctgtagccatcacttccatgaacttattatgaaggacggccgcaaactggtggttccctgcagacctcaggacgagctcatcgggcgggcccgcatctctcaaggagcgggctggtccctgaaggaaaccgcctgtctggggaaggcttatgcccagatgtggagcctcatgtactttcacagacgggatctgagacttgcttctaatgccatttgctccgctgtgcccgtccactggatccctacaagccgcacgacctggtccattcatgcccaccatcagtggatgacaaccgaggacatgctgacagtgtggaaccgggtttggatcgaggataatccctggatggaagacaagaccccggtgacgacctgggaggatgtcccttacctcggaaagagagaagaccaatggtgtggcagcctgattgggcttacatctcgcgcgacctgggcccagaacatcctgacagctattcaacaggtgcggagcctcatcggcgatgaggagttcctggactatatgccctccatgaaaagatttcgcaaggaagaggaatctgagggagccatctggtga

SEQ ID NO: 20485 - RNA, 9873 nt, synthetic construct
  misc_feature 1..9873: note = derived and/or modified CDS sequence (opt5) from DENV-3__GU131942__SS-prME
  source 1..9873: mol_type = other RNA
acaagcctgtgcctcatgatgatgttccccgccaccctggcttttcaccttacgtcccgggacggcgagcctcggatgatcgtggggaagaacgaacgcggaaaatctctcctgttcaagaccgccagcggcattaatatgtgtacactgatcgcgatggatcttggggagatgtgcgacgataccgtcacatacaaatgtccgctgattgctgaagttgagcccgaagacatcgattgctggtgtaacctcacctccacatgggtgacctatggaacgtgcaatcaggccggcgagcaccggcgggacaagcgctctgtggccctggctcctcacgtcgggatgggactggataccagaacacagacctggatgagcgccgagggcgcttggagacaggtggaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagtccaaacccacgctggacatcgagctccagaagaccgaagctacacaactggccacccttcgcaaactgtgtattgagggaaagatcacaaatattaccacggatagcagatgccctacacagggcgaagcgaccctcccggaggaacaggaccagaactatgtgtgtaaacacacctacgtggatcggggctgggggaatggatgcggcctgtttgggaagggatctcttgtcacatgcgccaagttccaatgtctggagcccatcgagggcaaagtggttcagtatgaaaacctcaagtacaccgtgattatcacagtccacacgggggaccagcatcaggtgggaaatgacacccaaggcgttacagtggagatcacccctcaggcttccacagtcgaagccgtgctgcccgagtatggcaccctggggctcgaatgcagccctcgcacgggactggattttaacgagatgattcttctgaccatgaaaaataaggcttggatggtccacagacagtggttctttgacctccccctgccgtggacatctggcgccaccacagagacccctacgtggaaccggaaagaacttctggtgacattcaagaatgcccatgctaaaaagcaagaggttgtggtcctcgggtcccaggaaggagcgatgcacaccgccctgacaggcgctaccgagatccagaacagcgggggcacctctatttttgccggacacctgaagtgtcgcctcaaaatggataagctggaacttaaaggcatgtcctacgccatgtgcctgaatacattcgtgctcaagaaagaggttagcgagacgcagcatgggaccatcctgattaaggtggaatacaagggagaggacgctccctgtaaaatccctttctccacagaagatggccaagggaaggcccactctggaagactgatcaccgcgaaccccgtcgtgaccaagaaggaggagcccgtgaacattgaagctgagcctccgtttggcgaaagcaatatcgttattgggatcggcgacaaagcccttaagattaactggtataagaaaggatccagcatcggcaagatgttcgaggccaccgctagaggggctagacgcatggctatcctcggagatacggcctgggactttggctctgtcgggggagtgctgaatagcctgggcaaaatggtgcatcagattttcgggagcgcgtacacagccctcttttctggcgtcagctgggtgatgaagatcggaattggcgttctgcttacctggatcgggctgaactccaaaaatacctctatgagcttctcctgcattgtgatcggaattatcacactctatctgggcgctgtcgtgcaggccgatatggggtgtgttatcaactggaagggaaaggaactgaaatgcggcagcgggatttttgtgaccaatgaggtccacacatggacggagcagtacaagttccaagctgactctcccaaacggcttgccaccgcgatcgccggcgcttgggaaaacggagtgtgtggcattagatccacaacccgcatggagaatctcctgtggaagcagatcgccaacgaactgaattatattctctgggagaacaatatcaaactgacagttgtggtcggggatatcattggagtgcttgaacagggcaagcggaccctgacgcctcagcccatggagctcaaatacagctggaagacctgggggaaggctaaaatcgtgacagccgagacccaaaactcttcctttattatcgacggacctaatacacccgaatgcccgagcgcctccagagcttggaacgtctgggaggttgaagactatggcttcggcgtgtttaccacaaacatttggctgaagctgcgcgaggtgtacacccagtcttgtgatcatcggcttatgagcgcggccatcaaagacgaaagagctgtccacgccgatatggggtactggatcgagtcccagaagaatggatcttggaaactcgagaaggccagcttcattgaagtgaagacgtgcacatggcctaaatcccacaccctgtggagcaacggcgttctggagtctgacatgatcattcccaagtccctcgctgggcctatcagccagcataatcaccgccccggatatcatacccaaacagccggcccttggcacctggggaaacttgaactggattttaactactgcgagggaaccacggtggtcattacagagaattgtggcacccggggcccctctctcagaacaaccacagtgtccgggaagctgatccacgaatggtgctgtcgcagctgcaccctgccgcctcttcggtatatgggagaggacggctgttggtacgggatggaaatcagacccattaacgagaaagaagagaatatggttaagtctctcgtgagcgcgggatccggcaaggtcgataacttcacgatgggggtgctgtgcctggctatcctcttcgaggaagttatgcggggaaaatttggcaagaaacatatgattgccggcgtgctgttcacctttgtccttctgctcagcgggcagatcacatggcgcgacatggcccacaccctgattatgatcggatctaatgcttccgatagaatgggcatgggggtgacatatctggcccttattgcgaccttcaagatccagccctttctggctctcggattctttctgcggaaactcacgagcagagagaacctgcttctgggcgtggggctcgccatggccacaaccctgcaactgcctgaagacatcgagcagatggctaatggaattgcccttggcctgatgacactcaagctgatcacccagttcgaaacctaccagctctggacagctctggtctcccttacgtgttctaacaccgtttttacactgaccgtggcctggcgcacagcgaccctcattctggccggcgtgagcctgcttccgctgtgccaatcctctagcatgcggaagacggattggctccccatgacagtcgctgccatgggggtgcctcccctgcctctcttcatcttttccctgaaagacacccccaagagacgctcttggcctcttaatgagggagttatggctgtgggcctggtcagcattctggcctccagcctcctgagaaacgatgtgcccatggccgggccgcttgttgctggaggcctgctcatcgcgtgttatgtgatcaccgggacatctgccgacctgaccgtcgagaaagctgccgacgtgacatgggaagaggaagccgagcagacgggagtctcccataatctcatgattaccgtggatgacgatggcacaatgcggatcaaggacgatgaaaccgagaacattctgacagttcttctgaaaaccgctctgctcatcgtgagcggcattttcccttactctatccccgccacgctgcttgtctggcacacctggcagaagcagacacaacgctccggggtgctgtgggacgttccttctcccccggagacccagaaagcggaactcgaggaaggagtgtacagaatcaagcagcagggcatttttgggaagacacaagtcggagtgggcgtgcagaaagagggggttttccataccatgtggcacgtcacacggggagctgtgctgacgcacaacggcaagcgcctcgagcctaattgggcctccgtgaaaaaggatctgatctcctatggcgggggatggagacttaacgcccagtggcaaaaaggcgaagaggtccaggtgattgctgttgaacccgggaagaatcctaagaacttccagaccatgcccggaatctttcagacaaccaccggcgagattggggccatcgcgctggacttcaaacccggaacaagcggctcccctattatcaatcgggaaggcaaggtggtcgggctgtacggaaacggcgtggttacgaaaaatgggggatatgtgagcggcatcgctcaaaccaacgccgagccggatgggcccacacctgagctcgaagaggaaatgtttaagaaacgcaatctgaccattatggaccttcatcccggctctggaaagacaagaaagtacctgcctgccatcgtccgggaggctattaaacgcagactccggaccctgatcctcgcccccacgagagtggttgctgccgaaatggaggaggcgctgaagggccttcctattcgctatcagacaaccgccaccaaaagcgaacacacagggcgggagatcgtggatctgatgtgccatgctaccttcacaatgagactgctctccccggtccgcgtgcccaactacaatctggtgatcatggacgaagcccactttaccgatcctgcttctattgccgcccggggatatatcagcacgagagtcggcatgggggaggctgcggccattttcatgacagctacaccccctggaacagccgaagcctttccccagtccaacgctccgatccaggacgaggagcgcgacattcctgaacggtcttggaatagcggcaacgagtggatcaccgatttcgttgggaagacggtgtggtttgtgccctccatcaaagccggcaatgacattgcgaactgtcttagaaagaacggaaagaaagtcatccaactgtctcgcaagaccttcgatacagaataccagaaaacccggctcaatgactgggattttgtggttacaaccgacattagcgagatgggcgctaacttcaaggccgatagagtgatcgacccccggcgctgcctgaaacctgtcattctgacagatgggcccgagagagtgatcctcgccggacctatgccggttaccgctgcctccgcggcccagcggcgcggcagagtggggcggaatccccagaaggaaaacgaccaatacattttcacgggacagcctcttaataacgatgaggaccatgctcactggacagaagccaagatgctgctggacaatatcaacacccccgagggcatcattcctgctctctttgaacccgagagagagaaaagcgccgctatcgatggggaatatcgcctgaagggcgagtctcggaaaaccttcgtcgaacttatgagacgcggagacctgccggtgtggctcgcccacaaggtcgcgtccgagggcattaaatacacagatcggaagtggtgctttgacggggaaagaaataaccagatcctggaggagaatatggatgtggaaatttggaccaaagagggagaacgcaagaagctgcggcctagatggctcgacgcccgcacatatagcgatccccttgctctgaaagagttcaaggactttgccgctggcagaaaatctatcgccctggatctcgttacggaaatcgggcgggtgccttcccatctggcccaccgcaccagaaacgctcttgacaatctggtgatgctccatacaagcgagcacggaggccgggcgtaccgccacgccgtcgaggaactgcccgagaccatggaaacactgctccttctgggcctgatgattctcctgaccgggggagctatgcttttcctgatctccggcaaggggattggaaaaacgtctatcggcctcatttgtgttatcgtgagctccgggatgctgtggatggccgatgtgcctctgcagtggatcgccagcgctattgtcctcgagtttttcatgatggtgcttctgatccccgagccggaaaagcaaagaacccctcaggacaaccagctggcctatgttgtgattggaatcctcacactggcggccattgtcgctgccaatgagatgggccttctggaaaccacaaagcgggatctcggcatgtctaaagagcccggggtggtctcccccaccagctacctggacgtggacctgcatcctgcttctgcctggacgctctatgcggttgccacaaccgtgatcacaccgatgcttagacacaccattgaaaacagcaccgctaatgtctccctggccgctatcgccaaccaagctgtggttctgatgggactcgataagggctggcccatctctaaaatggacctgggggtgcctcttctggccctcggatgctacagccaggtcaaccccctgacactgacggcggccgtgctccttctggtgacccattacgctattatcggccctgggctgcaggccaaggctacacgcgaggcccagaaacggaccgccgcgggaattatgaagaatcccacagttgatggcatcatgaccattgacctcgatcctgtcatctatgactccaagtttgagaaacaactgggccaggtgatgcttctggtgctctgtgctgtccagctgctgctcatgagaacgtcttgggccctttgcgaagctctgacactggccaccgggccgatcaccacactctgggagggaagccccggcaagttctggaacaccacaattgccgtttccatggctaatatctttcgcgggagctacctggccggagcgggccttgccttctctattatgaaatccgtgggggctggacggagaggcacgggcagccagggggaaaccctgggagagaagtggaaaaagaagctcaaccaactgtcccggaaagaatttgatctgtataagaaatctggcatcacagaggtggaccgcaccgaggccaaggaagggctcaaaagaggagagacaacccaccatgctgtcagccggggctccgccaaacttcagtggttcgtggaacgcaatatggttattcctgaggggagagtgatcgatctgggatgtggccggggcgggtggtcttactattgcgcgggactgaaaaaggtcacggaagtgcgcggctacaccaaagggggacccggccacgaggagcctgttcccatgagcacatatgggtggaacatcgtgaaactcatgtccggaaaggacgtcttctacctgccgcctgaaaaatgtgatacccttctgtgcgacattggcgagagctctccctcccccacagtggaagagagcagaaccatccgggtgctcaagatggtcgagccttggctgcgcaataaccagttttgtattaaagttctgaatccctacatgcctacagtgatcgaacacctcgagagacttcagcggaagtatggcgggatgctggtgagaaacccgctgtctcgcaattccacccatgaaatgtactggattagcaacggaacgggcaatatcgtctctagcgtgaacatggtttcccggctcctgcttaatagattcacaatgacccaccgccggcccaccattgagaaggatgtggacctgggggccggaacaagacatgtcaacgctgaacctgagacgcccaacatggacgtgatcggcgagcgcatcaaacggattaaggaagaacactctagcacctggcactatgatgacgaaaatccttacaaaacatgggcctatcatgggtcctacgaggttaaggctaccggaagcgcctcctctatgatcaacggcgtggtcaaactcctgacaaagccctgggatgtggttccgatggtgacccaaatggctatgacagacaccacgccttttggccagcagagagtcttcaaggaaaaagtggatacccgcacaccccggcctatgcccgggaccagaaaggtcatggagattacagccgagtggctgtggcgcaccctcggacggaataaaaagcctagactgtgcacgcgcgaagagtttaccaagaaggtgagaaccaacgcggccatgggcgctgttttcacagaagagaatcaatgggacagcgcccgggctgccgtggaagatgaggagttttggaaacttgtcgaccgcgaaagagagctgcacaaactcgggaagtgtggatcctgcgtgtataacatgatgggcaaacgggaaaagaaactgggggagttcggcaaggccaaaggatctagagcgatctggtacatgtggcttggcgctcggtacctggagtttgaagccctcgggttcctgaatgaggatcattggtttagccgcgaaaactcctattctggagtggagggcgaagggctgcacaagctcggatacattctgagagacatcagcaagatccccggcggggccatgtatgctgatgacaccgccggctgggacacgcggattaccgaggatgaccttcataatgaggagaagatcacacagcagatggatccggagcaccgccagctggctaacgccattttcaagctcacctaccaaaataaagttgtgaaggtccagagacctacacccaaaggaaccgtgatggacatcatttcccggaaggatcagcgcggcagcgggcaggttggaacatatggcctgaacacctttacgaatatggaagcgcaacttgtgagacagatggagggggaaggagtcctgtctaaggccgacctcgagaacccccatctgctggagaaaaagatcacacagtggctcgaaaccaaaggcgtggagcggctgaagcgcatggctatctccggggatgactgcgtcgtgaaacctattgatgacagattcgccaatgcccttctggccctcaacgatatgggcaaggttcggaaggacatcccgcagtggcaacccagcaaaggatggcatgattggcaacaggtgcctttctgttctcaccattttcacgaactgattatgaaggacggccgcaaacttgtcgtgccctgcagacctcaggacgagctgatcgggcgggcgcgcatttcccaaggagccggctggagcctcaaggaaaccgcttgtctggggaaagcctacgctcagatgtggtctctgatgtatttccacagacgggatctcagactggcctccaacgctatctgcagcgccgttcccgtgcattggatccctacatcccgcaccacatggagcattcacgcgcatcaccagtggatgacgaccgaggacatgcttacagtctggaatcgggtgtggatcgaggataacccctggatggaagacaagaccccggtgacaacctgggaggatgttccttacctgggaaagagagaagaccaatggtgtggctctctcattgggctgacgagccgcgccacctgggctcagaatatccttacagccattcagcaggtccggtccctgatcggcgatgaggagtttctcgactacatgccctctatgaaaagattccgcaaggaagaggaaagcgagggagccatttggtga

SEQ ID NO: 20486 - RNA, 9873 nt, synthetic construct
  misc_feature 1..9873: note = derived and/or modified CDS sequence (opt5) from DENV-3__GU131943__SS-prME
  source 1..9873: mol_type = other RNA
accagcctgtgcctcatgatgatgctgcccgccacccttgctttccacctgacgtcccgggacggagaacctcggatgatcgtggggaagaacgaacgcggaaagtctctcctgtttaagaccgcctccggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctatctggaaccggaaagaactgctcgtgacgtttaagaatgcccatgctaaaaagcaagaggttgtggtcctggggtcccaggaaggagcgatgcacacagccctgaccggcgctacagagattcagaacagcgggggcacctctatcttcgccggacacctcaagtgtcgcctgaaaatggataaacttgaactgaaaggcatgtcctacgccatgtgcctcaatacctttgtgctgaagaaagaggttagcgagacacagcatgggacgattctgatcaaggtggaatacaagggagaggacgctccctgtaaaatccctttctccaccgaagatggccaagggaaggcccacaacggaagacttattacagcgaaccccgtcgtgaccaaaaaggaggagcccgtgaatatcgaagctgagcctccgttcggcgaatctaacattgttatcgggattggcgacaaagccctcaagatcaattggtataagaaaggaagctccatcggcaagatgtttgaggccacagctagaggggccagacgcatggctattctgggagataccgcctgggacttcggcagcgtcgggggagtgctgaactctctcggcaaaatggtgcatcagatctttgggtccgcgtacacggccctgttcagcggcgtctcttggattatgaagatcggaattggcgtgcttctgacatggatcgggctcaatagcaaaaacacctccatgtcttttagctgcattgttatcggaatcattaccctgtatctgggcgctgtggtccaggccgatatggggtgtgctatcaattggaagggaaaggaacttaaatgcggctccgggattttcgtgacaaacgaggttcacacctggacagagcagtacaagtttcaagccgacagccccaaacggctcgcgacggccatcgctggcgcctgggaaaatggagtgtgtggcattagatctaccacacgcatggagaacctgctgtggaagcagatcgctaatgaactcaactatatcctgtgggagaataacattaaacttaccgtcgtggttggggatatcattggagtgctggaacagggcaagcggacactcacccctcagcccatggagctgaaatactcctggaagacgtgggggaaggccaaaatcgtcaccgccgagacacaaaatagctctttcattatcgacggacctaacacccccgaatgcccgtccgctagcagagcgtggaacgtgtgggaggtggaagactatggctttggcgtcttcacaaccaatatctggctgaaacttcgcgaggtttacacacagtcctgtgatcatcggctcatgtctgccgctattaaagacgaaagagccgtgcacgccgatatggggtactggatcgagagccagaagaacggatcctggaaactggagaaggcttcttttattgaagtgaagacctgcacgtggcctaaaagccacacactgtggtccaatggcgtcctcgagagcgacatgatcattcccaagtctctggccgggcctatctcccagcataaccaccgccccggatatcatacccaaaccgcgggcccttggcaccttgggaaactggaactcgatttcaattactgcgagggaacaaccgtggttatcacggagaactgtggcacacggggccccagcctgagaaccacaaccgtgtctgggaagctgattcacgaatggtgctgtcgctcctgcacacttccgcctctccggtatatgggagaggacggctgttggtacgggatggaaatcagacccattaatgagaaagaagagaacatggtcaagagcctggtgtctgctggaagcggcaaggttgataattttaccatgggggtgctgtgcctcgccatcctgttcgaggaagtcatgcggggaaaattcggcaagaaacatatgattgccggcgtgctttttacgttcgttctgctcctgtccgggcagatcacctggcgcgacatggctcacacactgattatgatcggaagcaacgcctctgatagaatgggcatgggggtgacctatcttgcgctgatcgctacatttaagattcagcccttcctcgccctgggatttttcctccggaaactgacctccagagagaatcttctgctcggcgtcgggctggccatggctacgacactgcaacttcctgaagacatcgagcagatggccaacggaattgctctgggcctcatgaccctgaagctcatcacacagtttgaaacctaccagctgtgggccgcgcttgtgagcctgacctgttccaatacaattttcacgctcaccgtggcctggcgcacagctaccctgatcctggccggcgtctctcttctgccgctctgccaaagctcctctatgcggaagacagattggctgcccatgaccgttgctgccatgggggtgcctcccctccctctgtttatcttcagccttaaagacacgcccaagagacgctcctggcctctgaacgagggagtgatggccgtcggcctggtgtctattctcgctagctccctgcttagaaatgatgttcccatggcggggccgctggtggccggaggcctcctgatcgcttgttatgtcattacagggaccagcgccgacctcaccgtggagaaagccgctgacgttacatgggaagaggaagccgagcagaccggagtgtctcataacctgatgatcacagtcgatgacgatggcacgatgcggattaaggacgatgaaaccgagaacatccttacagtgctgctgaaaaccgcgctcctgatcgtctccggcatttttccttacagcatccccgctacacttctggtgtggcacacctggcagaagcagacgcaacgctctggggttctctgggacgtgccttctcccccggagacccagaaagccgaactggaggaaggagtctacagaattaagcagcagggcatcttcgggaagacacaagtgggagttggcgtgcagaaagagggggtctttcataccatgtggcacgtgacacggggagccgtgctcacccacaatggcaagcgcctggagcctaactgggctagcgttaaaaaggatcttattagctatggcgggggatggagactgaatgcccagtggcaaaaaggcgaagaggtccaggtgatcgcggtggaacccgggaagaaccctaagaatttccagacaatgcccggaattttccagacgaccacaggcgagatcggggctatcgccctggactttaaacccggaacctccggcagccctattatcaaccgggaaggcaaggtcgtggggctctacggaaatggcgttgtgaccaaaaacgggggatatgtctccggcattgcccaaacaaatgctgagccggatgggcccacgcctgagctggaagaggaaatgttcaagaaacgcaaccttaccatcatggacctgcatcccggcagcggaaagacaagaaagtacctccctgccattgtgcgggaggctatcaaacgcagactgcggaccctcatcctggcccccacaagagttgtggcggccgaaatggaggaggctcttaagggcctgcctattcgctatcagaccacggccacaaaatctgaacacaccgggcgggagatcgtcgatctgatgtgccatgctacctttacaatgagactcctgagcccggtgcgcgttcccaattacaaccttgtgattatggacgaagcccacttcaccgatcctgcctccatcgctgcgcggggatatatttctacaagagtcggcatgggggaggccgctgccatctttatgaccgccacgccccctggaacagctgaagccttcccccagagcaatgcgccgatccaggacgaggagcgcgacattcctgaacggtcctggaactctggcaatgagtggatcaccgattttgtggggaagacagtgtggttcgtccccagcattaaagctggcaacgacatcgccaactgtctgagaaagaatggaaagaaagttattcaactctcccgcaagacctttgatacggaataccagaaaacccggctgaacgactgggatttcgtggtgacaaccgacatctctgagatgggcgccaattttaaggctgatagagtcattgacccccggcgctgcctgaaacctgtgatcctcacagatgggcccgagagagttatccttgccggacctatgccggtgaccgcggccagcgctgcccagcggcgcggcagagtcgggcggaacccccagaaggaaaatgaccaatacattttcacaggacagcctctgaacaatgatgaggaccatgctcactggaccgaagccaagatgctgctcgacaacatcaatacgcccgagggcattatccctgctctgttcgaacccgagagagagaaatccgccgcgattgatggggaatatcgccttaagggcgagagccggaaaacatttgtggaactgatgagacgcggagacctcccggtttggctggcccacaaggtggcttctgagggcatcaaatacaccgatcggaagtggtgcttcgacggggaaagaaacaatcagatcctggaggagaacatggatgtcgaaatttggaccaaagagggagaacgcaagaagctccggcctagatggcttgacgcccgcacatattccgatcccctggctctgaaagagtttaaggacttcgccgccggcagaaaaagcatcgctctcgatctggtgaccgaaattgggcgggtcccttctcatcttgcgcaccgcacaagaaatgccctggacaacctcgtgatgctgcatacgtccgagcacggaggccgggcttaccgccacgccgttgaggaactgcccgagaccatggaaacactccttctgctgggcctcatgatcctgcttaccgggggagccatgctgtttctcattagcggcaaggggatcggaaaaacatccatcggcctgatttgtgtgatcgtgtctagcgggatgctgtggatggctgatgtccctctccagtggattgcctccgcgatcgttcttgagttctttatgatggtgctgctgattcccgagccggaaaagcaaagaacccctcaggacaatcagctcgcctatgtggtcatcggcattctgacgcttgctgccatcgtggctgccaacgagatgggcctgctcgaaaccacaaagcgggatctgggcatgagcaaagagcccggggttgtgtctcccacctcctacctggacgtcgacctccatcctgcgagcgcctggacactttatgctgtggccaccacggtcatcacaccgatgctgagacacaccattgaaaattctacagctaacgtgagcctggccgctatcgccaaccaagcggttgtgctcatgggactggataagggctggcccatttccaaaatggaccttggggtccctctgctcgccctgggatgctactctcaggtgaatcccctgaccctcaccgctgccgttcttctgctggtgacacattacgctatcattggccctgggctccaggccaaggccacgcgcgaggcgcagaaacggaccgctgccggaatcatgaagaaccccacagtcgatggcatcatgaccattgacctggatcctgtgatctatgacagcaagttcgagaaacaacttggccaggtgatgctgctcgttctgtgtgctgtccagctgctccttatgagaacatcctgggccctgtgcgaagccctgaccctcgctacggggccgattacaaccctgtgggagggatctcccggcaagttttggaataccacaatcgccgtgagcatggcgaacattttccgcgggtcctaccttgccggagctggcctggcctttagcatcatgaaatctgtggggaccggacggagaggcacaggctcccagggggaaacgctcggagagaagtggaaaaagaagctgaatcaactgagccggaaagagttcgatctctataagaaatccggcatcaccgaggtcgaccgcacagaggctaaggaagggcttaaaagaggagagaccacacaccatgccgtttctcggggcagcgcgaagctgcagtggtttgtggaacgcaacatggtgattcctgaggggagagtcatcgatctgggatgtggccggggcgggtggtcctactattgcgccggactcaaaaaggtgaccgaagttcgcggctacacgaaaggcgggcccgggcacgaggagcctgtgcccatgtctacctatgggtggaatattgtcaaactgatgagcggaaaggacgtgttctaccttccgcctgaaaaatgtgatacactgctctgcgacatcggcgagtccagcccctctcccaccgttgaagagtccagaacaattcgggtgctgaagatggtcgagccttggctgcgcaacaatcagttctgtatcaaagtgctcaacccctacatgcctaccgtgattgaacaccttgagagactgcagcggaagtatggcgggatgctggtcagaaatccgctcagccgcaactctacacatgaaatgtactggatctccaatggaaccggcaacatcgttagctctgtgaatatggtgagccggctgcttctgaacagatttacgatgacacaccgccggcccaccattgagaaggatgtcgacctcggggctggaaccagacatgtgaacgccgaacctgagacacccaatatggacgttatcggcgagcgcattaaacggatcaaggaagaacactcctctacgtggcactatgatgacgaaaacccttacaaaacctgggcttatcatgggagctacgaggtgaaggccacaggatccgctagctccatgattaatggcgtcgtgaaactgctgaccaagccctgggatgttgtgccgatggtcacacaaatggccatgaccgacacaacccctttcggccagcagagagtgtttaaggaaaaagttgatacgcgcacaccccggcctatgcccgggacaagaaaggtgatggagatcaccgcggagtggctctggcgcacactgggacggaacaaaaagcctagactttgcacccgcgaagagttcacgaaaaaggtcagaacaaatgccgctatgggcgccgtgtttaccgaagagaaccaatgggactctgctcgggccgccgtcgaagatgaggagttctggaagctggtggaccgcgaaagagagctccacaaactggggaagtgtggaagctgcgtttataatatgatgggcaaacgggaaaagaaacttggggagtttggcaaggcgaaaggatccagagctatctggtacatgtggctgggcgcccggtacctcgagttcgaagccctggggtttctgaacgaggatcattggttctctcgcgaaaatagctattccggagtggagggcgaagggctccacaagctgggatacattcttagagacatctctaagattcccggcggggctatgtatgccgatgacacagctggctgggacacccggatcacggaggatgacctgcataacgaggagaagattacccagcagatggatccggagcaccgccagctcgccaatgcgatctttaagctgacataccaaaacaaagtcgtgaaggtgcagagacctacccccaaaggaacagttatggacatcattagccggaaggatcagcgcggctccggacaggtgggaacctatggccttaatacattcaccaacatggaagcccaactggtcagacagatggagggggaaggagtgctcagcaaggctgacctggagaatccccatctgctcgagaaaaagatcacgcagtggctggaaacaaaaggcgttgagcggcttaagcgcatggccatttctggggatgactgcgtggtcaaacctatcgatgacagatttgctaacgccctgctcgcgctgaacgatatgggcaaggtgcggaaggacattccgcagtggcaaccctccaaaggatggcatgattggcagcaggtccctttctgtagccaccatttccacgaacttatcatgaaggacggccgcaaactggtggttccctgcagacctcaggacgagctcatcgggcgggcccgcatttctcaaggagctggctggtccctgaaggaaaccgcctgtctggggaaggcttacgcccagatgtggagcctcatgtattttcacagacgggatctgagacttgcttctaatgccatctgctccgcggtgcccgtccattggattcctaccagccgcacaacctggtccatccacgcccatcaccagtggatgacaacggaggacatgctgaccgtgtggaaccgggtttggattgaggataatccctggatggaagacaagacaccggtgaccacatgggaggatgtcccttacctcggaaagagagaagaccaatggtgtggcagcctgatcgggcttacctctcgcgctacgtgggcccagaacattctgaccgccatccaacaggtgcggagcctcatcggcgatgaggagttcctggactacatgccctccatgaaaagatttcgcaaggaagaggaatctgagggagctatttggtga

SEQ ID NO: 20487 - RNA, 9873 nt, synthetic construct
  misc_feature 1..9873: note = derived and/or modified CDS sequence (opt5) from DENV-3__GU131945__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtggggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagtccatcgagggcaaagtggttcagtatgaaaacctgaagtacaccgtgattatcacagtccacacgggggaccagcatcaggtgggaaatgacacccaaggcgttacagtggagatcacaccccaggctagcacagtcgaagccgtgctgcctgagtatggcaccctcgggctggaatgctctccccgcacgggacttgatttcaacgagatgattctgctcaccatgaaaaataaggcttggatggtccacagacagtggtttttcgacctgcctcttccctggacatccggcgccaccacagagaccccgacgtggaaccggaaagaactgctcgtgacatttaagaatgcccatgctaaaaagcaagaggttgtggtcctggggagccaggaaggagcgatgcacaccgccctgacaggcgctaccgagatccagaactctgggggcacctccattttcgccggacacctcaagtgtcgcctgaaaatggataaacttgaactgaaaggcatgagctacgccatgtgcctcaatacatttgtgctgaagaaagaggtttccgagacgcagcatgggaccatcctgattaaggtggaatacaagggagaggacgctccttgtaaaatccccttctctacagaagatggccaagggaaggcccacaacggaagacttatcaccgcgaaccctgtcgtgaccaagaaggaggagcccgtgaatattgaagctgagccccctttcggcgaaagcaacatcgttattgggatcggcgacaaagccctcaagattaattggtataagaaaggatccagcatcggcaagatgtttgaggccaccgctagaggggccagacgcatggctatcctgggagatacggcctgggacttcggctctgtcgggggagtgctgaactccctcggcaaaatggtgcatcagatttttgggagcgcgtacacagccctgttctctggcgtcagctggatcatgaagattggaatcggcgtgcttctgacctggattgggctcaattccaaaaacacctctatgagcttttcctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgacagcccgaaacggctcgccaccgcgattgccggcgcttgggaaaacggagtctgtggcatcagatctacaacccgcatggagaatctgctgtggaagcagattgccaacgaactcaattatatcctgtgggagaacaatatcaaacttacagtggttgtgggggatattatcggagtcctggaacagggcaagcgggctctcacaccccagcctatggagctgaaatactcctggaagacgtgggggaaggccaaaattgtgaccgccgagacacaaaacagctctttcatcattgacggacccaacacccctgaatgcccctccgctagcagagcgtggaatgtgtgggaggtcgaagactatggctttggcgttttcacaaccaacatctggctgaaacttcgcgaggtgtacacacagtcctgtgatcatcggctcatgtctgccgctatcaaagacgaaagagccgtgcacgccgatatggggtactggattgagagccagaagaatggatcctggaaactggagaaggcttcttttatcgaagtcaagacctgcacgtggccgaaaagccacacactgtggtccaacggcgtgctcgagagcgacatgattatccctaagtctctggccgggcccatttcccagcataatcaccgccctggatatcatacccaaaccgcgggcccctggcaccttgggaaactggaactcgatttcaactactgcgagggaacaaccgttgtgatcgctgagaattgtggcacgcggggccctagcctgagaacaaccacagtctctgggaagctgatccacgaatggtgctgtcgctcctgcacccttcccccgctccggtatatgggagaggacggctgttggtacgggatggaaattagacctatcaacgagaaagaagagaatatggtcaagagcctggtttctgccggaagcggcaaggtggataactttacaatgggggtcctgtgcctcgccattctgttcgaggaagtgatgcggggaaaattcggcaagaaacatatgatcgctggcgttctttttaccttcgtgctgctcctgtccgggcagattacgtggcgcgacatggcccacaccctgatcatgattggaagcaatgcgtctgatagaatgggcatgggggtcacatatcttgctctgatcgccacctttaagatccagcccttcctcgccctgggatttttcctccggaaactgacatccagagagaaccttctgctcggcgtggggctggctatggccaccacgctgcaacttcccgaagacattgagcagatggctaatggaatcgccctgggcctcatgacactgaagctcattacccagtttgaaacataccagctgtggaccgcgcttgtgagcctgacctgttccaacacaatcttcacgctcaccgtcgcctggcgcacagctaccctgattctggccggcgtttctcttctgcctctctgccaaagctcctctatgcggaagacagattggctgccgatgaccgtggctgccatgggggtgccccctctccccctgtttatcttcagccttaaagacacgcctaagagacgctcctggcccctgaatgagggagtcatggccgtgggcctggtttctatcctcgctagctccctgcttagaaacgatgtgcctatggcggggcccctggtcgccggaggcctcctgattgcttgttatgtgatcacagggaccagcgccgacctcaccgttgagaaagccgctgacgtgacatgggaagaggaagccgagcagaccggagtctctcataacctgatgattacagtggatgacgatggcacgatgaagatcaaagacgatgaaaccgagaatattcttacagtcctgctgaagaccgcgctcctgatcgtgtccggcatctttccgtacagcattcctgctacacttctggtttggcacacctggcagaaacagacgcaacggtctggggtgctctgggacgtcccctcccctcccgagacccagaaggccgaactggaggaaggagtgtaccgcatcaagcagcagggcattttcgggaaaacacaagttggagtgggcgtccagaaggagggggtgtttcataccatgtggcacgtgacaagaggagccgttctcacccacaacggcaaacggctggagccgaattgggctagcgtcaagaaagatcttatctcttatggcgggggatggcgcctgtccgcccagtggcaaaagggcgaagaggtccaggtgattgcggtcgaacctgggaagaaccccaaaaatttccagacaatgcctggaatcttccagacgaccacaggcgagattggggctatcgccctggactttaagcccggaaccagcggctcccccatcattaacagagaaggcaaagtggttgggctctacggaaatggcgtggtcaccaagaacgggggatatgtgagcggcatcgcccaaacaaatgctgagcctgatgggccgacgcccgagctggaagaggaaatgttcaaaaagcggaaccttaccattatggacctgcatcctggctctggaaagacacgcaaatacctccccgccatcgttagagaggctattaagcggcgcctgagaaccctcatcctggcccctacacgggtggtcgcggccgaaatggaggaggctcttaaaggcctgcccatcagatatcagaccacggccacaaagagcgaacacaccgggcgcgagattgtggatctgatgtgccatgctacctttacaatgcggctcctgtcccctgttagagtgccgaattacaaccttgtcatcatggacgaagcccacttcaccgatcccgcctctattgctgcgcgcggatatatcagcacacgggtgggcatgggggaggccgctgccatttttatgaccgccacgcctcccggaacagctgaagccttccctcagtccaatgcgcccatccaggacgaggagagagacatcccggaacgctcttggaacagcggcaatgagtggattaccgattttgtggggaaaacagtctggttcgttccttccatcaaggctggcaacgacattgccaactgtctgcggaagaatggcaaaaaggtgatccaactctctagaaaaacctttgatacggaataccagaagacccgcctgaacgactgggatttcgtggtcacaaccgacattagcgagatgggagccaattttaaagctgatcgggtgatcgaccccagacggtgcctgaagcccgttattctcacagatgggcctgagcgcgtgatccttgccggacccatgcctgtcaccgcggcctccgctgcccagagacggggccgcgtggggagaaacccgcagaaggaaaatgaccaatacatcttcatgggacagcccctgaacaatgatgaggaccatgctcactggacagaagccaaaatgctgctcgacaacattaatacccctgagggcatcattcccgctctgttcgaacctgagcgggaaaagagcgccgcgatcgatggggaatatagacttaaaggcgagtctcgcaagacgtttgttgaactgatgcggagaggagacctccccgtgtggctggcccacaaagtcgcttccgagggcattaagtacacagatcgcaaatggtgcttcgacggggaacggaacaatcagatcctggaggagaacatggatgtggaaatctggaccaaggagggagaaagaaagaaactccgcccgcggtggcttgacgccagaacctatagcgatcctctggctctgaaggagtttaaagacttcgccgccggccgcaagtctattgctctcgatctggtcacagaaatcgggagagtgccctcccatcttgcgcaccggacccgcaatgccctggacaacctcgttatgctgcatacaagcgagcacggaggcagagcttaccggcacgccgtggaggaactgcctgagacgatggaaaccctccttctgctgggcctcatgattctgcttacagggggagccatgctgtttctcatctccggcaaagggattggaaagacctctatcggcctgatctgtgtgattgtcagctccgggatgctgtggatggctgatgttcccctccagtggatcgccagcgcgattgtgcttgagttctttatgatggtgctgctgatccctgagcccgaaaagcaacgcacaccgcaggacaatcagctcgcctatgtcgtgattggaatcctgacccttgctgccattgttgctgccaacgagatgggcctgctcgaaacgaccaaaagagatctgggcatgtctaaggagcctggggtggtctcccccacaagctacctggacgtggacctccatcccgcgtctgcctggaccctttatgctgtcgccacaaccgtgatcacgcctatgctgcggcacacaatcgaaaatagcaccgctaacgtttccctggccgctattgccaaccaagcggtggtcctcatgggactggataaaggctggccgatctctaagatggaccttggggtgcccctgctcgccctgggatgctacagccaggttaatcctctgacactcaccgctgccgtgcttctgctggtcacccattacgctattatcggccccgggctccaggccaaagccacaagagaggcgcagaagcgcacggctgccggaattatgaagaaccctaccgtggatggcatcatgacaatcgacctggatcccgtgatttatgactccaaattcgagaagcaacttggccaggttatgctgctcgtcctgtgtgctgtgcagctgctccttatgcggacctcttgggccctgtgcgaagccctgacactcgctaccgggcctatcacgacactgtgggagggaagcccgggcaaattttggaataccaccattgccgtgtccatggcgaacatcttcagagggagctaccttgccggagctggcctggccttttctattatgaagtccgtcgggacaggacgccggggcaccggcagccagggggaaacactcggagagaaatggaagaagaaactgaatcaactgtccagaaaggagttcgatctctataaaaagtctggcatcacggaggttgaccggaccgaggctaaagaagggcttaagcgcggagagacaacccaccatgccgtgagcagaggctccgcgaaactgcagtggtttgtggaacggaacatggtcatccccgaggggcgcgtgattgatctgggatgtggcagaggcgggtggtcttactattgcgccggactcaagaaggttacagaagtgcggggctacaccaaagggggacctggccacgaggagcccgtccctatgagcacgtatgggtggaatatcgtgaagctgatgtccggaaaagacgttttctaccttcccccggaaaagtgtgataccctgctctgcgacattggcgagagctctccttcccccacagtggaagagagccgcaccatcagagtcctgaaaatggtggagccctggctgcggtctaaccagttctgtattaaggtgctcaatccttacatgcccacagtcatcgaatatcttgagcgcctgcagagaaagtacggcgggatgctggttcggaaccctctctccagaaatagcacccacgaaatgtattggatttctaacggaacaggcaatatcgtgagctccgtgaacatggtctctcgcctgcttctgaatcggtttaccatgacgcatagacgcccgacaatcgagaaagatgtggacctcggggctggaacccggcacgttaacgccgaacccgagacccctaacatggacgtgattggcgagagaatcaagcgcattaaagaagaacacagctccacatggcactacgatgacgaaaatccctataagacgtgggcttaccacgggagctatgaggtcaaagccaccggatccgcttctagcatgatcaacggcgtggttaagctgctgacaaagccttgggatgtggtccccatggtgacccaaatggccatgacagacaccacaccgttcggccagcagcgggtttttaaagaaaaggtggataccagaacgcctcgccccatgcctgggacccggaaagtcatggagattacagcggagtggctctggagaaccctgggacgcaataagaaaccccggctttgcacaagagaagagttcaccaagaaggtgcgcacgaacgccgctatgggcgccgtctttacagaagagaatcaatgggactccgctagagccgccgtggaagatgaggagttctggaaactggttgacaaggaacgggagctccataaactggggaagtgtggatcttgcgtgtacaacatgatgggcaaacgcgaaaagaaacttggggagtttggcaaggcgaagggaagcagagctatctggtacatgtggctgggcgcccggtatctcgagttcgaagccctggggtttctgaatgaggatcactggttctccagagaaaactcttacagcggagtcgagggcgaagggctccataaactgggatatatccttcgggacatttccaagatccctggcggggctatgtacgccgatgacaccgctggctgggacacacgcattaccgaggatgacctgcacaatgaggagaagatcacgcagcagatggatcccgagcatagacagctcgccaacgcgatttttaagctgacctatcaaaataaagtggtgaaggttcagcggccgacacctaagggaaccgtgatggacatcatcagccgcaaagatcagagaggctctgggcaggtcggaacatacggccttaacaccttcacaaatatggaagcccaactggtgcggcagatggagggggaaggagttctctccaaggctgacctggagaacccccatctgctcgagaaaaagattacccagtggctggaaacgaaaggcgtggagcgccttaagagaatggccatcagcggggatgactgcgtcgtgaagcccattgatgaccggtttgctaatgccctgctcgcgctgaacgatatgggcaaagtccgcaaggacatccctcagtggcaaccgtctaaaggatggcacgattggcaacaggtgcccttctgttcccatcacttccatgaacttattatgaaggacggcagaaaactggttgtgccttgccggccccaggacgagctcatcgggcgcgccagaatcagccaaggagctggctggtctctgaaggaaacagcctgtctggggaaggcttatgcccagatgtggtccctcatgtactttcaccggcgcgatctgagacttgctagcaacgccatttgctccgcggtccctgtgcactggatccccaccagccggaccacatggtctattcatgcccaccatcagtggatgaccacagaggacatgctgacggtttggaatagagtgtggatcgaggataacccttggatggaagacaaaacccccgtcacaacctgggaggatgtgccgtacctcggaaagcgcgaagaccaatggtgtggcagcctgattgggcttacatcccgggctacctgggcccagaatatcctgacggccattcaacaggtgagatctctcatcggcgatgaggagttcctggactatatgcctagcatgaaacgctttcggaaggaagaggaaaccgagggagctatctggtga

SEQ ID NO: 20488 - RNA, 9873 nt, synthetic construct
  misc_feature 1..9873: note = derived and/or modified CDS sequence (opt5) from DENV-3__GU131946__SS-prME
  source 1..9873: mol_type = other RNA
accagcctgtgcctcatgatgatgctgcccgccacccttgctttccacctgacgtcccgggacggagagcctcggatgatcgtggggaagaacgaacgcggaaagtctctcctgtttaagaccgccagcggaattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggcattctgaactctctcggcaaaatggtgcatcagatctttgggtccgcgtacacagccctgttcagcggcgtgtcttggattatgaagatcggaattggcgtccttctgacctggatcgggctcaatagcaaaaacacctccatgtcttttagctgcattgtgatcggaatcattacactgtatctgggcgctgttgtgcaggccgatatggggtgtgtcatcaattggaagggaaaggaacttaaatgcggctccgggattttcgtgaccaacgaggttcacacatggacggagcagtacaagtttcaagctgacagccccaaacggctcgccaccgcgatcgccggcgcttgggaaaatggagtgtgtggcattagatctacaacccgcatggagaacctgctgtggaagcagatcgccaatgaactcaactatatcctgtgggagaataacattaaacttacagtcgtggttggggatatcattggagtgctggaacagggcaagcggaccctcacgcctcagcccatggagctgaaatactcctggaagacctgggggaaggctagaatcgtcacagccgagacccaaaatagctctttcattatcgacggacctaacacacccgaatgcccgtccgccagccgcgcttggaacgtgtgggaggtggaagactatggctttggcgtcttcaccacaaatatctggctgaaacttcgggaggtttacacccagtcctgtgatcatagactcatgtctgcggccattaaggacgaacgcgctgtgcacgccgatatggggtactggatcgagagccagaaaaacggatcctggaagctggagaaagcctcttttattgaagtgaagacgtgcacatggcctaagagccacaccctgtggtccaatggcgtcctcgagagcgacatgatcattcccaaatctctggctgggcctatctcccagcataaccaccggcccggatatcatacccaaacagccggcccttggcaccttgggaagctggaactcgatttcaattactgcgagggaaccacggtggttatcacagagaactgtggcaccagaggccccagcctgcgcacaaccacagtgtctgggaaactgattcacgaatggtgctgtcggtcctgcacccttccgcctctcagatatatgggagaggacggctgttggtacgggatggaaatccggcccattaatgagaaggaagagaacatggtcaaaagcctggtgtctgcgggaagcggcaaggttgataattttacgatgggggtgctgtgcctcgctatcctgttcgaggaagtcatgcgcggaaagttcggcaaaaagcatatgattgccggcgtgctttttaccttcgttctgctcctgtccgggcagatcacatggagagacatggcccacaccctgattatgatcggaagcaacgcttctgatcggatgggcatgggggtgacatatcttgccctgatcgcgacctttaaaattcagcccttcctcgctctgggatttttcctcagaaagctgacgtcccgcgagaatcttctgctcggcgtcgggctggccatggccacaaccctgcaacttcctgaagacatcgagcagatggctaacggaattgccctgggcctcatgacactgaaactcatcacccagtttgaaacctaccagctgtggacagctcttgtgagcctgacgtgttccaataccattttcacactcaccgtggcctggcggacagcgaccctgatcctggccggcgtctctcttctgccgctctgccaaagctcctctatgagaaagacggattggctgcccatgacagttgctgccatgggggtgcctcccctccctctgtttatcttcagccttaaggacacccccaaacgcagatcctggcctctgaacgagggagtgatggctgtcggcctggtgtctattctcgccagctccctgcttcggaatgatgttcccatggccgggccgctggtggctggaggcctcctgatcgcgtgttatgtcattaccgggacaagcgccgacctcaccgtggagaaggctgccgacgttacatgggaagaggaagccgagcagacgggagtgtctcataacctgatgatcaccgtcgatgacgatggcacaatgcgcattaaagacgatgaaaccgagaacatccttacagtgctgctgaagaccgctctcctgatcgtctccggcatttttccttacagcatccccgccacgcttctggtgtggcacacctggcagaaacagacacaaagatctggggttctctgggacgtgccttctcccccggagacccagaaggcggaactggaggaaggagtctaccggattaaacagcagggcatcttcgggaagacacaagtgggagttggcgtgcagaaggagggggtctttcataccatgtggcacgtgacacgcggagctgtgctcacgcacaatggcaaaagactggagcctaactgggccagcgttaagaaagatcttattagctatggcgggggatggcggctgtccgcccagtggcaaaagggcgaagaggtccaggtgatcgctgtggaacccgggaaaaatcctaagaacttccagaccatgcccggaattttccagacaaccaccggcgagatcggggccatcgcgctggactttaagcccggaacaagcggctcccctattatcaatcgcgaaggcaaagtcgtggggctctacggaaacggcgttgtgacgaagaatgggggatatgtcagcggcattgctcaaaccaacgccgagccggatgggcccacacctgagctggaagaggaaatgttcaaaaagagaaatcttaccatcatggacctgcatcccggctctggaaaaacacggaagtacctccctgccattgtgcgcgaggctatcaagagacggctgagaaccctcatcctggcccccacgcgcgttgtggctgccgaaatggaggaggcgcttaaaggcctgcctattcggtatcagacaaccgccaccaagagcgaacacacagggagagagatcgtcgatctgatgtgccatgctacctttacaatgcgcctcctgtccccggtgcgggttcccaactacaatcttgtgattatggacgaagcccacttcaccgatcctgcttctatcgccgccagaggatatattagcacgcgcgtcggcatgggggaggctgcggccatctttatgacagctacaccccctggaacagccgaagccttcccccagtccaacgctccgatccaggacgaggagcgggacattcctgaaagatcttggaatagcggcaacgagtggatcaccgattttgtggggaaaacggtgtggttcgtcccctccattaaggccggcaatgacatcgcgaactgtctgcgcaaaaacggaaagaaggttattcaactctctcggaaaacctttgatacagaataccagaagaccagactgaatgactgggatttcgtggtgacaaccgacatcagcgagatgggcgctaactttaaagccgatcgggtcattgacccccgcagatgcctgaagcctgtgatcctcacagatgggcccgagcgggttatccttgccggacctatgccggtgaccgctgcctccgcggcccagcgcagaggccgggtcgggagaaatccccagaaagaaaacgaccaatacattttcacgggacagcctctgaataacgatgaggaccatgctcactggacagaagccaagatgctgctcgacaatatcaacacccccgagggcattatccctgctctgttcgaacccgagcgcgaaaagagcgccgctattgatggggaatatcggcttaaaggcgagtctagaaagacctttctggaactcatgcgccggggagacctgccggtgtggctggcccacaaagttgcgtccgagggcatcaagtacacagatagaaaatggtgcttcgacggggaacgcaataaccagatcctcgaggagaatatggatgtggaaatttggaccaaggagggagaacggaagaaacttagacctcgctggctggacgccagaacatatagcgatcccctggctctcaaagagtttaaagacttcgccgctggccggaagtctatcgccctggatcttgtcacggaaattgggcgcgtgccttcccatctggcccacagaacccggagcgctctcgacaacctggtcatgctgcatacatccgagcacggaggccgcgcgtacagacacgccgtggaggaactccccgagaccatggaaacacttctgctgctcggcctgatgatccttctgaccgggggagctatgctctttctgatttctggcaaagggatcggaaagacgagcatcggcctgatttgtgttatcgtgtccagcgggatgctctggatggccgatgtgcctcttcagtggattgcctctgctatcgtcctggagttctttatgatggttctgctcattcccgagccggaaaaacaacggacccctcaggacaatcagctggcctatgtggtgatcggcattcttacactggcggccatcgtcgctgccaacgagatgggcctcctggaaaccacaaagagagatctgggcatgtccaaggagcccggggtggttagccccacctcttacctcgacgtggaccttcatcctgctagcgcctggacgctgtatgcggtcgccacaaccgtgatcacaccgatgctgcgccacaccattgaaaattccaccgctaacgtctctctcgccgctatcgccaatcaagctgtggttctgatgggacttgataaaggctggcccattagcaagatggacctgggggtgcctctcctggccctgggatgctactcccaggtcaaccccctcacacttacggcggccgtgctgctgctcgttacccattacgctatcattggccctgggctgcaggccaaagctacacgggaggcccagaagagaaccgccgcgggaatcatgaaaaaccccacagtggatggcatcatgaccattgaccttgatcctgtcatctatgactctaagttcgagaagcaactgggccaggtgatgctcctggtgctgtgtgctgttcagctccttctgatgcgcacgagctgggccctgtgcgaagctctcacactggccaccgggccgattaccacactttgggagggatcccccggcaaattttggaataccacaatcgccgtcagcatggctaacattttccgggggtcttacctggccggagcgggcctcgccttttccatcatgaagtccgtggggacgggaagacggggcaccggctcccagggggaaacactgggagagaaatggaagaaaaagctgaatcaactctctcgcaaggagttcgatctttataaaaagagcggcatcaccgaggtggacagaacagaggctaaagaagggctgaagcggggagagaccacgcaccatgccgtctcccgcggctctgctaaactgcagtggtttgttgaaagaaacatggtgattcctgaggggcgggtgatcgatctcggatgtggccgcggcgggtggagctactattgcgccggactgaagaaagtcaccgaagtgagaggctacacaaaaggcgggcccgggcacgaggagcctgttcccatgtccacctatgggtggaatattgtgaaacttatgagcggaaaagacgtcttctacctgccgcctgaaaagtgtgatacactcctgtgcgacatcggcgagtcttcccccagccccaccgtggaagagtctcggacaattcgcgttctgaaaatggtggagccttggctcagaaacaatcagttctgtatcaaggtccttaacccctacatgcctaccgtgattgaacacctggagcggctgcagagaaaatatggcgggatgctcgtgcgcaatccgctgtcccggaacagcacgcatgaaatgtactggatctctaatggaacaggcaacatcgtcagctccgttaatatggtgtctagacttctgctcaaccgctttaccatgacccaccggagacccacaattgagaaggatgtggacctgggggcgggaacgcgccatgtcaatgccgaacctgagacccccaacatggacgtgatcggcgagcggattaagagaatcaaagaagaacacagctccacatggcactatgatgacgaaaacccttacaagacctgggcttatcatgggagctacgaggttaaagccacaggatccgcttctagcatgattaatggcgtggtcaagctgctcaccaaaccctgggatgtggttccgatggtgacacaaatggccatgaccgacacgacccctttcggccagcagcgcgtctttaaggaaaaggtggatacacggacccccagacctatgcccgggacacgcaaagttatggagatcaccgctgagtggctgtggcggacgcttggaagaaacaagaaacctcgcctgtgcacaagagaagagttcaccaagaaagtgcggacaaatgccgcgatgggcgccgtctttaccgaagagaaccaatgggacaatgctcgcgccgctgtggaagatgaggagttctggaagctcgtcgacagagaacgggagctgcacaaacttgggaaatgtggatcctgcatctataacatgatgggcaagagagagaagaagctgggggagtttggcaaagccaagggatctcgggccatttggtacatgtggctcggcgcgcgctacctggagttcgaagctctggggtttctcaatgaggatcattggttcagcagagaaaactcctattctggagtggagggcgaagggctgcacaaacttggatacatcctgcgggacattagcaagatccccggcggggccatgtatgccgatgacacggctggctgggacacccgcattacagaggatgacctccataatgaggaaaagatcacccagcagatggatccggagcacagacagctggccaacgctatctttaaacttacataccaaaataaggttgtgaaagtccagcggcctacccccaagggaacagtgatggacattatctcccgcaaagatcagagaggcagcggacaggtgggaacctatggcctgaacacgttcacaaatatggaagcccaactcgttcggcagatggagggggaaggagtgctgtctaaggcggacctggagaacccccacctcctggagaagaaaattacccagtggcttgaaaccaagggcgtcgatcgcctgaaaagaatggccatctccggggacgattgcgtggttaagcctattgacgatcggtttgctaatgccctcctggctcttaacgacatgggcaaagtgcgcaaggatatcccgcagtggcaacccagcaagggatggcatgactggcagcaggtccctttctgttctcaccatttccacgagctgatcatgaaagacggcagaaagctcgtggtcccctgccggcctcaggatgaactgattgggcgcgccagaatctcccaaggagcgggctggagcctgaaagagacagcctgtctcgggaaggcttacgcccagatgtggtctctgatgtattttcaccggagagaccttcgcctggcttccaacgccatttgcagcgctgtgcccgttcattggatccctacctcccggacaacgtggagcattcacgcccatcaccagtggatgaccacagaagatatgctcaccgtgtggaatagagtctggatcgaggacaacccctggatggaggataaaacaccggtgaccacgtgggaagacgttccttacctgggaaagcgcgaggatcaatggtgtggctctcttattgggctgaccagccgggcgacatgggcccagaatatcctcaccgctatccaacaggtgagatccctgattggcgacgaagagttcctggattacatgccctctatgaagcgctttcggaaagaggaagagagcgaaggagccatctggtga

SEQ ID NO: 20489 - RNA, 9873 nt, synthetic construct
  misc_feature 1..9873: note = derived and/or modified CDS sequence (opt5) from DENV-3__FJ639712__SS-prME
  source 1..9873: mol_type = other RNA
acaagcctgtgcctcatgatgatgttccccgccaccctggcttttcaccttacgtcccgggacggagaacctcggatgattgtggggaagaacgaacgcggaaaatctctcctgttcaagaccgccagcggcattaatatgtgtacactgatcgcgatggatcttggggaaatgtgcgacgataccgtcacatacaaatgtccgctgattgctgaagttgagcccgaagacatcgattgctggtgtaacctcacctccacatgggtgacctatggaacgtgcaatcaggccggcgagcaccggcgggacaagcgctctgtggccctggctcctcacgtcgggatgggactggataccagaacacaaacctggatgagcgccgagggcgcttggagacaggtggaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagtccaaacccacgctggacatcgagctccagaagaccgaagctacacaactggccacccttcgcaaactgtgtattgagggaaagatcacaaatattaccacggatagcagatgccctacacagggcgaagcgaccctcccggaggaacaggaccagaactatgtgtgtaaacacacctacgtggatcggggctgggggaatggatgcggcctgtttgggaagggatctcttgtcacatgcgccaagttccaatgtctggagcccatcgagggcaaagtggttcagtatgaaaacctcaagtacaccgtgattatcacagtccacacgggggaccagcatcaggtgggaaatgacacccaaggcgttacagtggagatcacccctcaggcttccacagtcgaagccgtgctgcccgagtatggcaccctggggctcgaatgcagccctcgcacgggactggattttaacgagatgattcttctgaccatgaaaaataaggcttggatggtccacagacagtggttctttgacctccccctgccgtggacatctggcgccaccacagagacccctacgtggaaccggaaagaacttctggtgacattcaagaatgcccatgctaaaaagcaagaggttgtggtcctcgggtcccaggaaggagcgatgcacaccgccctgacaggcgctaccgagatccagaacagcgggggcacctctatttttgccggacacctgaagtgtcgcctcaaaatggataagctggaacttaaaggcatgtcctacgccatgtgcctgaatacattcgtgctcaagaaagaggttagcgagacgcagcatgggaccatcctgattaaggtggaatacaagggagaggacgctccctgtaaaatccctttctccacagaagatggccaagggaaggcccactctggaagactgatcaccgcgaaccccgtcgtgaccaagaaggaggagcccgtgaacattgaagctgagcctccgtttggcgaaagcaatatcgttattgggatcggcgacaaagcccttaagattaactggtataagaaaggatccagcatcggcaagatgttcgaggccaccgctagaggggctagacgcatggctatcctcggagatacggcctgggactttggctctgtcgggggagtgctgaatagcctgggcaaaatggtgcatcagattttcgggagcgcgtacacagccctcttttctggcgtcagctgggtgatgaagatcggaattggcgttctgcttacctggatcgggctgaactccaaaaatacctctatgagcttctcctgcattgtgatcggaattatcacactctatctgggcgctgtcgtgcaggccgatatggggtgtgttatcaactggaagggaaaggaactgaaatgcggcagcgggatttttgtgaccaatgaggtccacacatggacggagcagtacaagttccaagctgactctcccaaacggcttgccaccgcgatcgccggcgcttgggaaaacggagtgtgtggcattagatccacaacccgcatggagaatctcctgtggaagcagatcgccaacgaactgaattatattctctgggagaacaatatcaaactgacagttgtggtcggggatatcattggagtgcttgaacagggcaagcggaccctgacgcctcagcccatggagctcaaatacagctggaagacctgggggaaggctaaaatcgtgacagccgagacccaaaactcttcctttattatcgacggacctaatacacccgaatgcccgagcgcctccagagcttggaacgtctgggaggttgaagactatggcttcggcgtgtttaccacaaacatttggctgaagctgcgcgaggtgtacacccagtcttgtgatcatcggcttatgagcgcggccatcaaagacgaaagagctgtccacgccgatatggggtactggatcgagtcccagaagaatggatcttggaaactcgagaaggccagcttcattgaagtgaagacgtgcacatggcctaaatcccacaccctgtggagcaacggcgttctggagtctgacatgatcattcccaagtccctcgctgggcctatcagccagcataatcaccgccccggatatcatacccaaacagccggcccttggcacctggggaaacttgaactggattttaactactgcgagggaaccacggtggtcattacagagaattgtggcacccggggcccctctctcagaacaaccacagtgtccgggaagctgatccacgaatggtgctgtcgcagctgcaccctgccgcctcttcggtatatgggagaggacggctgttggtacgggatggaaatcagacccattaacgagaaagaagagaatatggttaagtctctcgtgagcgcgggatccggcaaggtcgataacttcacgatgggggtgctgtgcctggctatcctcttcgaggaagttatgcggggaaaatttggcaagaaacatatgattgccggcgtgctgttcacctttgtccttctgctcagcgggcagatcacatggcgcgacatggcccacaccctgattatgatcggatctaatgcttccgatagaatgggcatgggggtgacatatctggcccttattgcgaccttcaagatccagccctttctggctctcggattctttctgcggaaactcacgagcagagagaacctgcttctgggcgtggggctcgccatggccacaaccctgcaactgcctgaagacatcgagcagatggctaatggaattgcccttggcctgatgacactcaagctgatcacccagttcgaaacctaccagctctggacagctctggtctcccttacgtgttctaacaccatttttacactgaccgttgcctggcgcacagcgaccctcatcctggccggcgtgagcctgcttccgctgtgccaatcctctagcatgcggaagacggattggctccccatgacagtggctgccatgggggtccctcccctgcctctcttcatcttttccctgaaagacacccccaagagacgctcttggcctcttaatgagggagtgatggctgttggcctggtgagcatcctggcctccagcctcctgagaaacgatgtccccatggccgggccgcttgtggctggaggcctgctcatcgcgtgttatgttattaccgggacatctgccgacctgaccgtggagaaagctgccgacgtcacatgggaagaggaagccgagcagacgggagtgtcccataatctcatgatcaccgtcgatgacgatggcacaatgcggattaaggacgatgaaaccgagaacatcctgacagtgcttctgaaaaccgctctgctcattgttagcggcatcttcccttactctatccccgccacgctgcttgtgtggcacacctggcagaagcagacacaacgctccggggtcctgtgggacgtgccttctcccccggagacccagaaagcggaactcgaggaaggagtttacagaattaagcagcagggcatctttgggaagacacaagtgggagtcggcgtgcagaaagagggggtgttccataccatgtggcacgttacacggggagctgtcctgacgcacaacggcaagcgcctcgagcctaattgggcctccgtgaaaaaggatctgatttcctatggcgggggatggagacttaacgcccagtggcaaaaaggcgaagaggtgcaggtcatcgctgtggaacccgggaagaatcctaagaacttccagaccatgcccggaatttttcagacaaccaccggcgagatcggggccattgcgctggacttcaaacccggaacaagcggctcccctatcatcaatcgggaaggcaaggttgtggggctgtacggaaacggcgtcgtgacgaaaaatgggggatatgttagcggcattgctcaaaccaacgccgagccggatgggcccacacctgagctcgaagaggaaatgtttaagaaacgcaatctgaccatcatggaccttcatcccggctctggaaagacaagaaagtacctgcctgccattgtgcgggaggctatcaaacgcagactccggaccctgattctcgcccccacgagagtcgtggctgccgaaatggaggaggcgctgaagggccttcctatccgctatcagacaaccgccaccaaaagcgaacacacagggcgggagatcgttgatctgatgtgccatgctaccttcacaatgagactgctctccccggtgcgcgtccccaactacaatctggtgattatggacgaagcccactttaccgatcctgcttctatcgccgcccggggatatattagcacgagagtgggcatgggggaggctgcggccatcttcatgacagctacaccccctggaacagccgaagcctttccccagtccaacgctccgattcaggacgaggagcgcgacatccctgaacggtcttggaatagcggcaacgagtggatcaccgatttcgtcgggaagacggtttggtttgtgccctccattaaagccggcaatgacatcgcgaactgtcttagaaagaacggaaagaaagtgattcaactgtctcgcaagaccttcgatacagaataccagaaaacccggctcaatgagtgggactttgtcgtgacaaccgatatcagcgagatgggcgctaacttcaaggccgacagagttattgatccccggcgctgcctgaaacctgtgatcctgacagacgggcccgaaagagtcattctcgccggacctatgccggtgaccgctgcctccgcggcccagcggcgcggcagagttgggcggaatccccagaaggagaacgatcaatacatcttcacgggacagcctcttaataacgacgaagatcatgctcactggacagaggccaagatgctgctggacaatatcaacacccccgaaggcattatccctgctctctttgagcccgagagagaaaagagcgccgctattgacggggagtatcgcctgaagggcgagtctcggaaaaccttcgtggagcttatgagacgcggagatctgccggtctggctcgcccacaaggtggcgtccgaaggcatcaaatacgccgaccggaagtggtgctttgatggggagagaaataaccagattctggaggaaaatatggacgtcgagatctggacaaaagaaggagagcgcaagaagctgcggcctagatggctcgatgctcgcacctatagcgacccccttgccctgaaagagttcaaggattttgctgccggcagaaaatctatcgccctggacctcgtgacagagattgggcgggttccttcccatctggctcaccgcacgagaaacgcgcttgataatctggtgatgctccataccagcgagcacggaggccgggcctaccgccacgctgtggaagaactgcccgaaacaatggagaccctgctccttctgggcctgatgatcctcctgacagggggagccatgcttttcctgatttccggcaaggggatcggaaaaacctctattggcctcatctgtgtcatcgttagctccgggatgctgtggatggccgacgtgcctctgcagtggattgctagcgccatcgtgctcgagtttttcatgatggtccttctgattcccgaaccggagaagcaaagaacgcctcaggataaccagctggcgtatgtggttatcggcattctcaccctggccgctatcgtggccgctaatgaaatgggccttctggagacaaccaagcgggacctcggcatgtctaaagaacccggggtcgtgtcccccacaagctacctggatgtcgacctgcatcctgcctctgcgtggaccctctatgccgtggctacgacagttattaccccgatgcttagacacacaatcgagaacagcaccgccaatgtgtccctggctgccatcgctaaccaagccgtcgtgctgatgggactcgacaagggctggcccatttctaaaatggatctgggggttcctcttctggcgctcggatgctacagccaggtgaaccccctgaccctgacagccgctgtcctccttctggtgacgcattacgccatcattggccctgggctgcaggctaaggccacccgcgaggcccagaaacggacagcggctggaatcatgaagaatcccaccgtggacggcattatgacaatcgatctcgaccctgttatctatgattccaagtttgaaaaacaactgggccaggtcatgcttctggtgctctgtgccgtgcagctgctgctcatgagaacctcttgggctctttgcgaggccctgacgctggccacagggccgattaccaccctctgggaaggaagccccggcaagttctggaacacaaccatcgctgtctccatggccaatatttttcgcgggagctacctggcgggagccggccttgctttctctatcatgaaatccgttgggacaggacggagaggcacgggcagccagggggagaccctgggagaaaagtggaaaaagaagctcaaccaactgtcccggaaagagtttgacctgtataagaaatctggcattacagaggtggatcgcaccgaagccaaggaggggctcaaaagaggagaaacaacccaccatgctgtgagccggggctccgccaaacttcagtggttcgtcgagcgcaatatggtgatccctgaagggagagttatcgacctgggatgtggccggggcgggtggtcttactattgcgcgggactgaaaaaggtgacggaggtccgcggctacaccaaaggcgggcccgggcacgaggaacctgtgcccatgagcacatatgggtggaacattgttaaactcatgtccggaaaggatgtgttctacctgccgcctgagaaatgtgacacccttctgtgcgatatcggcgaaagctctccctcccccacagtcgaggagagcagaaccattcgggtgctcaagatggtggaaccttggctgcgcaataaccagttttgtatcaaagtcctgaatccctacatgcctacagttattgagcacctcgaaagacttcagcggaagtatggcgggatgctggtgagaaacccgctgtctcgcaattccacccatgagatgtactggatcagcaacggaacgggcaatattgtgtctagcgtcaacatggtgtcccggctcctgcttaatagattcacaatgacccaccgccggcccaccatcgaaaaggacgttgatctgggggccggaacaagacatgtgaacgctgagcctgagacgcccaacatggacgtcatcggcgaacgcattaaacggatcaaggaggaacactctagcacctggcactatgacgatgagaatccttacaaaacatgggcctatcatgggtcctacgaagtgaaggctaccggaagcgcctcctctatgattaacggcgttgtgaaactcctgacaaagccctgggacgtcgtgccgatggttacccaaatggctatgacagataccacgccttttggccagcagagagtgttcaaggagaaagtcgacacccgcacaccccggcctatgcccgggaccagaaaggtgatggagatcacagccgaatggctgtggcgcaccctcggacggaataaaaagcctagactgtgcacgcgcgaggaatttaccaagaaggtcagaaccaacgcggccatgggcgctgtgttcacagaggaaaatcaatgggatagcgcccgggctgccgttgaggacgaggaattttggaaacttgtggatcgcgagagagaactgcacaaactcgggaagtgtggatcctgcgtctataacatgatgggcaaacgggagaagaaactgggggagttcggcaaggccaaaggatctagagcgatttggtacatgtggcttggcgctcggtacctggaatttgaggccctcgggttcctgaatgaagaccattggtttagccgcgagaactcctattctggagtggaaggcgaggggctgcacaagctcggatacatcctgagagatatcagcaagattcccggcggggccatgtatgctgacgataccgccggctgggacacgcggatcaccgaggacgatcttcataatgaagagaaaattacacagcagatggacccggaacaccgccagctggctaacgccatcttcaagctcacctaccaaaataaagtggttaaggtgcagagacctacacccaaaggaaccgtcatggatattatctcccggaaggaccagcgcggcagcggacaggtgggaacatatggcctgaacacctttacgaatatggaggcgcaacttgttagacagatggaaggggagggagtgctgtctaaggccgatctcgagaacccccatctgctggagaaaaagatcacacagtggctcgagaccaaaggcgtcgaacggctgaagcgcatggctatttccggggacgattgcgtggtcaaacctatcgacgatagattcgccaatgcccttctggccctcaacgacatgggcaaggtgcggaaggatattccgcagtggcaacccagcaaaggatggcatgactggcagcaggttcctttctgttctcaccattttcacgagctgatcatgaaggatggccgcaaacttgtggtcccctgcagacctcaggacgaactgattgggcgggcgcgcatctcccaaggagccggctggagcctcaaggagaccgcttgtctggggaaagcctacgctcagatgtggtctctgatgtatttccacagacgggacctcagactggcctccaacgctatctgcagcgccgtgcccgttcattggattcctacatcccgcaccacatggagcatccacgcgcatcaccagtggatgacgaccgaggatatgcttacagtgtggaatcgggtctggattgaagacaacccctggatggaggataagaccccggtgacaacctgggaagacgtgccttacctgggaaagagagaggatcaatggtgtggctctctcatcgggctgacgagccgcgccacctgggctcagaatattcttacagccatccagcaggttcggtccctgattggcgacgaggaatttctcgattacatgccctctatgaaaagattccgcaaggaggaagagagcgaaggagccatctggtga

SEQ ID NO: 20490 - RNA, 9873 nt, synthetic construct
  misc_feature 1..9873: note = derived and/or modified CDS sequence (opt5) from DENV-3__FJ639713__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataagcttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgacaaaaaaggaggagcccgtgaatattgaagctgagcctccgttcggcgaatctaacatcgttattgggatcggcgacaaagccctcaagattaattggtataagaaaggaagctccatcggcaagatgtttgaggccaccgctcggggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagacccaaaactccagcttcatcattgacggacctaacacacccgaatgcccgtctgcctccagagcttggaatgtgtgggaggtcgaagactatggctttggcgttttcaccacaaacatctggctgaagcttcgcgaggtgtacacccagagctgtgatcatcggctcatgtccgcggccatcaaagacgaaagagctgtgcacgccgatatggggtactggattgagtctcagaagaatggaagctggaaactggagaaggcctcctttatcgaagtcaagacgtgcacatggcctaaatctcacaccctgtggagcaacggcgtgctcgagtccgacatgattatccccaagagcctggctgggcctatttctcagcataatcaccgccccggatatcatacccaaacagccggcccttggcaccttgggaaactggaactcgatttcaactactgcgagggaaccacggttgtgatcgcggagaattgtggcacacggggcccctccctgagaaccacaaccgtcagcgggaagctgatccacgaatggtgctgtcgctcttgcacacttccgcctctccggtatatgggagaggacggctgttggtacgggatggaaattagacccatcaacgagaaagaagagaatatggtgaagtccctggttagcgctggatctggcaaggtggataactttaccatgggggtcctgtgcctcgccattctgttcgaggaagtgatgcggggaaaattcggcaagaaacatatgatcgccggcgttctttttacgttcgtgctgctcctgagcgggcagattacctggcgcgacatggctcacacactgatcatgattggatccaatgccagcgatagaatgggcatgggggtcacctatcttgcgctgatcgctacatttaagatccagcccttcctcgccctgggatttttcctccggaaactgacctctagagagaaccttctgctcggcgtggggctggccatggctacgacactgcaacttcctgaagacattgagcagatggccaatggaatcgctctgggcctcatgaccctgaagctcattacacagtttgaaacctaccagctgtggaccgcccttgtgtccctgacatgtagcaacacgatcttcaccctcacagtcgcgtggcgcaccgccacactgattctggctggcgtttcccttctgccgctctgccaatctagctccatgcggaagaccgattggctgcccatgacggtggccgctatgggggtgcctcccctccctctgtttatcttctctcttaaagacacacccaagagacgcagctggcctctgaatgagggagtcatggccgtgggcctggtttccatcctcgcctctagcctgcttagaaacgatgtgcccatggctgggccgctggtcgcgggaggcctcctgattgcctgttatgtgatcaccgggacctccgctgacctcacagttgagaaagccgccgacgtgacctgggaagaggaagctgagcagacaggagtcagccataacctgatgattacggtggatgacgatggcaccatgcggatcaaggacgatgaaacagagaatattcttaccgtcctgctgaaaacagccctcctgatcgtgtctggcatctttccttactccattcccgcgacccttctggtttggcacacgtggcagaagcagacccaacgcagcggggtgctctgggacgtcccttctcccccggagacacagaaagctgaactggaggaaggagtgtacagaatcaagcagcagggcattttcgggaagacccaagttggagtgggcgtccagaaagagggggtgtttcatacaatgtggcacgtgacccggggagccgttctcacacacaacggcaagcgcctggagcctaattgggcctccgtcaaaaaggatcttatcagctatggcgggggatggagactgtctgctcagtggcaaaaaggcgaagaggtgcaggtgattgccgtcgaacccgggaagaaccctaagaatttccagacgatgcccggaatcttccagaccacaaccggcgagattggggcgatcgctctggactttaaacccggaacctccggcagccctatcattaaccgggaaggcaaggtggttgggctctacggaaatggcgtggtcacaaaaaacgggggatatgtgtccggcatcgcccaaacgaatgccgagccggatgggcccacccctgagctggaagaggaaatgttcaagaaacgcaaccttacaattatggacctgcatcccggcagcggaaagaccagaaagtacctccctgctatcgttcgggaggccattaaacgcagactgcggacactcatcctggctcccaccagagtggtcgccgcggaaatggaggaggcccttaagggcctgcctatccgctatcagacgacagctaccaaatctgaacacaccgggcgggagattgtggatctgatgtgccatgccacatttaccatgagactcctgagcccggttcgcgtgcccaattacaaccttgtcatcatggacgaagctcacttcacagatcctgcctccattgccgctcggggatatatctctaccagagtgggcatgggggaggcggccgctatttttatgacggccacaccccctggaaccgccgaagctttcccccagagcaatgccccgatccaggacgaggagcgcgacatccctgaacggtcctggaactctggcaatgagtggattacagattttgtggggaagaccgtctggttcgttcccagcatcaaagcgggcaacgacattgctaactgtctgagaaagaatggaaagaaagtgatccaactctcccgcaagacgtttgataccgaataccagaaaacacggctgaacgactgggatttcgtggtcaccacagacatttctgagatgggcgccaattttaaggccgatagagtgatcgacccccggcgctgcctgaaacctgttattctcaccgatgggcccgagagagtgatccttgctggacctatgccggtcacagccgcgagcgccgctcagcggcgcggcagagtggggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgttgaactgatgagacgcggagacctcccggtgtggctggcgcacaaggtcgcctctgagggcattaaatacaccgatcggaagtggtgcttcgacggggaaagaaacaatcagatcctggaggagaacatggatgtggaaatctggacaaaagagggagaacgcaagaagctccggcctagatggcttgacgctcgcacctattccgatcccctggccctgaaagagtttaaggacttcgctgccggcagaaaaagcattgccctcgatctggtcacagaaatcgggcgggtgccttctcatcttgctcaccgcacgagaaatgcgctggacaacctcgttatgctgcatacctccgagcacggaggccgggcctaccgccacgctgtggaggaactgcccgagacaatggaaaccctccttctgctgggcctcatgattctgcttacagggggagccatgctgtttctcatcagcggcaaggggattggaaaaacctccatcggcctgatctgtgtgattgtctctagcgggatgctgtggatggccgatgttcctctccagtggatcgcttccgccattgtgcttgagttctttatgatggtgctgctgatccccgagccggaaaagcaaagaacgcctcaggacaatcagctcgcgtatgtcgtgattggaatcctgacccttgccgctattgttgccgctaacgagatgggcctgctcgaaacaaccaagcgggatctgggcatgagcaaagagcccggggtggtctctcccacatcctacctggacgtggacctccatcctgccagcgcgtggaccctttatgccgtcgctacgacagtgatcaccccgatgctgagacacacaatcgaaaattctaccgccaacgttagcctggctgccattgctaaccaagccgtggtcctcatgggactggataagggctggcccatctccaaaatggaccttggggtgcctctgctcgcgctgggatgctactctcaggttaatcccctgaccctcacagccgctgtgcttctgctggtcacgcattacgccattatcggccctgggctccaggctaaggccacccgcgaggcccagaaacggacagcggctggaattatgaagaaccccaccgtggatggcatcatgacaatcgacctggatcctgtgatttatgacagcaagttcgagaaacaacttggccaggttatgctgctcgtcctgtgtgccgtgcagctgctccttatgagaacctcctgggctctgtgcgaagccctgacgctcgccacagggccgatcaccaccctgtgggagggatctcccggcaagttttggaatacaaccattgctgtgagcatggccaacatcttccgcgggtcctaccttgcgggagccggcctggcttttagcattatgaaatctgtcgggacaggacggagaggcacgggctcccagggggaaaccctcggagagaagtggaaaaagaagctgaatcaactgagccggaaagaattcgatctctataagaaatccggcatcacagaggttgaccgctctgaggccaaggaagggcttaaaagaggagagaccacacaccatgctgtgagccggggctccgccaagctgcagtggtttgtggaacgcaacatggtcatccctgaggggagagtgattgatctgggatgtggccggggcgggtggtcttactattgcgcgggactcaaaaaggttaccgaagtgcgcggctacacgaaggggggacccggccacgaggagcctgtccccatgagcacctatgggtggaatatcgtgaaactgatgtccggaaaggacgttttctaccttccgcctgaaaaatgtgatacactgctctgcgacattggcgagagctctccctcccccaccgtggaagagagcagaacaatccgggtcctgaagatggtggagccttggctgcgcaacaatcagttctgtattaaagtgctcaacccctacatgcctaccgtcatcgaacaccttgagagactgcagcggaagcatggcgggatgctggttagaaatccgctctctcgcaactccacacacgaaatgtattggattagcaatggaaccggcaacatcgtgtctagcgtgaatatggtctcccggctgcttctgaacagatttacgatgacacatcgccggcccaccatcgagaaggatgtggacctcggggccggaaccagacacgttaacgctgaacctgagacacccaatatggacgtgattggcgagcgcatcaaacggattaaggaagagcactctagcacgtggcattacgatgacgaaaacccttataaaacctgggcctaccacgggtcctatgaggtcaaggctacaggaagcgcctcctctatgatcaatggcgtggttaaactgctgaccaagccctgggatgtggtcccgatggtgacacaaatggctatgaccgacacaacccctttcggccagcagagagtttttaaggaaaaagtggatacgcgcaccccccggcctatgcccgggacaagaaaggtcatggagattaccgccgagtggctctggcgcacactgggacggaacaaaaagcctagactttgcacccgcgaagagttcacgaaaaaggtgagaacaaatgcggccatgggcgctgtctttaccgaagagaaccaatgggacagcgcccgggctgccgtggaagatgaggagttctggaagctggttgacaaagaacgcgagctccataagctggggaaatgtggatcctgcgtgtacaatatgatgggcaagagagaaaaaaagcttggggagtttggcaaagccaagggatctcgggcgatctggtatatgtggctgggcgctagatacctcgagttcgaagccctggggtttctgaacgaggatcactggttcagccgggaaaattcctactctggagtcgagggcgaagggctccataagctgggatatatccttcgcgacattagcaaaatccccggcggggccatgtacgctgatgacacagccggctgggacaccagaattacggaggatgacctgcacaacgaggaaaagatcacccagcagatggatccggagcaccggcagctcgctaatgccatttttaaactgacatatcaaaacaaggtggtgaaagttcagcgccctacccccaagggaacagtgatggacatcatctccagaaaggatcagcggggcagcgggcaggtcggaacctacggccttaatacattcaccaacatggaagcgcaactggtgcgccagatggagggggaaggagttctctctaaagccgacctggagaatccccatctgctcgagaagaaaattatccagtggctggaaacgaagggcgtggagagacttaaacggatggctatttccggggatgactgcgtcgtgaagcctatcgatgaccgctttgccaacgctctgctcgccctgaacgatatgggcaaggtcagaaaagacattccgcagtggcaacccagcaagggatggcacgattggcagcaggtgcctttctgttctcatcacttccacgaacttatcatgaaagacggccggaagctggttgtgccctgccgccctcaggacgagctcatcgggagagcgcggatttcccaaggagccggctggagcctgaaagaaacagcttgtctggggaaggcctatgctcagatgtggtctctcatgtactttcatcgcagagatctgcggcttgcctccaatgctatctgcagcgccgtccccgtgcactggattcctacctccagaaccacatggagcatccatgcgcaccatcagtggatgaccacagaggacatgctgtctgtttggaaccgcgtgtggattgaggataatccctggatggaagacaagacgccggtcaccacatgggaggatgtgccttatctcggaaaacgggaagaccaatggtgtggcagcctgatcgggcttacctccagagccacatgggctcagaacattctgaccgccatccagcaggtgcgctctctcatcggcgatgaggagttcctggactacatgcccagcatgaagcggtttagaaaagaagaggaatccgagggagccatttggtga

SEQ ID NO: 20491 - RNA, 9873 nt, synthetic construct
  misc_feature 1..9873: note = derived and/or modified CDS sequence (opt5) from DENV-3__FJ639714__SS-prME
  source 1..9873: mol_type = other RNA
acatccctgtgcctcatgatgatgctgcccgccacacttgctttccacctgacgtcccgggacggcgaacctcggatgatcgtggggaagaacgaacgcggaaaatctctcctgtttaagacagccagcggcattaatatgtgtacacttatcgcgatggatctgggggaaatgtgcgacgatacagtgacatacaaatgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaagcggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccagcagagcttggaacgtgtgggaggtcgaagactatggctttggcgttttcaccacaaatatctggctgaaacttcgcgaggtgtacacccagtcctgtgatcatcggctcatgtctgcggccatcaaagacgaaagagctgtgcacgccgatatggggtactggattgagagccagaagaacggatcctggaaactggagaaggcctcttttatcgaagtcaagacgtgcacatggcctaaaagccacaccctgtggtccaatggcgtgctcgagagcgacatgattatccccaagtctctggctgggcctatttcccagcataaccaccgccccggatatcatacccaaacagccggcccttggcaccttgggaaactggaactcgatttcaattactgcgagggaaccacggttgtgatcgcggagaactgtggcacacggggccccagcctgagaaccacaaccgtctctgggaagctgatccacgaatggtgctgtcgctcctgcacacttccgcctctccggtatatgggagaggacggctgttggtacgggatggaaattagacccatcaatgagaaagaagagaacatggttaagagcctggtgtctgctggaagcggcaaggtggataattttaccatgggggtcctgtgcctcgccattctgttcgaggaagtgatgcggggaaaattcggcaagaaacatatgatcgccggcgttctttttacgttcgtgctgctcctgtccgggcagattacctggcgcgacatggctcacacactgatcatgattggaagcaacgcctctgatagaatgggcatgggggtcacctatcttgcgctgatcgctacatttaagatccagcccttcctcgccctgggatttttcctccggaaactgacctccagagagaatcttctgctcggcgtggggctggccatggctacgacactgcaacttcctgaagacattgagcagatggccaacggaatcgctctgggcctcatgaccctgaagctcattacacagtttgaaacctaccagctgtggaccgcccttgtgagcctgacatgttccaatacgatcttcaccctcacagtcgcgtggcgcaccgccacactgattctggctggcgtttctcttctgccgctctgccaaagctcctctatgcggaagaccgattggctgcccatgacggtggccgctatgggggtgcctcccctccctctgtttatcttcagccttaaagacacacccaagagacgctcctggcctctgaacgagggagtcatggccgtgggcctggtttctatcctcgccagctccctgcttagaaatgatgtgcccatggctgggccgctggtcgcgggaggcctcctgattgcctgttatgtgatcaccgggaccagcgctgacctcacagttgagaaagccgccgacgtgacctgggaagaggaagctgagcagacaggagtctctcataacctgatgattacggtggatgacgatggcaccatgcggatcaaggacgatgaaacagagaacattcttaccgtcctgctgaaaacagccctcctgatcgtgtccggcatctttccttacagcattcccgcgacccttctggtttggcacacgtggcagaagcagacccaacgctctggggtgctctgggacgtcccttctcccccggagacacagaaagctgaactggaggaaggagtgtacagaatcaagcagcagggcattttcgggaagacccaagttggagtgggcgtccagaaagagggggtgtttcatacaatgtggcacgtgacccggggagccgttctcacacacaatggcaagcgcctggagcctaactgggccagcgtcaaaaaggatcttatcagctatggcgggggatggagactgtccgctcagtggcaaaaaggcgaagaggtccaggtgattgccgtcgaacccgggaagaatcctaagaacttccagacgatgcccggaatcttccagaccacaaccggcgagattggggcgatcgctctggactttaaacccggaaccagcggctcccctatcattaatcgggaaggcaaggtggttgggctctacggaaacggcgtggtcaccaagaatgggggatatgtgagcggcatcgcccaaacgaacgccgagccggatgggcccacccctgagctggaagaggaaatgttcaagaaacgcaatcttacaattatggacctgcatcccggctctggaaagaccagaaagtacctccctgctatcgttcgggaggccattaaacgcagactgcggacactcatcctggctcccaccagagtggtcgccgcggaaatggaggaggcccttaagggcctgcctatccgctatcagacgacagctaccaaaagcgaacacaccgggcgggagattgtggatctgatgtgccatgccacatttaccatgagactcctgtccccggttcgcgtgcccaactacaatcttgtcatcatggacgaagctcacttcacagatcctgcctctattgccgctcggggatatatcagcaccagagtgggcatgggggaggcggccgctatttttatgacggccacaccccctggaaccgccgaggctttcccccagtccaacgccccgatccaggacgaggagcgcgacatccctgaacggtcttggaatagcggcaacgagtggattacagattttgtggggaagaccgtctggttcgttccctccatcaaagcgggcaatgacattgctaactgtctgagaaagaacggaaagaaagtgatccaactctctcgcaagacgtttgataccgaataccagaaaacacggctgaatgactgggatttcgtggtcaccacagacattagcgagatgggcgccaactttaaggccgatagagtgatcgacccccggcgctgcctgaaacctgttattctcaccgatgggcccgagagagtgatccttgctggacctatgccggtcacagccgcgtccgccgctcagcggcgcggcagagtggggcggaatccccagaaggaaaacgaccaatacatcttcaccggacagcctctgaataacgatgaggaccatgcccactggacggaagctaagatgctgctcgacaatattaacacacccgagggcatcattcctgccctgttcgaacccgagagagagaaaagcgctgccatcgatggggaatatcgccttaagggcgagtctcggaaaacctttgttgaactgatgagacgcggagacctcccggtgtggctggcgcacaaggtcgcctccgagggcattaaatacaccgatcggaagtggtgcttcgacggggaaagaaataaccagatcctggaggagaatatggatgtggaaatctggacaaaagagggagaacgcaagaagctccggcctagatggcttgacgctcgcacctatagcgatcccctggccctgaaagagtttaaggacttcgctgccggcagaaaatctattgccctcgatctggtcacagaaatcgggcgggtgccttcccatcttgctcaccgcacgagaaacgcgctggacaatctcgttatgctgcataccagcgagcacggaggccgggcctaccgccacgctgtggaggaactgcccgagacaatggaaaccctccttctgctgggcctcatgattctgcttacagggggagccatgctgtttctcatctccggcaaggggattggaaaaacctctatcggcctgatctgtgtgattgtcagctccgggatgctgtggatggccgatgttcctctccagtggatcgctagcgccattgtgcttgagttctttatgatggtgctgctgatccccgagccggaaaagcaaagaacgcctcaggacaaccagctcgcgtatgtcgtgattggaatcctgacccttgccgctattgttgccgctaatgagatgggcctgctcgaaacaaccaagcgggatctgggcatgtctaaagagcccggggtggtctcccccacaagctacctggacgtggacctccatcctgcctctgcgtggaccctttatgccgtcgctacgacaatcatcaccccgatgctgagacacacaattgaaaacagcaccgccaatgtgtccctggctgccatcgctaaccaagccgttgtgctcatgggactggataagggctggcccatttctaaaatggaccttggggtccctctgctcgcgctgggatgctacagccaggtgaaccccctgaccctcacagccgctgttcttctgctggtgacgcattacgccatcattggccctgggctccaggctaaggccacccgcgaggcccagaaacggacagcggctggaatcatgaagaatcccaccgtcgatggcatcatgacaattgacctggatcctgtgatctatgactccaagttcgagaaacaacttggccaggtgatgctgctcgttctgtgtgccgtccagctgctccttatgagaacctcttgggctctgtgcgaagccctgacgctcgccacagggccgattaccaccctgtgggagggaagccccggcaagttttggaacacaaccatcgctgtgtccatggccaatattttccgcgggagctaccttgcgggagccggcctggctttttctatcatgaaatccgtggggacaggacggagaggcacgggcagccagggggaaaccctcggagagaagtggaaaaagaagctgaaccaactgtcccggaaagagttcgatctctataagaaatctggcatcacagaggtcgaccgcaccgaggccaaggaagggcttaaaagaggagagacaacccaccatgctgttagccggggctccgccaagctgcagtggtttgtggaacgcaatatggtgattcctgaggggagagtcatcgatctgggatgtggccggggcgggtggtcttactattgcgcgggactcaaaaaggtgacggaagttcgcggctacaccaaagggggacccggccacgaggagcctgtgcccatgagcacatatgggtggaacattgtcaaactgatgtccggaaaggacgtgttctaccttccgcctgaaaaatgtgataccctgctctgcgacatcggcgagagctctccctcccccacagttgaagagagcagaaccattcgggtgctgaagatggtcgagccttggctgcgcaataaccagttctgtatcaaagtgctcaatccctacatgcctacagtgattgaacaccttgagagactgcagcggaagtatggcgggatgctggtcagaaacccgctctctcgcaattccacccatgaaatgtactggatcagcaacggaacgggcaatatcgtttctagcgtgaacatggtgtcccggctgcttctgaatagatttacaatgacccaccgccggcccaccattgagaaggatgtcgacctcggggccggaacaagacatgtgaacgctgaacctgagacgcccaacatggacgttatcggcgagcgcattaaacggatcaaggaagaacactctagcacctggcactatgatgacgaaaatccttacaaaacatgggcctatcatgggtcctacgaggtgaaggctaccggaagcgcctcctctatgattaacggcgtcgtgaaactgctgacaaagccctgggatgttgtgccgatggtcacccaaatggctatgacagacaccacgcctttcggccagcagagagtgtttaaggaaaaagttgatacccgcacaccccggcctatgcccgggaccagaaaggtgatggagatcacagccgagtggctctggcgcaccctgggacggaataaaaagcctagactttgcacgcgcgaagagttcaccaagaaggtcagaaccaacgcggccatgggcgctgtgtttacagaagagaatcaatgggacagcgcccgggctgccgtcgaagatgaggagttctggaagctggtggacaaagaacgcgagctccacaagctggggaaatgtggatcctgcgtttataacatgatgggcaagagagagaagaaacttggggagtttggcaaagccaagggatctcgggcgatctggtacatgtggctgggcgctagatacctcgagttcgaagccctggggtttctgaatgaggatcattggttcagccgggaaaactcctattctggagtggagggcgaagggctccacaagctgggatacattcttcgcgacatcagcaaaattcccggcggggccatgtatgctgatgacaccgccggctgggacacgagaatcaccgaggatgacctgcataatgaggaaaagattacacagcagatggatccgggacaccggcagctcgctaacgccatctttaaactgacctaccaaaataaggtcgtgaaagtgcagcgccctacacccaagggcaccgttatggacatcatttccagaaaggatcagcgggggagcggacaggtgggcacatatgggcttaacaccttcacgaatatggaggcgcaactggtccgccagatggaaggagagggcgtgctctctaaagccgacctggaaaacccccatctgctcgagaagaaaatcacacagtggctggagaccaagggggttgaaagacttaaacggatggctatttccggcgatgactgcgtggtcaagcctatcgatgaccgctttgccaatgctctgctcgccctgaacgatatgggaaaggtgagaaaagacattccgcagtggcaacccagcaagggctggcatgattggcagcaggtccctttctgttctcaccatttccacgagcttatcatgaaagacgggcggaagctggtggttccctgccgccctcaggacgaactcatcggacgggcgcggatttcccaaggcgccgggtggagcctgaaagagaccgcttgtctgggaaaggcctacgctcagatgtggtctctcatgtattttcaccgcagagatctgcggcttgcctccaacgctatctgcagcgccgtgcccgtccattggattcctacatccagaaccacatggagcatccacgcgcatcaccagtggatgacgaccgaagacatgctgacagtgtggaatcgcgtttggattgaggataacccctggatggaggacaagaccccggtgacaacctgggaagatgtcccttacctcggcaaacgggaggaccaatggtgtgggtctctgatcggccttacgagcagagccacctgggctcagaatattctgacagccatccaacaggtgcgctccctcatcggagatgaagagttcctggactacatgccctctatgaagcggtttagaaaagaggaagagaccgaaggcgccatttggtga

SEQ ID NO: 20492 - RNA, 9873 nt, synthetic construct
  misc_feature 1..9873: note = derived and/or modified CDS sequence (opt5) from DENV-3__FJ639715__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcaccaatattttcgccggacacctcaagtgtcgcctgaaaatggataaacttgaactgaaaggcatgtcttacgccatgtgcctcaacacatttgtgctgaagaaagaggtttccgagacgcagcatgggaccatcctgattaaggtggaatacaagggagaggacgctccctgtaaaatccctttcagcacagaagatggccaagggaaggcccacaacggaagacttatcaccgcgaatcccgtcgtgaccaagaaggaggagcccattaacatcgaagctgagcctccgttcggcgaatccaatattgtgatcgggattggcgacaaagccctcaagatcaactggtataagaaaggatctagcatcggcaagatgtttgaggccaccgctagaggggccagacgcatggctattctgggagatacggcctgggacttcggctccgttgggggagtcctgaatagcctcggcaaaatggtgcatcagatctttgggtctgcgtacacagccctgttctccggcgtgagctggattatgaagatcggaattggcgtccttctgacctggatcgggctcaactctaaaaataccagcatgtccttttcttgcattgtgatcggaatcattacactgtatctgggcgctgttgtgcaggccgatatggggtgtgtcatcaactggaagggaaaggaacttaaatgcggcaatgggattttcgtgaccaacgaggttcacacatggacggagcagtacaagtttcaagctgacagccccaaacggctcgccaccgcgatcgccggcgcttgggaaaatggagtgtgtggcattagatccacaacccgcatggagaacctgctgtggaagcagatcgccaatgaactcaactatatcctgtgggagaataacattaaacttacagtcgtggttggggatatcattggagtgctggaacagggcaagcggaccctcacgcctcagcccatggagctgaaatacagctggaagacctgggggaaggctaaaatcgtcacagccgagacccaaaactcttccttcattatcgacggacctaatacacccgaatgcccgagcgcctctagagcttggaacgtgtgggaggtggaagactatggctttggcgtcttcaccacaaatatctggctgaaacttcgcgaggtttacacccagtcctgtgatcatcggctcatgagcgcggccattaaagacgaaagagctgtgcacgccgatatggggtactggatcgagtcccagaagaacggatcttggaaactggagaaggccagctttattgaagtgaagacgtgcacatggcctaaatcccacaccctgtggtctaatggcgtcctcgagagcgacatgatcattcccaagtccctggctgggcctatcagccagcataaccaccgccccggatatcatacccaaacagccggcccttggcaccttgggaaactggaactcgatttcaattactgcgagggaaccacggtggttatcgcggagaactgtggcacacggggcccctctctgagaaccacaaccgtgtccgggaagctgattcacgaatggtgctgtcgcagctgcacacttccgcctctccggtatatgggagaggacggctgttggtacgggatggaaatcagacccattaatgagaaagaagagaacatggtcaagtctctggtgtccgctggaagcggcaaggttgataattttaccatgggggtgctgtgcctcgccatcctgttcgaggaagtcatgcggggaaaattcggcaagaaacatatgattgccggcgtgctttttacgttcgttctgctcctgtctgggcagatcacctggcgcgacatggctcacacactgattatgatcggaagcaacgcctccgatagaatgggcatgggggtgacctatcttgcgctgatcgctacatttaagattcagcccttcctcgccctgggatttttcctccggaaactgaccagcagagagaatcttctgctcggcgtcgggctggccatggctacgacactgcaacttcctgaagacatcgagcagatggccaacggaattgctctgggcctcatgaccctgaagctcatcacacagtttgaaacctaccagctgtggaccgcccttgtgtctctgacatgttccaatacgattttcaccctcacagtggcgtggcgcaccgccacactgatcctggctggcgtcagccttctgccgctctgccaatcctctagcatgcggaagaccgattggctgcccatgacggttgccgctatgggggtgcctcccctccctctgtttatcttctcccttaaagacacacccaagagaaaatcttggcctctgaacgagggagtgatggccgtcggcctggtgagcattctcgcctcctctctgcttcgcaacgatgttcccatggctgggccgctggtggcgggaggcctcctgatcgcctgttatgtcattaccgggaccagcgctgacctcacagtggagaaggccgccgacgttacctgggaagaggaagctgagcagacaggagtgtcccataatctgatgatcacggtcgatgacgatggcaccatgagaattaaagacgatgaaacagagaacatccttaccgtgctgctgaagacagccctcctgatcgtcagcggcatttttccttactctatccccgcgacccttctggtgtggcacacgtggcagaaacagacccaacggtccggggttctctgggacgtgccttctcccccggagacacagaaggctgaactggaggaaggagtctaccgcattaagcagcagggcatcttcgggaaaacccaagtgggagttggcgtgcagaaggagggggtctttcatacaatgtggcacgtgaccagaggagccgtgctcacacacaatggcaaacggctggagcctaactgggcctccgttaagaaagatcttatttcctatggcgggggatggcgcctgagcgctcagtggcaaaagggcgaagaggtccaggtgatcgccgtggaacccgggaagaatcctaaaaacttccagacgatgcccggaattttccagaccacaaccggcgagatcggggcgatcgctctggactttaagcccggaacctctggctcccctattatcaatagagaaggcaaagtcgtggggctctacggaaacggcgttgtgacaaagaatgggggatatgtcagcggcattgcccaaacgaacgccgagccggatgggcccacccctgagctggaagaggaaatgttcaaaaagcggaatcttacaatcatggacctgcatcccggctccggaaagacccgcaaatacctccctgctattgtgagagaggccatcaagcggcgcctgagaacactcatcctggctcccacccgggttgtggccgcggaaatggaggaggcccttaaaggcctgcctattagatatcagacgacagctaccaagagcgaacacaccgggcgcgagatcgtcgatctgatgtgccatgccacatttaccatgcggctcctgtctccggtgagagttcccaactacaatcttattatcatggacgaagctcacttcacagatcctgccagcattgccgctcgcggatatatctccacccgggtgggcatgggggaggcggccgctatctttatgacggccacaccccctggaaccgccgaggctttcccccagtctaacgccccgattcaggacgaggagagagacatccctgaacgcagctggaatagcggcaacgagtggattacagattttgtcgggaaaaccgtgtggttcgtgccctctatcaaggcgggcaacgacattgctaattgtctgcggaagaacggcaaaaaggtcatccaactcagcagaaaaacgtttgataccgaataccagaagacacgcctgaatgactgggatttcgttgtgaccacagacatttccgagatgggagccaactttaaagccgatcgggtgatcgaccccagacggtgcctgaagcctgtcatcctcaccgatgggcccgagcgcgtgattcttgctggacctatgccggttacagccgcgtctgccgctcagagacggggccgcgtggggagaaatccccagaaggaaaacgaccaatacatcttcaccggacagcctctgaataacgatgaggaccatgcccactggacggaagctaaaatgctgctcgacaatattaacacacccgagggcatcattcctgccctgttcgaacccgagcgggaaaagagcgctgccatcgatggggaatatagacttaaaggcgagtcccgcaagacctttgtcgaactgatgcggagaggagacctcccggtgtggctggcgcacaaagttgccagcgagggcatcaagtacaccgatcgcaaatggtgcttcgacggggaacggaataaccagattctggaggagaatatggatgtggaaatctggacaaaggagggagaaagaaagaaactccgccctcggtggcttgacgctagaacctattctgatcccctggccctgaaggagtttaaagacttcgctgccggccgcaagtccattgccctcgatctggtcacagaaatcgggagagtgcctagccatcttgctcaccggacgcgcaacgcgctggacaatctcgtcatgctgcatacctctgagcacggaggcagagcctaccggcacgctgtggaggaactgcccgagacaatggaaaccctccttctgctgggcctcatgattctgcttacagggggagccatgctgtttctcatctccggcaaagggatcggaaagaccagcattggcctgatctgtgttattgtgtcctctgggatgctgtggatggccgatgtgcctctccagtggatcgctagcgccattgtccttgagttctttatgatggttctgctgatccccgagccggaaaagcaacgcacgcctcaggacaaccagctcgcgtatgtggtgattggaatcctgacccttgccgctatcgtcgccgctaatgagatgggcctgctcgaaacaaccaaaagagatctgggcatgtccaaggagcccggggtggttagccccacatcttacctggacgtggacctccatcctgcctccgcgtggaccctttatgccgtcgctacgacagtgattaccccgatgctgcggcacacaatcgaaaacagcaccgccaacgtctctctggctgccattgctaatcaagccgtggttctcatgggactggataaaggctggcccatcagcaagatggaccttggggtgcctctgctcgcgctgggatgctactcccaggtcaaccccctgaccctcacagccgctgtgcttctgctggttacgcattacgccattatcggccctgggctccaggctaaagccaccagagaggcccagaagcgcacagcggctggaatcatgaagaatcccaccgtggatggcattatgacaatcgacctggatcctgtcatttatgactctaaattcgagaagcaacttggccaggtgatgctgctcgtgctgtgtgccgttcagctgctccttatgcggaccagctgggctctgtgcgaagccctgacgctcgccacagggccgatcaccaccctgtgggagggatcccccggcaaattttggaacacaaccattgctgtctctatggccaatatcttcagagggagctaccttgcgggagccggcctggctttttccatcatgaaaagcgtggggacaggacgccggggcacgggctctcagggggaaaccctcggagagaaatggaagaagaaactgaaccaactgtccagaaaggagttcgatctctataaaaagagcggcattacagaggtggaccggaccgaggccaaagaagggcttaagcgcggagagacaacccaccatgctgtctccagaggctctgccaaactgcagtggtttgttgaacggaatatggtgatccctgaggggcgcgtgattgatctgggatgtggcagaggcgggtggagctactattgcgcgggactcaagaaggtcacggaagtgcggggctacaccaaagggggacccggccacgaggagcctgttcccatgtccacatatgggtggaacatcgtgaagctgatgtctggaaaagacgtcttctaccttccgcctgaaaagtgtgataccctgctctgcgacattggcgagagctcccccagccccacagtggaagagtctcgcaccatcagagttctgaaaatggtggagccttggctgcggaataaccagttctgtattaaggtcctcaatccctacatgcctaacgtgatcgaacaccttgagcgcctgcagagaaagtatggcgggatgctggtgcggaatccgctctccagaaacagcacacatgaaatgtactggatctctaatggaaccggcaacattgtctccagcgttaacatggtgtctcgcctgcttctgaatcggtttacgatgacacacagacgccccaccatcgagaaagatgtggacctcggggccggaacccggcatgtcaacgctgaacctgagacacccaatatggacgtgattggcgagagaatcaagcgcattaaagaagaacacagctccacgtggcactatgatgacgaaaacccttacaagacctgggcctatcatgggtcttacgaggttaaagctacaggaagcgcctccagcatgatcaatggcgtggtcaagctgctgaccaagccctgggatgtggttccgatggtgacacaaatggctatgaccgacacaacccctttcggccagcagcgggtctttaaagaaaaggtggatacgagaacaccccgccctatgcccgggacacggaaagttatggagatcaccgccgagtggctctggagaacactgggacgcaacaagaaacctcggctttgcaccagagaagagttcacgaagaaggtgcgcacaaatgcggccatgggcgctgtctttaccgaagagaaccaatgggactccgccagagctgccgtggaagatgaggagttctggaaactggtcgacaaggaacgggagctccacaaactggggaagtgtggatcttgcgtgtataatatgatgggcaaacgcgaaaagaaacttggggagtttggcaaggccaagggaagcagagcgatttggtacatgtggctgggcgctcggtacctcgagttcgaagccctggggtttctgaacgaggatcattggttctccagagaaaattcttatagcggagttgagggcgaagggctccacaaactgggatacatccttcgggacatttccaagatccccggcggggccatgtatgctgatgacacagccggctgggacacccgcattacggaggatgacctgcataacgaggagaagatcacccagcagatggatccggagcacagacagctcgctaatgccatctttaagctgacataccaaaacaaagtggtcaaggtgcagcggcctacccccaagggaacagtgatggacattatctctcgcaaagatcagagaggcagcgggcaggttggaacctatggccttaatacattcaccaacatggaagcgcaactggtgcggcagatggagggggaaggagtcctctccgaggccgacctggagaacccccatctgctcgaaaagaaaattacgcagtggctggagacaaagggcgtggaacgccttaaaagaatggctatcagcggggatgactgcgttgtgaagcctattgatgaccggtttgccaatgctctgctcgccctgaacgatatgggcaaggtccgcaaagacatcccgcagtggcaaccctctaagggatggcatgattggcaacaggtgcctttctgttcccaccatttccacgagcttatcatgaaagacggcagaaagctggtcgtgccctgccggcctcaggacgaactcattgggcgcgcgagaatcagccaaggagccggctggtctctgaaagagaccgcttgtctggggaaggcctacgctcagatgtggtccctcatgtattttcaccggcgcgatctgagacttgccagcaatgctatttgctctgccgttcccgtgcattggatccctacctcccggacaacctggagcattcacgcgcatcaccagtggatgacaacggaggacatgctgaccgtctggaacagagtgtggatcgaagataatccctggatggaggacaagacaccggttaccacatgggaagatgtgccttacctcggaaaacgcgaggaccaatggtgtggctccctgattgggcttaccagccgggccacgtgggctcagaacatcctgaccgccatccagcaggtcagatctctcattggcgatgaggagttcctggactacatgcccagcatgaagcgctttcggaaagaggaagagtccgaaggagccatctggtga

SEQ ID NO: 20493 - RNA, 9873 nt, synthetic construct
  misc_feature 1..9873: note = derived and/or modified CDS sequence (opt5) from DENV-3__KF955461__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgaccctgccggaggaacaggaccagaattatgtgtgtaaacacacctacgtggatcggggctgggggaacggatgcggccttttcgggaagggaagcctggtcacatgcgccaagtttcaatgtctcgagcccatcgagggcaaagtggttcagtatgaaaatctgaagtacaccgtgattatcacagtccacacgggggaccagcatcaggtgggaaacgacacccaaggcgttacagtggagatcacccctcaggcttctacagtcgaagccgtgctgcccgagtatggcaccctcgggctggaatgctcccctcgcacgggacttgatttcaatgagatgattctgctcaccatgaaaaacaaggcttggatggtccacagacagtggtttttcgacctgccccttccgtggacaagcggcgccaccacagagacccctacgtggaatcggaaagaactgctcgtgacatttaagaacgcccatgctaaaaagcaagaggttgtggtcctggggtctcaggaaggagcgatgcacaccgccctgacaggcgctaccgagatccagaattccgggggcaccagcattttcgccggacacctcaagtgtcgcctgaaaatggataagcttgaactgaaaggcatgtcttacgccatgtgcctcaacacatttgtgctgaagaaagaggtttccgagacgcagcatgggaccatcctgattaaggtggaatacaagggagaggacgctccctgtaaaatccctttcagcacagaagatggccaagggaaggcccacaacggaagacttatcaccgcgaatcccgtcgtgacaaaaaaggaggagcccgtgaacattgaagctgagcctccgttcggcgaatccaatatcgttattgggatcggcgacaaagccctcaagattaactggtataagaaaggatctagcatcggcaagatgtttgaggccaccgctcggggggccagacgcatggctatcctgggagatacggcctgggacttcggctccgtcgggggagtgctgaatagcctcggcaaaatggtgcatcaggtctttgggtctgcgtacacagccctgttctccggcgtgagctggattatgaagatcggaattggcgttcttctgacctggatcgggctcaactctaaaaataccagcatgtccttttcttgcattgtgatcggaattatcacactgtatctgggcgctgtcgtgcaggccgatatggggtgtgttatcaactggaagggaaaggaacttaaatgcggcagcgggattttcgtgaccaatgaggtccacacatggacggagcagtacaagtttcaagctgactcccccaaacggctcgccaccgcgatcgccggcgcttgggaaaacggagtgtgtggcattagaagcacaacccgcatggagaatctgctgtggaagcagatcgccaacgaactcaattatattctgtgggagaacaatatcaaacttacagttgtggtcggggatatcattggagtgctggaacagggcaagcggaccctcacgcctcagcccatggagctgaaatactcttggaagacctgggggaaggctaaaatcgtgacagccgagacccaaaactccagcttcattatcgacggacctaacacacccgaatgcccgtctgcctccagagcttggaatgtctgggaggttgaagactatggctttggcgtgttcaccacaaacatttggctgaagcttcgcgaggtgtacacccagagctgtgatcatcggctcatgtccgcggccatcaaagacgaaagagctgtccacgccgatatggggtactggatcgagtctcagaagaatggaagctggaaactggagaaggcctcctttattgaagtgaagacgtgcacatggcctaaatctcacaccctgtggagcaacggcgttctcgagtccgacatgatcattcccaagagcctggctgggcctatctctcagcataatcaccgccccggatatcatacccaaacagccggcccttggcaccttgggaaactggaactcgatttcaactactgcgagggaaccacggtggcgattacagagaattgtggcacccggggcccctccctgagaacaaccacagtcagcgggaagctgatccacgaatggtgctgtcgctcttgcacccttccgcctctccggtatatgggagaggacggctgttggtacgggatggaaatcagacccattaacgagaaagaagagaatatggtgaagtccctggttagcgctggatctggcaaggtggataactttacgatgggggtcctgtgcctcgccatcctgttcgaggaagtgatgcggggaaaattcggcaagaaacatatgattgccggcgttctttttaccttcgtgctgctcctgagcgggcagatcacatggcgcgacatggctcacaccctgattatgatcggatccaatgccagcgatagaatgggcatgggggtcacatatcttgcgctgattgctacctttaagatccagcccttcctcgccctgggatttttcctccggaaactgacgtctagagagaaccttctgctcggcgtggggctggccatggctacaaccctgcaacttcctgaagacatcgagcagatggccaatggaattgctctgggcctcatgacactgaagctcatcacccagtttgaaacctaccagctgtggacagcccttgtgtccctgacgtgtagcaacaccattttcacactcaccgtcgcgtggcgcacagccaccctgatcctggctggcgtttcccttctgccgctctgccaatctagctccatgcggaagacggattggctgcccatgacagtggccgctatgggggtgcctcccctccctctgtttattttctctcttaaagacacccccaagagacgcagctggcctctgaatgagggagtcatggccgtgggcctggtttccatcctcgcctctagcctgcttagaaacgatgtgcccatggctgggccgctggtcgcgggaggcctcctgatcgcctgttatgtgattaccgggacatccgctgacctcaccgttgagaaagccgccgacgtgacatgggaagaggaagctgagcagacgggagtcagccataacctgatgatcaccgtggatgacgatggcacaatgcggattaaggacgatgaaaccgagaatatccttacagtcctgctgaaaaccgccctcctgattgtgtctggcatctttccttactccatccccgcgacgcttctggtttggcacacctggcagaagcagacacaacgcagcggggtgctctgggacgtcccttctcccccggagacccagaaagctgaactggaggaaggagtgtacagaattaagcagcagggcatcttcgggaagacacaagttggagtgggcgtccagaaagagggggtgtttcataccatgtggcacgtgacacggggagccgttctcacgcacaacggcaagcgcctggagcctaattgggcctccgtcaaaaaggatcttattagctatggcgggggatggagactgtctgctcagtggcaaaaaggcgaagaggtgcaggtgatcgccgtcgaacccgggaagaaccctaagaatttccagaccatgcccggaattttccagacaaccaccggcgagatcggggcgattgctctggactttaaacccggaacatccggcagccctatcatcaaccgggaaggcaaggtggttgggctctacggaaatggcgtggtcacgaaaaacgggggatatgtgtccggcattgcccaaaccaatgccgagccggatgggcccacacctgagctggaagaggaaatgttcaagaaacgcaaccttaccatcatggacctgcatcccggcagcggaaagacaagaaagtacctccctgctattgttcgggaggccatcaaacgcagactgcggaccctcattctggctcccacgagagtggtcgccgcggaaatggaggaggcccttaagggcctgcctatccgctatcagacaaccgctaccaaatctgaacacacagggcgggagatcgtggatctgatgtgccatgccacctttacaatgagactcctgagcccggttcgcgtgcccaattacaaccttgtcattatggacgaagctcacttcaccgatcctgcctccatcgccgctcggggatatatttctacgagagtgggcatgggggaggcggccgctatctttatgacagccaccccccctggaacagccgaagctttcccccagagcaatgccccgattcaggacgaggagcgcgacatccctgaacggtcctggaactctggcaatgagtggatcaccgattttgtggggaagacggtctggttcgttcccagcattaaagcgggcaacgacatcgctaactgtctgagaaagaatggaaagaaagtgattcaactctcccgcaagacctttgatacagaataccagaaaacccggctgaacgactgggatttcgtggtcacaaccgacatctctgagatgggcgccaattttaaggccgatagagtgattgacccccggcgctgcctgaaacctgttatcctcacagatgggcccgagagagtgattcttgctggacctatgccggtcaccgccgcgagcgccgctcagcggcgcggcagagtggggcggaacccccagaaggaaaatgaccaatacatcttcacgggacagcctctgaacaatgatgaggaccatgcccactggacagaagctaagatgctgctcgacaacatcaatacccccgagggcattatccctgccctgttcgaacccgagagagagaaatccgctgccattgatggggaatatcgccttaagggcgagagccggaaaacctttgttgaactgatgagacgcggagacctcccggtgtggctggcgcacaaggtcgcctctgagggcatcaaatacacagatcggaagtggtgcttcgacggggaaagaaacaatcagattctggaggagaacatggatgtggaaatctggaccaaagagggagaacgcaagaagctccggcctagatggcttgacgctcgcacatattccgatcccctggccctgaaagagtttaaggacttcgctgccggcagaaaaagcatcgccctcgatctggtcacggaaattgggcgggtgccttctcatcttgctcaccgcaccagaaatgcgctggacaacctcgttatgctgcatacatccgagcacggaggccgggcctaccgccacgctgtggaggaactgcccgagaccatggaaacactccttctgctgggcctcatgatcctgcttaccgggggagccatgctgtttctcattagcggcaaggggatcggaaaaacgtccattggcctgatctgtgtgatcgtctctagcgggatgctgtggatggccgatgttcctctccagtggattgcttccgccatcgtgcttgagttctttatgatggtgctgctgattcccgagccggaaaagcaaagaacccctcaggacaatcagctcgcgtatgtcgtgatcggaattctgacacttgccgctatcgttgccgctaacgagatgggcctgctcgaaaccacaaagcgggatctgggcatgagcaaagagcccggggtggtctctcccacctcctacctggacgtggacctccatcctgccagcgcgtggacgctttatgccgtcgctacaaccgtgattacaccgatgctgagacacaccatcgaaaattctaccgccaacgttagcctggctgccatcgctaaccaagccgtggtcctcatgggactggataagggctggcccatttccaaaatggaccttggggtgcctctgctcgcgctgggatgctactctcaggttaatcccctgacactcacggccgctgtgcttctgctggtcacccattacgccatcattggccctgggctccaggctaaggccacacgcgaggcccagaaacggaccgcggctggaatcatgaagaaccccacagtggatggcattatgaccatcgacctggatcctgtgatctatgacagcaagttcgagaaacaacttggccaggttatgctgctcgtcctgtgtgccgtgcagctgctccttatgagaacgtcctgggctctgtgcgaagccctgacactcgccaccgggccgattaccacactgtgggagggatctcccggcaagttttggaataccacaatcgctgtgagcatggccaacattttccgcgggtcctaccttgcgggagccggcctggcttttagcatcatgaaatctgtcgggacgggacggagaggcaccggctcccagggggaaacactcggagagaagtggaaaaagaagctgaatcaactgagccggaaagaattcgatctctataagaaatccggcattaccgaggttgaccgcacagaggccaaggaagggcttaaaagaggagagaccacgcaccatgctgtgtctcggggcagcgccaagctgcagtggtttgtggaacgcaacatggtcatccctgaggggagagtgatcgatctgggatgtggccggggcgggtggtcctactattgcgcgggactcaaaaaggttaccgaagtgcgcggctacacaaaggggggacccggccacgaggagcctgtccccatgtctacctatgggtggaatattgtgaaactgatgagcggaaaggacgttttctaccttccgcctgaaaaatgtgatacactgctctgcgacatcggcgagtccagcccctctcccaccgtggaagagtccagaacaattcgggtcctgaagatggtggagccttggctgaaaaacaatcagttctgtatcaaggtgctcaacccctacatgcctaccgtcattgaacaccttgagcgcctgcagagaaagtatggcgggatgctggttcggaatccgctcagcagaaactctacgcatgaaatgtactggatctccaatggaacaggcaacattgtgagctctgtgaatatggtcagccgcctgcttctgaaccggtttaccatgacccacagacgccccacaatcgagaaagatgtggacctcggggccggaacgcggcatgttaacgctgaacctgagacccccaatatggacgtgatcggcgagagaattaagcgcatcaaagaagagcactcctctacatggcactatgatgacgaaaacccttacaagacctgggcctatcatgggagctacgaggtcaaagctacaggatccgccagctccatgattaatggcgtggttaagctgctgaccaagccctgggatgtggtcccgatggtgacacaaatggctatgaccgacacgacccctttcggccagcagcgggtttttaaagaaaaggtggatacaagaaccccccgccctatgcccgggacacggaaagtcatggagatcaccgccgagtggctctggagaacgctgggacgcaacaagaaacctcggctttgcacaagagaagagttcaccaagaaggtgcgcacaaatgcggccatgggcgctgtctttaccgaagagaaccaatgggactctgccagagctgccgtggaagatgaggagttctggaaactggttgaccgggaacgcgagctccacaagctggggaaatgtggaagctgcgtgtataatatgatgggcaagagagaaaaaaagcttggggagtttggcaaagccaagggatcccgggcgatttggtacatgtggctgggcgctagatacctcgagttcgaagccctggggtttctgaacgaggatcattggttctctcgggaaaatagctattccggagtcgagggcgaagggctccacaagctgggatacatccttcgcgacatctctaaaattcccggcggggccatgtatgctgatgacacggccggctgggacaccagaatcacagaggatgacctgcataacgaggaaaagattacccagcagatggatccggagcaccggcagctcgctaatgccatctttaaactgacataccaaaacaaggtggtgaaagttcagcgccctacccccaagggaacagtgatggacattatcagcagaaaggatcagcggggctccgggcaggtcggaacctatggccttaatacgttcacaaacatggaagcgcaactggtgcgccagatggagggggaaggagttctcagcaaagccgacctggagaatccccaccagctggagaagaaaatcacccagtggctcgaaaccaagggcgtggagagactgaaacggatggctatttctggggatgactgcgtcgtgaagcctatcgatgaccgctttgccaacgctcttctggccctcaacgatatgggcaaggtcagaaaagacattccgcaatggcagccctccaagggatggcatgattggcagcaggtgcctttctgtagccaccatttccacgaactgatcatgaaagacggccggaagcttgttgtgccctgccgccctcaagacgagctgattgggagagcgcggatctctcagggagccggctggtccctcaaagaaacagcttgtctggggaaggcctacgctcagatgtggagcctgatgtattttcaccgcagagatctccggctggcctctaatgctatctgctccgccgtccccgtgcattggattcctaccagcagaacaacgtggtccatccacgcgcatcaccaatggatgaccacagaggacatgcttaccgtttggaaccgcgtgtggattgaggataatccctggatggaagacaagacaccggtcaccacgtgggaggatgtgccttacctgggaaaacgggaagaccagtggtgtggcagcctcatcgggctgacctctagagccacatgggctcagaacattcttaccgccatccagcaagtgcgcagcctgattggcgatgaggagttcctcgactacatgccctccatgaagcggtttagaaaagaagaggaatctgagggagccatctggtga

SEQ ID NO: 20494 - RNA, 9873 nt, synthetic construct
  misc_feature 1..9873: note = derived and/or modified CDS sequence (opt5) from DENV-3__FJ639719__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccaccggcattaatatgtgtacccttatcgcgatggatctgggggagatgtgcgacgatacagtgacctacaagtgtccgctcattgctgaagttgagcccgaagacatcgattgctggtgtaacctgacaagcacctgggtgacgtatggaacctgcaatcaggccggcgagcatagacgggacaagcgctccgtggccctggctcctcacgtcgggatgggactcgatacaagaacccagacatggatgtctgccgagggcgcttggcggcaggtcgaaaaggttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacctgcgccaagtttcaatgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaaccgagacacctacctggaatcggaaagaactgctcgtgacgtttaagaacgcccatgctaaaaagcaagaggttgtggtcctggggagccaggaaggagcgatgcacacagccctgaccggcgctacagagatccaaaattctgggggcacctccattttcgccggacacctcaagtgtcgcctgaaaatggataaacttgaactgaaaggcatgagctacgccatgtgcctcaacacctttgtgctgaagaaagaggtttctgagacacagcatgggacgatcctgatcaaggtggaatacaagggagaggacgctccctgtaaaattcctttctccaccgaagatggccaagggaaggcccacaacggaagacttatcacagcgaatcccgtcgtgaccaaaaaggaggagcccgtgaacattgaagctgagcctccgttcggcgaaagcaatatcgttattgggatcggcgacaaagccctcaagatcaactggtataagaaaggatcctctattggcaagatgtttgaggccacagctagaggggccagacgcatggctatcctgggagataccgcctgggacttcggcagcgtcgggggagtgctgaatagcctcggcaaaatggtgcatcagatttttgggagcgcgtacacggccctgttctctggcgtctcctggatcatgaagattggaatcggcgtgcttctgacatggattgggctcaacagcaaaaatacctctatgagcttttcctgcatcgttatcggaattatcaccctgtatctgggcgctgtggtccaggccgatatggggtgtgtgattaactggaagggaaaggaacttaaatgcggctctgggatcttcgttacaaatgaggtgcacacctggacagagcagtacaagtttcaagctgacagccccaaacggctcgccacggcgattgccggcgcttgggaaaacggagtctgtggcatcagatccaccacacgcatggagaatctgctgtggaagcagatcgccaacgaactcaattatattctgtgggagaacaatatcaaacttaccgtggttgtgggggatattatcggagtcctggaacagggcaagcggacactcacccctcagcccatggagctgaaatacagctggaagacgtgggggaaggctaaaattgtgaccgccgagacacaaaactcttccttcatcatcgacggacctaacacccccgaatgcccgagcgcctctagagcttggaatgtgtgggaggtcgaagactatggctttggcgttttcacaaccaacatttggctgaaacttcgcgaggtgtacacacagtcctgtgatcatcggctcatgagcgcggccatcaaagacgaaagagctgtgcacgccgatatggggtactggattgagtcccagaagaatggatcttggaaactggagaaggccagctttatcgaagtcaagacctgcacgtggcctaaatcccacacactgtggtctaacggcgtgctcgagagcgacatgattatccccaagtccctggctgggcctatcagccagcataatcaccgccccggatatcatacccaaaccgccggcccttggcaccttgggaaactggaactcgatttcaactactgcgagggaacaaccgttgtgattacggagaattgtggcacacggggcccctctctgagaaccacaaccgtctccgggaagctgatccacgaatggtgctgtcgcagctgcacacttccgcctctccggtatatgggagaggacggctgttggtacgggatggaaattagacccatcaacgagaaagaagagaatatggtgaagtctctggtttccgcgggaagcggcaaggtggataactttaccatgggggtcctgtgcctcgctattctgttcgaggaagtgatgcggggaaaattcggcaagaaacatatgatcgccggcgttctttttacgttcgtgctgctcctgtctgggcagattacctggcgcgacatggcccacacactgatcatgatcggaagcaatgcttccgatagaatgggcatgggggtcacccatcttgccctgattgcgacatttaagatccagcccttcctcgctctgggatttttcctccggaaactgaccagcagagagaaccttctgctcggcgtggggctggccatggccacgacactgcaacttcctgaagacattgagcagatggctaatggaatcgccctgggcctcatgaccctgaagctcattacacagtttgaaacctatcagctgtggaccgctcttgtgtctctgacatgttccaacacgatcttcaccctcacagtcgcctggcgcaccgcgacactgatcctggccggcgttagccttctgccgctctgccaatcctctagcatgcggaagaccgattggctgcccatgacggtggctgccatgggggtgcctcccctccctctgtttattttctcccttaaagacacacccaagagacgctcttggcctctgaatgagggagtcatggctgtgggcctggttagcatcctcgcctcctctctgcttagaaacgatgtgcccatggccgggccgctggtcgctggaggcctcctgattgcgtgttacgtgatcaccgggaccagcgccgacctcacagttgagaaagctgccgacgtgacctgggaagaggaagccgagcagacaggagtctcccacaacctgatgattacggtggatgacgatggcaccatgcggatcaaggacgatgaaacagagaatatccttaccgtcctgctgaaaacagctctcctgattgtgagcggcatctttccttattctattcccgccacccttctggtttggcatacgtggcagaagcagacccaacgctccggggtgctctgggacgtcccttctcccccggagacacagaaagcggaactggaggaaggagtgtacagaatcaagcagcagggcattttcgggaagacccaagttggagtgggcgtccagaaagagggggtgtttcacacaatgtggcacgtgacccggggagctgttctcacacataacggcaagcgcctggagcctaattgggcctccgtcaaaaaggatcttatctcctacggcgggggatggagactgagcacgcagtggcaaaaaggcgaagaggtccaggtgattgccgtcgaacccgggaagaaccctaagaatttccagaccatgcccggaatcttccagacaaccaccggcgagatcggggctattgccctggactttaaacccggaacatctggctcccctatcattaaccgggaaggcaaggtggttgggctctatggaaatggcgtggtcacgaaaaacgggggatacgtgagcggcatcgcgcaaaccaatgctgagccggatgggcccacacctgagctggaagaggaaatgttcaagaaacgcaaccttaccattatggacctgcaccccggctccggaaagacaagaaagtatctccctgccatcgttcgggaggccatcaaacgcagactgcggaccctcattctggctcccacgagagtggtcgccgctgaaatggaggaggcccttaagggcctgcctatccgctaccagacaaccgcgaccaaaagcgaacatacagggcgggagattgtggatctgatgtgccacgccacctttacaatgagactcctgtctccggttcgcgtgcccaattataaccttatcattatggacgaagctcatttcaccgatcctgccagcatcgctgcccggggatacatctccacgagagtcggcatgggggaggccgctgcgatttttatgacagccacaccccctggaacagctgaagccttcccccagtctaatgccccgatccaggacgaggagcgcgacattcctgaacggagctggaactccggcaatgagtggatcaccgattttgtggggaagacggtgtggttcgtcccctctattaaagctggcaacgacatcgccaactgtctgagaaagaatggaaagaaagttattcaactcagccgcaagacctttgatacagaatatcagaaaacccggctgaacgactgggatttcgtggtgacaaccgacatctccgagatgggcgcgaattttaaggctgatagagtcatcgacccccggcgctgcctgaaacctgtgattctcacagatgggcccgagagagttatccttgccggacctatgccggtgaccgccgcttctgccgcgcagcggcgcggcagagtcgggcggaacccccagaaggaaaatgaccaatacattttcacgggacagcctctgaacaatgatgaggaccacgcccactggacagaagctaagatgctgctcgacaacatcaatacccccgagggcattatccctgccctgttcgaacccgagagagagaaaagcgctgccatcgatggggaataccgccttaagggcgagtcccggaaaacctttgtggaactgatgagacgcggagacctcccggtttggctggctcataaggtggccagcgagggcattaaatatacagatcggaagtggtgcttcgacggggaaagaaacaatcagatcctggaggagaacatggatgtcgaaatttggaccaaagagggagaacgcaagaagctccggcctagatggcttgacgcgcgcacatactctgatcccctggccctgaaagagtttaaggacttcgctgccggcagaaaatccatcgctctcgatctggtgacggaaattgggcgggtccctagccaccttgcccatcgcaccagaaatgccctggacaacctcgtgatgctgcacacatctgagcacggaggccgggcttatcgccatgcggttgaggaactgcccgagaccatggaaacactccttctgctgggcctcatgatcctgcttaccgggggagccatgctgtttctcgtgtccggcaaggggatcggaaaaacgaccattggcctgatctgtgtgattgtcagctccgggatgctgtggatggctgatatccctctccagtggattgcctctgccatcgttcttgagttctttatgatggtgctgctgattcccgagccggaaaagcaaagaacacctcaggacaatcagctcgcttacgtggtcatcggaatcctgacccttgccgcgattgtggccgctaacgagatgggcctgctcgaaacaaccaagcgggatctgggcatgagcaaagagcccggggttgtgtcccccacgagctatctggacgtcgacctccaccctgcctctgcttggacactttacgccgtggcgaccacagtcatcaccccgatgctgagacataccattgaaaattccacagccaacgtgagcctggctgccatcgctaaccaagccgttgtgctcatgggactggataagggctggcccatttctaaaatggaccttggggtccctctgctcgctctgggatgctatagccaggtgaatcccctgacgctcaccgccgcggttcttctgctggtgacacactacgccatcatcggccctgggctccaggctaaggccacccgcgaggctcagaaacggacagccgccggaattatgaagaaccccaccgtcgatggcatcatgacgattgacctggatcctgtgatctacgactccaagttcgagaaacaacttggccaggtgatgctgctcgttctgtgtgcggtccagctgctccttatgagaacatcttgggctctgtgcgaagccctgaccctcgctaccgggccgattacaaccctgtgggagggaagccccggcaagttttggaatacaacgatcgccgtgtccatggccaacatcttccgcgggtcttatcttgctggagccggcctggcgtttagcattatgaaatccgtggggaccggacggagaggcacaggcagccagggggaaaccctcggagagaagtggaaaaagaagctgaatcaactgtctcggaaagagttcgatctctacaagaaatccggcatcacagaggtcgaccgcaccgaggccaaggaagggcttaaaagaggagagacgacccatcacgctgttagccggggctccgccaagctgcagtggtttgtggaacgcaacatggtgattcctgaggggagagtcatcgatctgggatgtggccggggcgggtggtcttattactgcgctggactcaaaaaggtgacagaagttcgcggctataccaaaggcgggcccgggcacgaggagcctgtgcccatgagcacatacgggtggaatattgtcaaactgatgtccggaaaggacgtgttctatcttccgcctgaaaaatgtgataccctgctctgcgacatcggcgagtctagcccctcccccacagttgaagagagcagaaccattcgggtgctgaagatggtcgagccttggctgaaaaacaatcagttctgtatcaaggtgctcaacccctacatgcctacggtgatcgaacatcttgagcgcctgcagagaaagtacggcgggatgctggtccggaatccgctctctagaaactccacacacgaaatgtattggattagcaatggaaccggcaacatcgtttcttccgtgaatatggtgagccgcctgcttctgaaccggtttaccatgacacatagacgccccacgattgagaaagatgtcgacctcggggccggaacccggcacgtgaacgcggaacctgagacacccaatatggacgttatcggcgagagaattaagcgcatcaaagaagaacactctagcacctggcattacgatgacgaaaacccttataagacatgggcctaccacgggtcctatgaggtgaaagctaccggatctgccagctccatgatcaatggcgtcgtgaagctgctgacaaagccctgggatgttgtgccgatggtcacccaaatggctatgacggacaccacacctttcggccagcagcgggtgtttaaagaaaaggttgataccagaacaccccgccctatgcccgggacccggaaagtgatggagattacggccgagtggctctggagaacactgggacgcaacaagaaacctcggctttgcaccagagaagagttcacaaagaaggtccgcaccaatgctgccatgggcgcggtgtttacggaagagaaccaatgggacagcgccagagctgccgtcgaagatgaggagttctggaaactggtggaccgggaacgcgagctccataagctggggaaatgtggatcctgcgtttacaatatgatgggcaagagagagaagaaacttggggagtttggcaaagctaagggatctcgggccatctggtatatgtggctgggcgccagattcctcgagtttgaagcgctggggttcctgaacgaggatcactggtttagccgggaaaattcctactctggagtggagggcgaagggctccataagctgggatacattcttcgcgacatcagcaaaattcccggcggggctatgtatgccgatgacaccgccggctgggacacaagaatcaccgaggatgacctgcacaacgaggaaaagatcacacagcagatggatccggagcaccggcagctcgctaatgccattttcaaactgacctaccaaaacaaggtcgtgaaagtgcagcgccctacacccaagggaaccgttatggacatcatttccagaaaggatcagcggggctctggacaggtgggaacgtatggccttaatacatttaccaacatggaagctcaactggtccgccagatggagggggaaggagtgctcagcaaagccgacctggagaatccccatctgctcgagaagaaaatcacccagtggctggaaaacaagggcgttgagagacttaaacggatggcgatttccggggatgactgcgtggtcaagcctatcgatgaccgcttcgccaacgctctgctcgccctgaatgatatgggcaaggtgagaaaagacatcccgcagtggcaacccagcaagggatggcacgattggcagcaggtccctttctgttctcatcactttcacgaacttattatgaaagacggccggaagctggtggttccctgccgccctcaggacgagctcatcgggagagctcggatttcccaaggagccggctggagcctgaaagaaacagcgtgtctggggaaggcctacgctcagatgtggtctctcatgtatttccatcgcagagatctgcggcttgcctccaacgctatctgcagcgccgtgcccgtccactgggtgcctacctctagaacaacgtggtccattcatgctcaccatcagtggatgaccacagaggacatgctgaccgtttggaatcgcgtgtggatcgaggataacccctggatggaagacaagacaccggtcaccacgtgggaggatgtgccttacctcggaaaacgggaagaccaatggtgtggcagcctgattgggcttacctccagagccacatgggcgcagaatatcctgaccgccatccaacaggtgcgcagcctcattggcgatgaggagtttctggactatatgccctctatgaagcggttcagaaaagaagaggaaagcgagggagctatctggtga

SEQ ID NO: 20495 - RNA, 9873 nt, synthetic construct
  misc_feature 1..9873: note = derived and/or modified CDS sequence (opt5) from DENV-3__KF955332__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccacaggcattaatatgtgtacccttatcgcgatggatctgggggagatgtgcgacgatacagtcacctacaagtgtccgctcattgctgaagttgagcccgaagacatcgattgctggtgtaacctgacaagcacctgggtgacgtatggaacctgcaatcaggccggcgagcaccggcgggacaagcgctccgtggccctggctcctcacgtcgggatgggactcgatacaagaacccagacatggatgtctgccgagggcgcttggagacaggtggaaaaagttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacatgcgccaagtttcaatgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaaccgagacacctacctggaatcggaaagaactgctcgtgacgtttaagaacgcccatgctaaaaagcaagaggttgtggtcctggggagccaggaaggagcgatgcacacagccctgaccggcgctacagagatccaaaattctgggggcacctccattttcgccggacacctcaagtgtcgcctgaaaatggataaacttgaactgaaaggcatgagctacgccatgtgcctcaacacctttgtgctgaagaaagaggtttctgagacacagcatgggacgatcctgatcaaggtggaatacaagggagaggacgctccctgtaaaattcctttctccaccgaagatggccaagggaaggcccacaacggaagacttatcacagcgaatcccgtcgtgaccaaaaaggaggagcccgtgaacattgaagctgagcctccgttcggcgaaagcaatatcgttattgggatcggcgacaaagccctcaagatcaactggtataagaaaggatcctctattggcaagatgtttgaggccacagctagaggggccagacgcatggctatcctgggagataccgcctgggacttcggcagcgtcgggggagtgctgaatagcctcggcaaaatggtgcatcagatttttgggagcgcgtacacggccctgttctctggcgtctcctggatcatgaagattggaatcggcgtgcttctgacatggattgggctcaacagcaaaaatacctctatgagcttttcctgcatcgttatcggaattatcaccctgtatctgggcgctgtggtccaggccgatatggggtgtgtgattaactggaagggaaaggaacttaaatgcggctctgggatcttcgttacaaatgaggtgcacacctggacagagcagtacaagtttcaagctgacagccccaaacggctcgccacggcgattgccggcgcttgggaaaacggagtctgtggcatcagatccaccacacgcatggagaatctgctgtggaagcagatcgccaacgaactcaattatattctgtgggagaacaatatcaaacttaccgtggttgtgggggatattatcggagtcctggaacagggcaagcggacactcacccctcagcccatggagctgaaatacagctggaagacgtgggggaaggctaaaattgtgaccgccgagacacaaaactcttccttcatcatcgacggacctaacacccccgaatgcccgagcgcctctagagcttggaatgtgtgggaggtcgaagactatggctttggcgttttcacaaccaacatttggctgaaacttcgcgaggtgtacacacagtcctgtgatcatcggctcatgagcgcggccatcaaagacgaaagagctgtgcacgccgatatggggtactggattgagtcccagaagaatggatcttggaaactggagaaggccagctttatcgaagtcaagacctgcacgtggcctaaatcccacacactgtggtctaacggcgtgctcgagagcgacatgattatccccaagtccctggctgggcctatcagccagcataatcaccgccccggatatcatacccaaaccgccggcccttggcaccttgggaaactggaactcgatttcaactactgcgagggaacaaccgttgtgattacggagaattgtggcacacggggcccctctctgagaaccacaaccgtctccgggaagctgatccacgaatggtgctgtcgcagctgcacacttccgcctctccggtatatgggagaggacggctgttggtacgggatggaaattagacccatcaacgagaaagaagagaatatggtgaagtctctggtttccgcgggaagcggcaaggtggataactttaccatgggggtcctgtgcctcgctattctgttcgaggaagtgatgcggggaaaattcggcaagaaacatatgatcgccggcgttctttttacgttcgtgctgctcctgtctgggcagattacctggcgcgacatggcccacacactgatcatgatcggaagcaatgcttccgatagaatgggcatgggggtcacctatcttgccctgattgcgacatttaagatccagcccttcctcgctctgggatttttcctccggaaactgaccagcagagagaaccttctgctcggcgtggggctggccatggccacgacactgcaacttcctgaagacattgagcagatggctaatggaatcgccctgggcctcatgaccctgaagctcattacacagtttgaaacctaccagctgtggaccgctcttgtgtctctgacatgttccaacacgatcttcaccctcacagtcgcctggcgcaccgcgacactgatcctggccggcgttagccttctgccgctctgccaatcctctagcatgcggaagaccgattggctgcccatgacggtggctgccatgggggtgcctcccctccctctgtttattttctcccttaaagacgctcccaagagacgctcttggcctctgaatgagggagtcatggccgtgggcctggttagcatcctcgcctcctctctgcttagaaacgatgtgcccatggctgggccgctggtcgcgggaggcctcctgattgcctgttatgtgatcacagggaccagcgctgacctcaccgttgagaaagccgccgacgtgacatgggaagaggaagctgagcagaccggagtctcccataacctgatgattacagtggatgacgatggcacgatgcggatcaaggacgatgaaaccgagaatatccttacagtcctgctgaaaaccgccctcctgattgtgagcggcatctttccttactctattcccgcgacacttctggtttggcacacctggcagaagcagacgcaacgctccggggtgctctgggacgtcccttctcccccggagacccagaaagctgaactggaggaaggagtgtacagaatcaagcagcagggcattttcgggaagacacaagttggagtgggcgtccagaaagagggggtgtttcataccatgtggcacgtgacacggggagccgttctcacccacaacggcaagcgcctggagcctaattgggcctccgtcaaaaaggatcttatctcctatggcgggggatggagactgagcacacagtggcaaaaaggcgaagaggtccaggtgattgctgtcgaacccgggaagaaccctaagaatttccagacgatgcccggaatcttccagaccacaaccggcgagatcggggccattgcgctggactttaaacccggaacctctggctcccctatcattaaccgggaaggcaaggtggttgggctctacggaaatggcgtggtcaccaagaacgggggatatgtgagcggcatcgctcaaacgaatgccgagccggatgggcccacccctgagctggaagaggaaatgttcaagaaacgcaaccttacaattatggacctgcatcccggctccggaaagaccagaaagtacctccctgccatcgttcgggaggctatcaaacgcagactgcggacactcattctggcccccaccagagtggtcgctgccgaaatggaggaggcgcttaagggcctgcctatccgctatcagacgacagccaccaaaagcgaacacaccgggcgggagattgtggatctgatgtgccatgctacatttaccatgagactcctgtctccggttcgcgtgcccaattacaaccttatcattatggacgaagcccacttcacagatcctgctagcatcgccgcccggggatatatctccaccagagtcggcatgggggaggctgcggccatttttatgacggctacaccccctggaaccgccgaagccttcccccagtctaatgctccgatccaggacgaggagcgcgacattcctgaacggagctggaactccggcaatgagtggatcacagattttgtggggaagaccgtgtggttcgtcccctctattaaagccggcaacgacatcgcgaactgtctgagaaagaatggaaagaaagttattcaactcagccgcaagacgtttgataccgaataccagaaaacacggctgaacgactgggatttcgtggtgaccacagacatctccgagatgggcgctaattttaaggccgatagagtcatcgacccccggcgctgcctgaaacctgtgattctcaccgatgggcccgagagagttatccttgccggacctatgccggtgacagctgcctctgcggcccagcggcgcggcagagtcgggcggaacccccagaaggaaaatgaccaatacattttcaccggacagcctctgaacaatgatgaggaccatgctcactggacggaagccaagatgctgctcgacaacatcaatacacccgagggcattatccctgctctgttcgaacccgagagagagaaaagcgccgctatcgatggggaatatcgccttaagggcgagtcccggaaaacctttgtggaactgatgagacgcggagacctcccggtttggctggcccacaaggtggcgagcgagggcattaaatacaccgatcggaagtggtgcttcgacggggaaagaaacaatcagatcctggaggagaacatggatgtcgaaatttggacaaaagagggagaacgcaagaagctccggcctagatggcttgacgcccgcacctattctgatcccctggctctgaaagagtttaaggacttcgccgctggcagaaaatccatcgccctcgatctggtgacagaaattgggcgggtccctagccatcttgcccaccgcacgagaaatgctctggacaacctcgtgatgctgcatacctctgagcacggaggccgggcgtaccgccacgccgttgaggaactgcccgagacaatggaaaccctccttctgctgggcctcatgatcctgcttacagggggagctatgctgtttctcgtgtccggcaaggggatcggaaaaaccacgattggcctgatctgtgtgattgtcagctccgggatgctgtggatggccgatatccctctccagtggattgcctctgctatcgttcttgagttctttatgatggtgctgctgattcccgagccggaaaagcaaagaacccctcaggacaatcagctcgcctatgtggtcatcggaatcctgacacttgcggccattgtggctgccaacgagatgggcctgctcgaaaccacaaagcgggatctgggcatgagcaaagagcccggggttgtgtcccccaccagctacctggacgtcgacctccatcctgcttctgcctggacgctttatgcggtggccacaaccgtcatcacaccgatgctgagacacaccattgaaaattccaccgctaacgtgagcctggccgctatcgccaaccaagctgttgtgctcatgggactggataagggctggcccatttctaaaatggaccttggggtccctctgctcgccctgggatgctacagccaggtgaatcccctgacactcacggcggccgttcttctgctggtgacccattacgctatcatcggccctgggctccaggccaaggctacacgcgaggcccagaaacggaccgccgcgggaattatgaagaaccccacagtcgatggcatcatgaccattgacctggatcctgtgatctatgactccaagttcgagaaacaacttggccaggtgatgctgctcgttctgtgtgctgtccagctgctccttatgagaacgtcttgggccctgtgcgaagctctgacactcgccaccgggccgattaccacactgtgggagggaagccccggcaagttttggaataccacaatcgccgtgtccatggctaacatcttccgcgggtcttaccttgccggagcgggcctggcctttagcattatgaaatccgtggggacgggacggagaggcaccggcagccagggggaaacactcggagagaagtggaaaaagaagctgaatcaactgtctcggaaagagttcgatctctataagaaatccggcatcaccgaggtcgaccgcacagaggctaaggaagggcttaaaagaggagagaccacgcaccatgccgttagccggggctccgctaagctgcagtggtttgtggaacgcaacatggtgattcctgaggggagagtcatcgatctgggatgtggccggggcgggtggtcttactattgcgccggactcaaaaaggtgaccgaagttcgcggctacacaaaaggcgggcccgggcacgaggagcctgtgcccatgagcacctatgggtggaatattgtcaaactgatgtccggaaaggacgtgttctaccttccgcctgaaaaatgtgatacactgctctgcgacatcggcgagtctagcccctcccccaccgttgaagagagcagaacaattcgggtgctgaagatggtcgagccttggctgaaaaacaatcagttctgtatcaaggtgctcaacccctacatgcctaccgtgatcgaacaccttgagcgcctgcagagaaagtatggcgggatgctggtccggaatccgctctctagaaactccacgcatgaaatgtactggattagcaatggaacaggcaacatcgtttcttccgtgaatatggtgagccgcctgcttctgaaccggtttaccatgacccacagacgccccacaattgagaaagatgtcgacctcggggcgggaacgcggcatgtgaacgccgaacctgagacccccaatatggacgttatcggcgagagaattaagcgcatcaaagaagaacactctagcacatggcactatgatgacgaaaacccttacaagacctgggcttatcatgggtcctacgaggtgaaagccacaggatctgctagctccatgatcaatggcgtcgtgaagctgctgaccaagccctgggatgttgtgccgatggtcacacaaatggccatgaccgacacgacccctttcggccagcagcgggtgtttaaagaaaaggttgatacaagaacaccccgccctatgcccgggacacggaaagtgatggagattaccgctgagtggctctggagaacgctgggacgcaacaagaaacctcggctttgcacaagagaagagttcaccaagaaggtccgcacaaatgccgcgatgggcgccgtgtttaccgaagagaaccaatgggacagcgctagagccgctgtcgaagatgaggagttctggaaactggtggaccgggaacgcgagctccacaagctggggaaatgtggatcctgcgtttataatatgatgggcaagagagagaagaaacttggggagtttggcaaagccaagggatctcgggccatctggtacatgtggctgggcgcgagattcctcgagtttgaagctctggggttcctgaacgaggatcattggtttagccgggaaaattcctactctggagtggagggcgaagggctccacaagctgggatatattcttcgcgacatcagcaaaattcccggcggggccatgtacgccgatgacacggctggctgggacaccagaatcacagaggatgacctgcataacgaggaaaagatcacccagcagatggatccggagcaccggcagctcgccaatgctattttcaaactgacatatcaaaacaaggtcgtgaaagtgcagcgccctacccccaagggaacagttatggacatcatttccagaaaggatcagcggggctctggacaggtgggaacctacggccttaatacgtttacaaacatggaagcccaactggtccgccagatggagggggaaggagtgctcagcaaaaccgacctggagaatccccatctgctcgagaagaaaatcacccagtggctggaaaacaagggcgttgagagacttaaacggatggcgatttccggggatgactgcgtggtcaagcctatcgatgaccgcttcgccaacgctctgctcgccctgaatgatatgggcaaggtgagaaaagacatcccgcagtggcaacccagcaagggatggcatgattggcagcaggtccctttctgttctcaccattttcacgaacttattatgaaagacggccggaagctggtggttccctgccgccctcaggacgagctcatcgggagagctcggatttcccaaggagccggctggagcctgaaagaaacagcgtgtctggggaaggcctatgctcagatgtggtctctcatgtacttccaccgcagagatctgcggcttgcctccaacgctatctgcagcgccgtgcccgtccattgggtgcctacctctagaacaacgtggtccattcacgctcatcaccagtggatgaccacagaggacatgctgaccgtttggaatcgcgtgtggatcgaggataacccctggatggaagacaagacaccggtcaccacgtgggaggatgtgccttatctcggaaaacgggaagaccaatggtgtggcagcctgattgggcttacctccagagccacatgggcgcagaatatcctgaccgccatccaacaggtgcgcagcctcattggcgatgaggagtttctggactacatgccctctatgaagcggttcagaaaagaagaggaaagcgagggagctatctggtga

SEQ ID NO: 20496 - RNA, 9873 nt, synthetic construct
  misc_feature 1..9873: note = derived and/or modified CDS sequence (opt5) from DENV-3__FJ639720__SS-prME
  source 1..9873: mol_type = other RNA
accagcctgtgcctcatgatgatgctgcccgccacacttgctttccacctgacgtcccgggacggagagcctcggatgatcgtggggaagaacgaacgcggaaagtctctcctgtttaagaccgccaccggcattaatatgtgtacccttatcgcgatggatctgggggagatgtgcgacgatacagtcacctacaagtgtccgctcattgctgaagttgagcccgaagacatcgattgctggtgtaacctgacaagcacctgggtgacgtatggaacctgcaatcaggccggcgagcacagacgggacaagcgctccgtggccctggctcctcacgtcgggatgggactcgatacaagaacccagacatggatgtctgccgagggcgcttggagacaggtggaaaaagttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacatgcgccaagtttcaatgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaaccgagacacctacctggaatcggaaagaactgctcgtgacgtttaagaacgcccatgctaaaaagcaagaggttgtggtcctggggagccaggaaggagcgatgcacacagccctgaccggcgctacagagatccaaaattctgggggcacctccattttcgccggacacctcaagtgtcgcctgaaaatggataaacttgaactgaaaggcatgagctacgccatgtgcctcaacacctttgtgctgaagaaagaggtttctgagacacagcatgggacgatcctgatcaaggtggaatacaagggagaggacgctccctgtaaaattcctttctccaccgaagatggccaagggaaggcccacaacggaagacttatcacagcgaatcccgtcgtgaccaaaaaggaggagcccgtgaacattgaagctgagcctccgttcggcgaaagcaatatcgttattgggatcggcgacaaagccctccggatcaactggtataagaagggatcctctattggcaaaatgtttgaggccacagctagaggggcccgccggatggctatcctgggagataccgcctgggacttcggcagcgtcgggggagtgctgaatagcctcggcaagatggtgcatcagatttttgggagcgcgtacacggccctgttctctggcgtctcctggatcatgaaaattggaatcggcgtgcttctgacatggattgggctcaacagcaagaatacctctatgagcttttcctgcatcgttatcggaattatcaccctgtatctgggcgctgtggtccaggccgatatggggtgtgtgattaactggaaaggaaaggaacttaagtgcggctctgggatcttcgttacaaatgaggtgcacacctggacagagcagtacaaatttcaagctgacagccccaagagactcgccacggcgattgccggcgcttgggaaaacggagtctgtggcatccgctccaccacacggatggagaatctgctgtggaaacagatcgccaacgaactcaattatattctgtgggagaacaatatcaaacttaccgtggttgtgggggatattatcggagtcctggaacagggcaaaagaacactcacccctcagcccatggagctgaagtacagctggaaaacgtgggggaaggctaagattgtgaccgccgagacacaaaactcttccttcatcatcgacggacctaacacccccgaatgcccgagcgcctctcgcgcttggaatgtgtgggaggtcgaagactatggctttggcgttttcacaaccaacatttggctgaaacttcgggaggtgtacacacagtcctgtgatcatagactcatgagcgcggccatcaaggacgaacgcgctgtgcacgccgatatggggtactggattgagtcccagaaaaatggatcttggaagctggagaaagccagctttatcgaagtcaagacctgcacgtggcctaagtcccacacactgtggtctaacggcgtgctcgagagcgacatgattatccccaaatccctggctgggcctatcagccagcataatcaccggcccggatatcatacccaaaccgccggcccttggcaccttgggaagctggaactcgatttcaactactgcgagggaacaaccgttgtgattacggagaattgtggcacaagaggcccctctctgcgcaccacaaccgtctccgggaaactgatccacgaatggtgctgtcggagctgcacacttccgcctctcagatatatgggagaggacggctgttggtacgggatggaaattcggcccatcaacgagaaggaagagaatatggtgaaatctctggtttccgcgggaagcggcaaggtggataactttaccatgggggtcctgtgcctcgctattctgttcgaggaagtgatgcgcggaaagttcggcaaaaagcatatgatcgccggcgttctttttacgttcgtgctgctcctgtctgggcagattacctggagagacatggcccacacactgatcatgatcggaagcaatgcttccgatcggatgggcatgggggtcacctatcttgccctgattgcgacatttaaaatccagcccttcctcgctctgggatttttcctcagaaagctgaccagccgcgagaaccttctgctcggcgtggggctggccatggccacgacactgcaacttcctgaagacattgagcagatggctaatggaatcgccctgggcctcatgaccctgaaactcattacacagtttgaaacctaccagctgtggaccgctcttgtgtctctgacatgttccaacacgatcttcaccctcacagtcgcctggcggaccgcgacactgatcctggccggcgttagccttctgccgctctgccaatcctctagcatgagaaagaccgattggctgcccatgacggtggctgccatgggggtgcctcccctccctctgtttattttctcccttaaggacacacccaaacgcagatcttggcctctgaatgagggagtcatggctgtgggcctggttagcatcctcgcctcctctctgcttcggaacgatgtgcccatggccgggccgctggtcgctggaggcctcctgattgcgtgttatgtgatcaccgggaccagcgccgacctcacagttgagaaggctgccgacgtgacctgggaagaggaagccgagcagacaggagtctcccataacctgatgattacggtggatgacgatggcaccatgcgcatcaaagacgatgaaacagagaatatccttaccgtcctgctgaagacagctctcctgattgtgagcggcatctttccttactctattcccgccacccttctggtttggcacacgtggcagaaacagacccaaagatccggggtgctctgggacgtcccttctcccccggagacacagaaggcggaactggaggaaggagtgtaccggatcaaacagcagggcattttcgggaagacccaagttggagtgggcgtccagaaggagggggtgtttcatacaatgtggcacgtgacccgcggagctgttctcacacacaacggcaaaagactggagcctaattgggcctccgtcaagaaagatcttatctcctatggcgggggatggcggctgagcacgcagtggcaaaagggcgaagaggtccaggtgattgccgtcgaacccgggaaaaaccctaagaatttccagaccatgcccggaatcttccagacaaccaccggcgagatcggggctattgccctggactttaagcccggaacatctggctcccctatcattaaccgcgaaggcaaagtggttgggctctacggaaatggcgtggtcacgaagaacgggggatatgtgagcggcatcgcgcaaaccaatgctgagccggatgggcccacacctgagctggaagaggaaatgttcaaaaagagaaaccttaccattatggacctgcatcccggctccggaaaaacacggaagtacctccctgccatcgttcgcgaggccatcaagagacggctgagaaccctcattctggctcccacgcgcgtggtcgccgctgaaatggaggaggcccttaaaggcctgcctatccggtatcagacaaccgcgaccaagagcgaacacacagggagagagattgtggatctgatgtgccatgccacctttacaatgcgcctcctgtctccggttcgggtgcccaattacaaccttatcattatggacgaagctcacttcaccgatcctgccagcatcgctgccagaggatatatctccacgcgcgtcggcatgggggaggccgctgcgatttttatgacagccacaccccctggaacagctgaagccttcccccagtctaatgccccgatccaggacgaggagcgggacattcctgaaagaagctggaactccggcaatgagtggatcaccgattttgtggggaaaacggtgtggttcgtcccctctattaaggctggcaacgacatcgccaactgtctgcgcaaaaatggaaagaaggttattcaactcagccggaaaacctttgatacagaataccagaagaccagactgaacgactgggatttcgtggtgacaaccgacatctccgagatgggcgcgaattttaaagctgatcgggtcatcgacccccgcagatgcctgaagcctgtgattctcacagatgggcccgagcgggttatccttgccggacctatgccggtgaccgccgcttctgccgcgcagcgcagaggccgggtcgggagaaacccccagaaagaaaatgaccaatacattttcacgggacagcctctgaacaatgatgaggaccatgcccactggacagaagctaagatgctgctcgacaacatcaatacccccgagggcattatccctgccctgttcgaacccgagcgcgaaaagagcgctgccatcgatggggaatatcggcttaaaggcgagtccagaaagacctttgtggaactgatgcgccggggagacctcccggtttggctggctcacaaagtggccagcgagggcattaagtacacagatagaaaatggtgcttcgacggggaacgcaacaatcagatcctggaggagaacatggatgtcgaaatttggaccaaggagggagaacggaaaaagctcagacctcgctggcttgacgcgagaacatattctgatcccctggccctgaaggagtttaaagacttcgctgccggccggaagtccatcgctattgatctcgtgacggaaatcgggcgcgtccctagccatctggcccacagaacccggaatgcccttgacaacctggtgatgctccatacatctgagcacggaggccgcgcttacagacacgcggttgaggaactgcccgagaccatggaaacactgctccttctgggcctgatgatcctcctgaccgggggagccatgctttttctggtgtccggcaaagggattggaaagacgaccatcggcctcatttgtgtgatcgtcagctccgggatgctgtggatggctgatattcctctgcagtggatcgcctctgccattgttctcgagttctttatgatggtgcttctgatccccgagccggaaaaacaacggacacctcaggacaatcagctggcttatgtggtcatcggcattctcaccctggccgcgatcgtggccgctaacgagatgggccttctggaaacaaccaagagagatctcggcatgagcaaggagcccggggttgtgtcccccacgagctacctggacgtcgacctgcatcctgcctctgcttggacactctatgccgtggcgaccacagtcattaccccgatgcttcgccacaccatcgaaaattccacagccaacgtgagcctggctgccattgctaaccaagccgttgtgctgatgggactcgataaaggctggcccatctctaagatggacctgggggtccctcttctggctctcggatgctacagccaggtgaatcccctgacgctgaccgccgcggttctccttctggtgacacattacgccatcattggccctgggctgcaggctaaagccacccgggaggctcagaagagaacagccgccggaatcatgaaaaaccccaccgtcgatggcattatgacgatcgacctcgatcctgtgatttatgactccaagttcgagaagcaactgggccaggtgatgcttctggttctctgtgcggtccagctgctgctcatgcgcacatcttgggctctttgcgaagccctgaccctggctaccgggccgatcacaaccctctgggagggaagccccggcaaattttggaatacaacgatcgccgtgtccatggccaacattttccgggggtcttacctggctggagccggccttgcgtttagcatcatgaagtccgtggggaccggaagacggggcacaggcagccagggggaaaccctgggagagaaatggaagaaaaagctcaatcaactgtctcgcaaggagttcgatctgtataaaaagtccggcattacagaggtcgacagaaccgaggccaaagaagggctcaagcggggagagacgacccaccatgctgttagccgcggctccgccaaacttcagtggtttgtggaaagaaacatggtgatccctgaggggcgggtcattgatctgggatgtggccgcggcgggtggtcttactattgcgctggactgaagaaagtgacagaagttagaggctacaccaaaggcgggcccgggcacgaggagcctgtgcccatgagcacatatgggtggaatatcgtcaagctcatgtccggaaaagacgtgttctacctgccgcctgaaaagtgtgatacccttctgtgcgacattggcgagtctagcccctcccccacagttgaagagagccggaccatccgcgtgctcaaaatggtcgagccttggctgaagaacaatcagttctgtatcaaagtgctgaacccctacatgcctacggtgattgaacacctcgagagacttcagcggaagtatggcgggatgctggtcagaaatccgctgtctcgcaactccacacatgaaatgtactggatcagcaatggaaccggcaacattgtttcttccgtgaatatggtgagccggctcctgcttaacagatttaccatgacacaccgccggcccacgatcgagaaggatgtcgacctgggggccggaaccagacatgtgaacgcggaacctgagacacccaatatggacgttattggcgagcgcatcaaacggatcaaggaagaacactctagcacctggcactatgatgacgaaaacccttacaaaacatgggcctatcatgggtcctacgaggtgaaggctaccggatctgccagctccatgattaatggcgtcgtgaaactcctgacaaagccctgggatgttgtgccgatggtcacccaaatggctatgacggacaccacacctttcggccagcagagagtgtttaaggaaaaagttgatacccgcacaccccggcctatgcccgggaccagaaaggtgatggagatcacggccgagtggctgtggcgcacactcggacggaacaaaaagcctagactgtgcacccgcgaagagttcaccaagaaggtcagaaccaatgctgccatgggcgcggtgtttacggaagagaaccaatgggacagcgcccgggctgccgtcgaagatgaggagttctggaaacttgtggaccgcgaaagagagctgcacaaactcgggaagtgtggatcctgcgtttataatatgatgggcaaacgggaaaagaaactgggggagtttggcaaggctaaaggatctagagccatttggtacatgtggcttggcgcccggttcctggagtttgaagcgctcgggttcctgaacgaggatcattggtttagccgcgaaaattcctactctggagtggagggcgaagggctgcacaagctcggatatatcctgagagacattagcaagatccccggcggggctatgtacgccgatgacaccgccggctgggacacacggatcaccgaggatgaccttcataacgaggagaagattacacagcagatggatccggagcaccgccagctggctaatgccatcttcaagctcacctatcaaaacaaagtcgtgaaggtgcagagacctacacccaaaggaaccgttatggacattatctcccggaaggatcagcgcggctctggacaggtgggaacgtacggcctgaatacatttaccaacatggaagctcaacttgtcagacagatggagggggaaggagtgctgagcaagaccgacctcgagaatccccatctgctggagaaaaagattacacagtggctcgaaaacaaaggcgttgagcggctgaagcgcatggccatctccggggatgactgcgtggtcaaacctatcgatgacagattcgcgaacgcccttctggctctcaatgatatgggcaaggtgcggaaggacattccgcagtggcaacccagcaaaggatggcatgattggcagcaggtccctttctgttctcaccattttcacgaactgatcatgaaggacggccgcaaacttgtggttccctgcagacctcaggacgagctgattgggcgggcccgcatctcccaaggagctggctggagcctcaaggaaaccgcctgtctggggaaagcgtatgcccagatgtggtctctgatgtacttccacagacgggatctcagactggcttccaacgccatttgcagcgctgtgcccgtccattgggtgcctacatctcgcacgacctggtccatccacgcccatcaccagtggatgacaaccgaggacatgcttacagtttggaatcgggtgtggattgaggataacccctggatggaagacaagaccccggtcacgacctgggaggatgtgccttatctgggaaagagagaagaccaatggtgtggcagcctcatcgggctgacatcccgcgctacctgggcccagaatatccttacagcgattcaacaggtgcggagcctgatcggcgatgaggagtttctcgactacatgccctctatgaaaagattccgcaaggaagaggaaagcgagggagccatttggtga

SEQ ID NO: 20497 - RNA, 9873 nt, synthetic construct
  misc_feature 1..9873: note = derived and/or modified CDS sequence (opt5) from DENV-3__GQ868626__SS-prME
  source 1..9873: mol_type = other RNA
accagcctgtgcctcatgatgatgctgcccgccacccttgctttccacctgacgtccagagacggcgagcctcggatgatcgtggggaagaacgaacgcggaaagtctctcctgtttaagaccgccacaggcattaatatgtgtacccttatcgcgatggatctgggggagatgtgcgacgatacagtgacctacaagtgtccgctcattgctgaagttgagcccgaagacatcgattgctggtgtaacctgacaagcacctgggtgacgtatggaacctgcaatcaggccggcgagcatagacgggacaagcgctccgtggccctggctcctcacgtcgggatgggactcgatacaagaacccagacatggatgtctgccgagggcgcttggcggcaggtcgaaaaagttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacctgcgccaagtttcagtgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaatcgagacccctacatggaatcggaaagaactgctcgtgacctttaagaacgcccatgctaaaaagcaagaggttgtggtcctggggagccaggaaggagcgatgcacacggccctgacaggcgctaccgagattcaaaattctgggggcacatccatcttcgccggacacctcaagtgtcgcctgaaaatggataaacttgaactgaaaggcatgagctacgccatgtgcctcaacacctttgtgctgagaaaggaggtttctgagacccagcatgggacaatcctgattaaagtggaatacaagggagaggacgctccctgtaagatccctttctccacggaagatggccaagggaaagcccacaacggacggcttattaccgcgaatcccgtcgtgacaaagaaagaggagcccgtgaacatcgaagctgagcctccgttcggcgaaagcaatattgttatcgggatcggcgacaaggccctcaaaattaactggtataagaagggatcctctatcggcaaaatgtttgaggccaccgctagaggggcccgccggatggctattctgggagatacagcctgggacttcggcagcgtcgggggagtgctgaatagcctcggcaagatggtgcatcagatctttgggagcgcgtacaccgccctgttctctggcgtctcctggattatgaaaatcggaattggcgtgcttctgacgtggatcgggctcaacagcaagaatacatctatgagcttttcctgcatcgttattggaatcattaccctgtatctgggcgctgtggtccaggccgatatggggtgtgtgatcaactggaaaggaaaggaacttaagtgcggctctgggattttcgttaccaatgaggtgcacacatggaccgagcagtacaaatttcaagctgacagccccaagagactcgccacagcgatcgccggcgcttgggaaaacggagtctgtggcatccgctccacgacccggatggagaatctgctgtggaaacagattgccaacgaactcaattatatcctgtgggagaacaatattaaacttacagtggttgtgggggatatcattggagtcctggaacagggcaaaagaaccctcacacctcagcccatggagctgaagtacagctggaaaacctgggggaaggctaagatcgtgacggccgagacccaaaactcttccttcatcattgacggacctaacacacccgaatgcccgagcgcctctcgcgcttggaatgtgtgggaggtcgaagactatggctttggcgttttcaccacaaacatctggctgaaacttcgggaggtgtacacccagtcctgtgatcatagactcatgagcgcggccattaaggacgaacgcgctgtgcacgccgatatggggtactggatcgagtcccagaaaaatggatcttggaagctggagaaagccagctttattgaagtcaagacatgcacctggcctaagtcccacacgctgtggtctaacggcgtgctcgagagcgacatgatcatccccaaatccctggctgggcctattagccagcataatcaccggcccggatatcatacacaaaccgccggcccttggcaccttgggaagctggaactcgatttcaactactgcgagggaaccacagttgtgatcaccgagaattgtggcacgagaggcccctctctgcgcacaaccacagtctccgggaaactgattcacgaatggtgctgtcggagctgcacccttccgcctctcagatatatgggagaggacggctgttggtacgggatggaaatccggcccattaacgagaaggaagagaatatggtgaaatctctggtttccgcgggaagcggcaaggtggataactttacaatgggggtcctgtgcctcgctatcctgttcgaggaagtgatgcgcggaaagttcggcaaaaagcatatgattgccggcgttctttttaccttcgtgctgctcctgtctgggcagatcacgtggagagacatggcccacaccctgatcatgattggaagcaatgcttccgatcggatgggcatgggggtcacatatcttgccctgatcgcgacctttaaaattcagcccttcctcgctctgggatttttcctcagaaagctgacaagccgcgagaaccttctgctcggcgtggggctggccatggccaccacgctgcaacttcctgaagacatcgagcagatggctaatggaattgccctgggcctcatgacactgaaactcatcacccagtttgaaacataccagctgtggaccgctcttgtgtctctgacctgttccaacacaatcttcacgctcaccgtcgcctggcggacagcgaccctgattctggccggcgttagccttctgccgctctgccaatcctctagcatgagaaagacagattggctgcccatgaccgtggctgccatgggggtgcctcccctccctctgtttatcttctcccttaaggacacgcccaaacgcagatcttggcctctgaatgagggagtcatggctgtgggcctggttagcattctcgcctcctctctgcttcggaacgatgtgcccatggccgggccgctggtcgctggaggcctcctgatcgcgtgttatgtgattacagggaccagcgccgacctcaccgttgagaaggctgccgacgtgacatgggaagaggaagccgagcagaccggagtctcccataacctgatgatcacagtggatgacgatggcacgatgcgcatcaaagacgatgaaaccgagaatattcttacagtcctgctgaagaccgctctcctgatcgtgagcggcatttttccttactctatccccgccacacttctggtttggcacacctggcagaaacagacgcaaagatccggggtgctctgggacgtcccttctcccccggagacccagaaggcggaactggaggaaggagtgtaccggattaaacagcagggcatcttcgggaagacacaagttggagtgggcgtccagaaggagggggtgtttcataccatgtggcacgtgacacgcggagctgttctcacccacaacggcaaaagactggagcctaattgggcctccgtcaagaaagatcttatttcctatggcgggggatggcggctgagcacacagtggcaaaagggcgaagaggtccaggtgatcgccgtcgaacccgggaaaaaccctaagaatttccagacgatgcccggaatcttccagaccacaaccggcgagattggggctatcgccctggactttaagcccggaacctctggctcccctattatcaaccgcgaaggcaaagtggttgggctctacggaaatggcgtggtcacaaagaacgggggatatgtgagcggcattgcgcaaacgaatgctgagccggatgggcccacccctgagctggaagaggaaatgttcaaaaagagaaaccttacaatcatggacctgcatcccggctccggaaaaacccggaagtacctccctgccatcgttcgcgaggccattaagagacggctgagaacactcatcctggctcccacccgcgtggtcgccgctgaaatggaggaggcccttaaaggcctgcctattcggtatcagacgacagcgaccaagagcgaacacaccgggagagagatcgtggatctgatgtgccatgccacatttaccatgcgcctcctgtctccggttcgggtgcccaattacaaccttattatcatggacgaagctcacttcacagatcctgccagcatcgctgccagaggatatatttccacccgcgtcggcatgggggaggccgctgcgatctttatgacggccacaccccctggaaccgctgaagccttcccccagtctaatgccccgattcaggacgaggagcgggacatccctgaaagaagctggaactccggcaatgagtggattacagattttgtggggaaaaccgtgtggttcgtcccctctatcaaggctggcaacgacattgccaactgtctgcgcaaaaatggaaagaaggttatccaactcagccggaaaacgtttgataccgaataccagaagacaagactgaacgactgggatttcgtggtgaccacagacatctccgagatgggcgcgaattttaaagctgatcgggtcattgacccccgcagatgcctgaagcctgtgatcctcaccgatgggcccgagcgggttattcttgccggacctatgccggtgacagccgcttctgccgcgcagcgcagaggccgggtcgggagaaacccccagaaagaaaatgaccaatacatcttcaccggacagcctctgaacaatgatgaggaccatgcccactggacggaagctaagatgctgctcgacaacattaatacacccgagggcatcatccctgccctgttcgaacccgagcgcgaaaagagcgctgccattgatggggaatatcggcttaaaggcgagtccagaaagacctttgtggaactgatgcgccggggagacctcccggtttggctggcttacaaagtggccagcgagggcatcaagtataccgatagaaaatggtgcttcgacggggaacgcaacaatcagattctggaggagaacatggatgtcgaaatctggacaaaggagggagaacggaaaaagctcagacctcgctggcttgacgcgagaacctactctgatcccctggccctgaaggagtttaaagacttcgctgccggccggaagtccattgctctcgatctggtgacagaaatcgggcgcgtccctagccaccttgcccatagaacgcggaatgccctggacaacctcgtgatgctgcacacctctgagcatggaggccgcgcttatagacacgcggttgaggaactgcccgagacaatggaaaccctccttctgctgggcctcatgatcctgcttacagggggagccatgctgtttctcatttccggcaaagggatcggaaagaccacgattggcctgatctgtgtgattgtgagctccgggatgctgtggatggctgatatccctctccagtggattgcctctgccatcgtccttgagttctttatgatggttctgctgatccccgagccggaaaaacaacggacccctcaggacaatcagctcgcttacgtggtgattggaatcctgacacttgccgcgattgtcgccgctaacgagatgggcctgctcgaaaccacaaagagagatctgggcatgagcaaggagcccggggtggtttcccccaccagctatctggacgtggacctccaccctgcctctgcttggacgctttacgccgtcgcgacaaccgtgatcacaccgatgctgcgccataccattgaaaattccaccgccaacgtcagcctggctgccatcgctaaccaagccgtggttctcatgggactggataaaggctggcccatctctaagatggaccttggggtgcctctgctcgctctgggatgctacagccaggtcaatcccctgacactcacggccgcggtgcttctgctggttacccactatgccattatcggccctgggctccaggctaaagccacacgggaggctcagaagagaaccgccgccggaattatgaaaaaccccacagtggatggcatcatgaccattgacctggatcctgtcatctacgactccaagttcgagaagcaacttggccaggtgatgctgctcgtgctgtgtgcggttcagctgctccttatgcgcacgtcttgggctctgtgcgaagccctgacactcgctaccgggccgatcaccacactgtgggagggaagccccggcaaattttggaataccacaattgccgtctccatggccaacatcttccgggggtcttatcttgctggagccggcctggcgtttagcattatgaagtccgtggggacgggaagacggggcaccggcagccagggggaaacactcggagagaaatggaagaaaaagctgaatcaactgtctcgcaaggagttcgatctctacaaaaagtccggcatcaccgaggtggacagaacagaggccaaagaagggcttaagcggggagagaccacgcatcacgctgtcagccgcggctccgccaaactgcagtggtttgttgaaagaaacatggtgattcctgaggggcgggtgatcgatctgggatgtggccgcggcgggtggtcttattactgcgctggactcaagaaagtcaccgaagtgagaggctatacaaaagggggacccggccatgaggagcctgttcccatgagcacctacgggtggaatattgtgaagctgatgtccggaaaagacgtcttctaccttccgcctgaaaagtgtgatacactgctctgcgacatcggcgagtctagcccctcccccaccgtggaagagagccggacaatccgcgttctgaaaatggtggagccttggctgaagaacaatcagttctgtattaaagtcctcaacccctatatgcctaccgtgatcgaacaccttgagagactgcagcggaagtacggcgggatgctggtgagaaatccgctctctcgcaactccacgcacgaaatgtattggattagcaatggaacaggcaacatcgtctcttccgttaatatggtgagccggctgcttctgaacagatttaccatgacccatcgccggcccacaattgagaaggatgtggacctcggggccggaacgagacacgtcaacgcggaacctgagacccccaatatggacgtgatcggcgagcgcatcaaacggattaaggaagaacactctagcacatggcactacgatgacgaaaacccttataaaacctgggcctaccacgggtcctatgaggttaaggctacaggatctgccagctccatgatcaatggcgtggtcaaactgctgaccaagccctgggatgtggttccgatggtgacacaaatggctatgaccgacacgacccctttcggccagcagagagtctttaaggaaaaagtggatacacgcacaccccggcctatgcccgggacaagaaaggttatggagattaccgccgagtggctctggcgcacgctgggacggaacaaaaagcctagactttgcacacgcgaagagttcaccaaaaaggtgagaacaaatgctgccatgggcgcggtctttaccgaagagaaccaatgggacagcgcccgggctgccgtggaagatgaggagttctggaagctggtcgaccgcgaaagagagctccataaactggggaagtgtggatcctgcgtgtacaatatgatgggcaaacgggaaaagaaacttggggagtttggcaaggctaaaggatctagagccatctggtacatgtggctgggcgcccggttcctcgagtttgaagcgctggggttcctgaacgaggatcactggtttagccgcgaaaattcctattctggagttgagggcgaagggctccataagctgggatacattcttagagacatcagcaagatccccggcggggctatgtatgccgatgacacggccggctgggacacccggattacagaggatgacctgcacaacgaggagaagatcacccagcagatggatccggagcatcgccagctcgctaatgccattttcaagctgacataccaaaacaaagtggtcaaggtgcagagacctacccccaaaggaacagtgatggacatcatttcccggaaggatcagcgcggctctgggcaggttggaacctatggccttaatacgtttacaaacatggaagctcaactggtgagacagatggagggggaaggagtcctcagcaaggccgacctggagaatccccatctgctcgagaaaaagatcacccagtggctggaaaacaaaggcgtggagcggcttaagcgcatggcgatctccggggatgactgcgttgtgaaacctattgatgacagattcgccaacgctctgctcgccctgaatgatatgggcaaggtccggaaggacatcccgcagtggcaacccagcaaaggatggcacgattggcaacaggtgcctttctgttctcatcactttcatgaacttattatgaaggacggccgcaaactggtcgtgccctgcagacctcaggacgagctcatcgggcgggctcgcatttcccaaggagccggctggagcctgaaggaaaccgcgtgtctggggaaagcctacgctcagatgtggtctctcatgtatttccacagacgggatctgagacttgcctccaacgctatctgcagcgccgttcccgtgcactgggtccctacatctcgcaccacatggtccattcatgctcaccatcagtggatgacgaccgaggacatgctggccgtgtggaatcgggtttggatcgaggataacccctggatggaagacaagacaccggtgaccacatgggaggatgtcccttacctcggaaagagagaagaccaatggtgtggcagcctgatcgggcttacctcccgcgcgacgtgggcccagaatattctgaccgctatccaacaggtgcggagcctcattggcgatgaggagtttctggactacatgccctctatgaaaagattccgcaaggaagaggaaagcgagggagccatctggtga

SEQ ID NO: 20498 - RNA, 9873 nt, synthetic construct
  misc_feature 1..9873: note = derived and/or modified CDS sequence (opt5) from DENV-3__GQ868627__SS-prME
  source 1..9873: mol_type = other RNA
accagcctgtgcctcatgatgatgctgcccgccacacttgctttccacctgacgtcccgggacggagagcctcggatgatcgtggggaagaacgaacgcggaaagtctctcctgtttaagaccgccaccggcattaatatgtgtacccttatcgcgatggatctgggggagatgtgcgacgatacagtcacctacaaatgtccgctcattgctgaagttgagcccgaagacatcgattgctggtgtaacctgacaagcacctgggtgacgtatggaacctgcaatcaggccggcgagcatagacgggacaagcgctccgtggccctggctcctcacgtcgggatgggactcgatacaagaacccagacatggatgtctgccgagggcgcttggagacaggtggaaaaagttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacatgcgccaagtttcagtgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaaccgagacacctacctggaatcggaaagaactgctcgtgacgtttaagaacgcccatgctaaaaagcaagaggttgtggtcctggggagccaggaaggagcgatgcacacagccctgaccggcgctacagagatccaaaattctgggggcacctccattttcgccggacacctcaagtgtcgcctgaaaatggataaacttgaactgaaaggcatgagctacgccatgtgcctcaacacctttgtgctgagaaaggaggtttctgagacacagcatgggacgatcctgatcaaagtggaatacaagggagaggacgctccctgtaagattcctttctccaccgaagatggccaagggaaagcccacaacggacggcttatcacagcgaatcccgtcgtgaccaagaaagaggagcccgtgaacattgaagctgagcctccgttcggcgaaagcaatatcgttattgggatcggcgacaaggccctcaaaatcaactggtataagaagggatcctctattggcaaaatgtttgaggccacagctagaggggcccgccggatggctatcctgggagataccgcctgggacttcggcagcgtcgggggagtgctgaatagcctcggcaagatggtgcatcagatttttgggagcgcgtacacggccctgttctctggcgtctcctggatcatgaaaattggaatcggcgtgcttctgacatggattgggctcaacagcaagaatacctctatgagcttttcctgcatcgttatcggaattatcaccctgtatctgggcgctgtggtccaggccgatatggggtgtgtgattaactggaaaggaaaggaacttaagtgcggctctgggatcttcgttacaaatgaggtgcacacctggacagagcagtacaaatttcaagctgacagccccaagagactcgccacggcgattgccggcgcttgggaaaacggagtctgtggcatccgctccaccacacggatggagaatctgctgtggaaacagatcgccaacgaactcaattatattctgtgggagaacaatatcaaacttaccgtggttgtgggggatattatcggagtcctggaacagggcaaaagaacactcacccctcagcccatggagctgaagtacagctggaaaacgtgggggaaggctaagattgtgaccgccgagacacaaaactcttccttcatcatcgacggacctaacacccccgaatgcccgagcgcctctcgcgcttggaatgtgtgggaggtcgaagactatggctttggcgttttcacaaccaacatttggctgaaacttcgggaggtgtacacacagtcctgtgatcatagactcatgagcgcggccatcaaggacgaacgcgctgtgcacgccgatatggggtactggattgagtcccagaaaaatggatcttggaagctggagaaagccagctttatcgaagtcaagacctgcacgtggcctaagtcccacacactgtggtctaacggcgtgctcgagagcgacatgattatccccaaatccctggctgggcctatcagccagcataatcaccggcccggatatcatacccaaaccgccggcccttggcaccttgggaagctggaactcgatttcaactactgcgagggaacaaccgttgtgattacggagaattgtggcacaagaggcccctctctgcgcaccacaaccgtctccgggaaactgatccacgaatggtgctgtcggagctgcacacttccgcctctcagatatatgggagaggacggctgttggtacgggatggaaattcggcccatcaacgagaaggaagagaatatggtgaaatctctggtttccgcgggaagcggcaaggtggataactttaccatgggggtcctgtgcctcgctattctgttcgaggaagtgatgcgcggaaagttcggcaaaaagcatatgatcgccggcgttctttttacgttcgtgctgctcctgtctgggcagattacctggagagacatggcccacacactgatcatgatcggaagcaatgcttccgatcggatgggcatgggggtcacctatcttgccctgattgcgacatttaaaatccagcccttcctcgctctgggatttttcctcagaaagctgaccagccgcgagaaccttctgctcggcgtggggctggccatggccacgacactgcaacttcctgaagacattgagcagatggctaatggaatcgccctgggcctcatgaccctgaaactcattacacagtttgaaacctaccagctgtggaccgctcttgtgtctctgacatgttccaacacgatcttcaccctcacagtcgcctggcggaccgcgacactgatcctggccggcgttagccttctgccgctctgccaatcctctagcatgagaaagaccgattggctgcccatgacggtggctgccatgggggtgcctcccctccctctgtttattttctcccttaaggacacacccaaacgcagatcttggcctctgaatgagggagtcatggctgtgggcctggttagcatcctcgcctcctctctgcttcggaacgatgtgcccatggccgggccgctggtcgctggaggcctcctgattgcgtgttatgtgatcaccgggaccagcgccgacctcacagttgagaaggctgccgacgtgacctgggaagaggaagccgagcagacaggagtctcccataacctgatgattacggtggatgacgatggcaccatgcgcatcaaagacgatgaaacagagaatatccttaccgtcctgctgaagacagctctcctgattgtgagcggcatctttccttactctattcccgccacccttctggtttggcacacgtggcagaaacagacccaaagatccggggtgctctgggacgtcccttctcccccggagacacagaaggcggaactggaggaaggagtgtaccggatcaaacagcagggcattttcgggaagacccaagttggagtgggcgtccagaaggagggggtgtttcatacaatgtggcacgtgacccgcggagctgttctcacacacaacggcaaaagactggagcctaattgggcctccgtcaagaaagatcttatctcctatggcgggggatggcggctgagcacgcagtggcaaaagggcgaagaggtccaggtgattgccgtcgaacccgggaaaaaccctaagaatttccagaccatgcccggaatcttccagacaaccaccggcgagatcggggctattgccctggactttaagcccggaacatctggctcccctatcattaaccgcgaaggcaaagtggttgggctctacggaaatggcgtggtcacgaagaacgggggatatgtgagcggcatcgcgcaaaccaatgctgagccggatgggcccacacctgagctggaagaggaaatgttcaaaaagagaaaccttaccattatggacctgcatcccggctccggaaaaacacggaagtacctccctgccatcgttcgcgaggccatcaagagacggctgagaaccctcattctggctcccacgcgcgtggtcgccgctgaaatggaggaggcccttaaaggcctgcctatccggtatcagacaaccgcgaccaagagcgaacacacagggagagagattgtggatctgatgtgccatgccacctttacaatgcgcctcctgtctccggttcgggtgcccaattacaaccttatcattatggacgaagctcacttcaccgatcctgccagcatcgctgccagaggatatatctccacgcgcgtcggcatgggggaggccgctgcgatttttatgacagccacaccccctggaacagctgaagccttcccccagtctaatgccccgatccaggacgaggagcgggacattcctgaaagaagctggaactccggcaatgagtggatcaccgattttgtggggaaaacggtgtggttcgtcccctctattaaggctggcaacgacatcgccaactgtctgcgcaaaaatggaaagaaggttattcaactcagccggaaaacctttgatacagaataccagaagaccagactgaacgactgggatttcgtggtgacaaccgacatctccgagatgggcgcgaattttaaagctgatcgggtcatcgacccccgcagatgcctgaagcctgtgattctcacagatgggcccgagcgggttatccttgccggacctatgccggtgaccgccgcttctgccgcgcagcgcagaggccgggtcgggagaaacccccagaaagaaaatgaccaatacattttcacgggacagcctctgaacaatgatgaggaccatgcccactggacagaagctaagatgctgctcgacaacatcaatacccccgagggcattatccctgccctgttcgaacccgagcgcgaaaagagcgctgccatcgatggggaatatcggcttaaaggcgagtccagaaagacctttgtggaactgatgcgccggggagacctcccggtttggctggcttacaaagtggccagcgagggcattaagtatacagatagaaaatggtgcttcgacggggaacgcaacaatcagatcctggaggagaacatggatgtcgaaatttggaccaaggagggagaacggaaaaagctcagacctcgctggcttgacgcgagaacatactctgatcccctggccctgaaggagtttaaagacttcgctgccggccggaagtccatcgctctcgatctggtgacggaaattgggcgcgtccctagccaccttgcccatagaacccggaatgccctggacaacctcgtgatgctgcacacatctgagcatggaggccgcgcttatagacacgcggttgaggaactgcccgagaccatggaaacactccttctgctgggcctcatgatcctgcttaccgggggagccatgctgtttctcatctccggcaaagggattggaaagacgaccatcggcctgatttgtgtgatcgtgagctccgggatgctgtggatggctgatattcctctccagtggatcgcctctgccattgtccttgagttctttatgatggttctgctgatccccgagccggaaaaacaacggacacctcaggacaatcagctcgcttacgtggtgatcggcattctgacccttgccgcgatcgtcgccgctaacgagatgggcctgctcgaaacaaccaagagagatctgggcatgagcaaggagcccggggtggtttcccccacgagctatctggacgtggacctccaccctgcctctgcttggacactttacgccgtcgcgaccacagtgattaccccgatgctgcgccataccatcgaaaattccacagccaacgtcagcctggctgccattgctaaccaagccgtggttctcatgggactggataaaggctggcccatctctaagatggaccttggggtgcctctgctcgctctgggatgctacagccaggtcaatcccctgacgctcaccgccgcggtgcttctgctggttacacactatgccatcattggccctgggctccaggctaaagccacccgggaggctcagaagagaacagccgccggaatcatgaaaaaccccaccgtggatggcattatgacgatcgacctggatcctgtcatttacgactccaagttcgagaagcaacttggccaggtgatgctgctcgtgctgtgtgcggttcagctgctccttatgcgcacatcttgggctctgtgcgaagccctgaccctcgctaccgggccgatcacaaccctgtgggagggaagccccggcaaattttggaatacaacgatcgccgtctccatggccaacattttccgggggtcttatcttgctggagccggcctggcgtttagcatcatgaagtccgtggggaccggaagacggggcacaggcagccagggggaaaccctcggagagaaatggaagaaaaagctgaatcaactgtctcgcaaggagttcgatctctacaaaaagtccggcattacagaggtggacagaaccgaggccaaagaagggcttaagcggggagagacgacccatcacgctgtcagccgcggctccgccaaactgcagtggtttgttgaaagaaacatggtgatccctgaggggcgggtgattgatctgggatgtggccgcggcgggtggtcttattactgcgctggactcaagaaagtcacagaagtgagaggctataccaaagggggacccggccatgaggagcctgttcccatgagcacatacgggtggaatatcgtgaagctgatgtccggaaaagacgtcttctaccttccgcctgaaaagtgtgataccctgctctgcgacattggcgagtctagcccctcccccacagtggaagagagccggaccatccgcgttctgaaaatggtggagccttggctgaagaacaatcagttctgtatcaaagtcctcaacccctatatgcctacggtgattgaacaccttgagagactgcagcggaagtacggcgggatgctggtgagaaatccgctctctcgcaactccacacacgaaatgtattggatcagcaatggaaccggcaacattgtctcttccgttaatatggtgagccggctgcttctgaacagatttaccatgacacatcgccggcccacgatcgagaaggatgtggacctcggggccggaaccagacacgtcaacgcggaacctgagacacccaatatggacgtgattggcgagcgcatcaaacggatcaaggaagaacactctagcacctggcactacgatgacgaaaacccttataaaacatgggcctaccacgggtcctatgaggttaaggctaccggatctgccagctccatgattaatggcgtggtcaaactgctgacaaagccctgggatgtggttccgatggtgacccaaatggctatgacggacaccacacctttcggccagcagagagtctttaaggaaaaagtggatacccgcacaccccggcctatgcccgggaccagaaaggttatggagatcacggccgagtggctctggcgcacactgggacggaacaaaaagcctagactttgcacccgcgaagagttcaccaagaaggtgagaaccaatgctgccatgggcgcggtctttacggaagagaaccaatgggacagcgcccgggctgccgtggaagatgaggagttctggaagctggtcgaccgcgaaagagagctccataaactggggaagtgtggatcctgcgtgtacaatatgatgggcaaacgggaaaagaaacttggggagtttggcaaggctaaaggatctagagccatttggtacatgtggctgggcgcccggttcctcgagtttgaagcgctggggttcctgaacgaggatcactggtttagccgcgaaaattcctattctggagttgagggcgaagggctccataagctgggatacatccttagagacattagcaagatccccggcggggctatgtatgccgatgacaccgccggctgggacacacggatcaccgaggatgacctgcacaacgaggagaagattacacagcagatggatccggagcatcgccagctcgctaatgccatcttcaagctgacctaccaaaacaaagtggtcaaggtgcagagacctacacccaaaggaaccgtgatggacattatctcccggaaggatcagcgcggctctgggcaggttggaacgtatggccttaatacatttaccaacatggaagctcaactggtgagacagatggagggggaaggagtcctcagcaaggccgacctggagaatccccatctgctcgagaaaaagattacccagtggctggaaaacaaaggcgtggagcggcttaagcgcatggcgatctccggggatgactgcgttgtgaaacctatcgatgacagattcgccaacgctctgctcgccctgaatgatatgggcaaggtccggaaggacattccgcagtggcaacccagcaaaggatggcacgattggcaacaggtgcctttctgttctcatcactttcatgaacttatcatgaaggacggccgcaaactggtcgtgccctgcagacctcaggacgagctcattgggcgggctcgcatctcccaaggagccggctggagcctgaaggaaacagcgtgtctggggaaagcctacgctcagatgtggtctctcatgtatttccacagacgggatctgagacttgcctccaacgctatttgcagcgccgttcccgtgcactgggtccctacctctcgcacaacgtggtccatccatgctcaccatcagtggatgaccacagaggacatgctggccgtgtggaatcgggtttggattgaggataacccctggatggaagacaagaccccggtgacaacctgggaggatgtcccttacctcggaaagagagaagaccaatggtgtggcagcctgatcgggcttacgtcccgcgcgacctgggcccagaatatcctgacagctattcaacaggtgcggagcctcatcggcgatgaggagtttctggactacatgccctctatgaaaagattccgcaaggaagaggaaagcgagggagccatttggtga

SEQ ID NO: 20499 - RNA, 9873 nt, synthetic construct
  misc_feature 1..9873: note = derived and/or modified CDS sequence (opt5) from DENV-3__FJ639721__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccaccggcattaatatgtgtacccttatcgcgatggatctgggggaaatgtgcgacgatacagtgacctacaagtgtccgctcattgttgaagtggagcccgaagacatcgattgctggtgtaacctgacaagcacctgggtgacgtatggaacctgcaatcaggctggcgagcacagacgggacaagcgctccgtcgccctggcccctcacgtggggatgggactcgatacaagaacccagacatggatgtctgctgagggcgcctggcggcaggttgaaaaggtggagacctgggctctgcgccatcccggcttcacgattcttgccctgtttctcgcgcactacatcgggacaagcctgatccagaaggtcgtgattttcatccttctgatgctcgttaccccttccatgacaatgagatgtgtgggagtcggcaaccgggactttgtggaagggctgtctggagccacctgggtggatgtcgttctggagcatggcgggtgcgtgaccacaatggctaagaataaacccacgctcgacattgagctgcagaagaccgaagccacacagcttgctaccctgcgcaaactctgtatcgagggaaagattacaaacatcaccacggatagcagatgccctacacagggcgaagccattctgccggaggaacaggaccagaattatgtgtgtaaacacacctacgtcgatcggggctgggggaacggatgcggccttttcgggaagggatccctggtgacctgcgcgaagtttcaatgtctcgagcccatcgagggcaaagttgtgcagtatgaaaatctgaagtacacagtcatcattaccgtgcacacaggggaccagcatcaggttggaaacgacacgcaaggcgtgaccgtcgagatcacacctcaggccagcaccgtggaagctgtcctgcccgagtatggcacactcgggctggaatgctctcctcgcaccggacttgatttcaatgagatgattctgctcacgatgaaaaacaaggcctggatggtgcacagacagtggtttttcgacctgccccttccgtggacctccggcgctacaaccgagacacctacctggaatcggaaagaactgctcgttacgtttaagaacgcccatgccaaaaagcaagaggtggtcgtgctggggagccaggaaggagctatgcacacagcgctgaccggcgccacagagatccaaaattctgggggcacctccattttcgctggacacctcaagtgtcgcctgaaaatggataaacttgaactgaaaggcatgagctacgccatgtgcctcaacacctttgttctgaagaaagaggtgtctgagacacagcatgggacgatcctgatcaaggtcgaatacaagggagaggacgccccctgtaaaattcctttctccaccgaagatggccaagggaaggctcacaacggaagacttatcacagccaatcccgtggtgaccaaaaaggaggagcccgttaacattgaagcggagcctccgttcggcgaaagcaatatcgtcattgggatcggcgacaaagctctcaagatcaactggtataagaaaggatcctctattggcaagatgtttgaggccacagccagaggggctagacgcatggccatcctgggagataccgcttgggacttcggcagcgtcgggggagtgctgaatagcctcggcaaaatggtccatcagatttttgggagcgcctacacggcgctgttctctggcgtgtcctggatcatgaagattggaatcggcgttcttctgacatggattgggctcaacagcaaaaatacctctatgagcttttcctgcatcgtgatcggaattatcaccctgtatctgggcgccgtcgtgcaggctgatatggggtgtgttattaactggaagggaaaggaacttaaatgcggctctgggatcttcgtgacaaatgaggtccacacctggacagagcagtacaagtttcaagccgacagccccaaacggctcgctacggccattgcgggcgcctgggaaaacggagtgtgtggcatcagatccaccacacgcatggagaatctgctgtggaagcagatcgctaacgaactcaattatattctgtgggagaacaatatcaaacttaccgttgtggtcggggatattatcggagtgctggaacagggcaagcggacactcacccctcagcccatggagctgaaatacagctggaagacgtgggggaaggccaaaattgtgaccgctgagacacaaaactcttccttcatcatcgacggacctaacacccccgaatgcccgagcgcctctagagcctggaatgtctgggaggttgaagactatggctttggcgtgttcacaaccaacatttggctgaaacttcgcgaggtgtacacacagtcctgtgatcatcggctcatgagcgctgcgatcaaagacgaaagagccgtccacgctgatatggggtactggattgagtcccagaagaatggatcttggaaactggagaaggccagctttatcgaagtgaagacctgcacgtggcctaaatcccacacactgtggtctaacggcgttctcgagagcgacatgattatccccaagtccctggccgggcctatcagccagcataatcaccgccccggatatcatacccaaaccgctggcccttggcaccttgggaaactggaactcgatttcaactactgcgagggaacaaccgtggtcattacggagaattgtggcacacggggcccctctctgagaaccacaaccgtgtccgggaagctgatccacgaatggtgctgtcgcagctgcacacttccgcctctccggtatatgggagaggacggctgttggtacgggatggaaattagacccatcaacgagaaagaagagaatatggttaagtctctggtgtccgccggaagcggcaaggtcgataactttaccatgggggtgctgtgcctcgcgattctgttcgaggaagttatgcggggaaaattcggcaagaaacatatgatcgctggcgtgctttttacgttcgtcctgctcctgtctgggcagattacctggcgcgacatggcccacacactgatcatgatcggaagcaatgcctccgatagaatgggcatgggggtgacctatcttgctctgattgccacatttaagatccagcccttcctcaccctgggatttttcctccggaaactgacgagcagagagaaccttctgctcggcgtggggctggcgatggctacaaccctgcaacttcctgaagacattgagcagatggccaatggaatcgccctgggcctcatgacactgaagctcattacccagtttgaaacctaccagctgtggacagctcttgtctctctgacgtgttccaacaccatcttcacactcaccgttgcctggcgcacagctaccctgatcctggccggcgtgagccttctgccgctctgccaatcctctagcatgcggaagacggattggctgcccatgacagtggcggccatgggggtccctcccctccctctgtttattttctcccttaaagacgctcccaagagacgctcttggcctctgaatgagggagtgatggccgttggcctggtgagcatcctcgcttcctctctgcttagaaacgatgtccccatggccgggccgctggtggccggaggcctcctgattgcttgttatgttatcaccgggaccagcgcggacctcacagtggagaaagccgctgacgtcacctgggaagaggaagccgagcagacaggagtgtcccataacctgatgattacggtcgatgacgatggcaccatgcggatcaaggacgatgaaacagagaatatccttaccgtgctgctgaaaacagccctcctgattgttagcggcatctttccttactctattcccgctacccttctggtgtggcacacgtggcagaagcagacccaacgctccggggtcctctgggacgtgccttctcccccggagacacagaaagccgaactggaggaaggagtttacagaatcaagcagcagggcattttcgggaagacccaagtgggagtcggcgtgcagaaagagggggtgtttcatacaatgtggcacgttacccggggagcggtcctcacacacaacggcaagcgcctggagcctaattgggcttccgtgaaaaaggatcttatctcctatggcgggggatggagactgagcacgcagtggcaaaaaggcgaagaggtgcaggtcattgccgtggaacccgggaagaaccctaagaatttccagaccatgcccggaatcttccagacaaccaccggcgagatcggggccattgctctggactttaaacccggaacatctggctcccctatcattaaccgggaaggcaaggttgtggggctctacggaaatggcgtcgtgacgaaaaacgggggatatgttagcggcatcgcccaaaccaatgcggagccggatgggcccacacctgagctggaagaggaaatgttcaagaaacgcaaccttaccattatggacctgcatcccggctccggaaagacaagaaagtacctccctgctatcgtgcgggaggccatcaaacgcagactgcggaccctcattctggcccccacgagagtcgtggctgccgaaatggaggaggctcttaagggcctgcctatccgctatcagacaaccgccaccaaaagcgaacacacagggcgggagattgttgatctgatgtgccatgcgacctttacaatgagactcctgtctccggtgcgcgtccccaattacaaccttatcattatggacgaagcccacttcaccgatcctgctagcatcgccgctcggggatatatctccacgagagtgggcatgggggaggccgccgctatttttatgacagcgacaccccctggaacagccgaggctttcccccagtctaatgccccgatccaggacgaggagcgcgacattcctgaacggagctggaactccggcaatgagtggatcaccgattttgtggggaagacggtctggttcgttccctctattaaagccggcaacgacatcgctaactgtctgagaaagaatggaaagaaagtgattcaactcagccgcaagacctttgatacagaataccagaaaacccggctgaacgactgggatttcgtggtcacaaccgacatctccgagatgggcgccaattttaaggcggatagagtgatcgacccccggcgctgcctgaaacctgttattctcacagatgggcccgagagagtgatccttgctggacctatgccggtcaccgccgcctctgctgcccagcggcgcggcagagtggggcggaacccccagaaggaaaatgaccaatacattttcacgggacagcctctgaacaatgatgaggaccatgcgcactggacagaagccaagatgctgctcgacaacatcaatacccccgagggcattatccctgctctgttcgaacccgagagagagaaaagcgccgctatcgatggggaatatcgccttaagggcgagtcccggaaaacctttgttgaactgatgagacgcggagacctcccggtgtggctggcccacaaggtcgctagcgagggcattaaatacacagatcggaagtggtgcttcgacggggaaagaaacaatcagatcctggaggagaacatggatgtggaaatttggaccaaagagggagaacgcaagaagctccggcctagatggcttgacgcccgcacatattctgatcccctggcgctgaaagagtttaaggacttcgccgctggcagaaaatccatcgccctcgatctggtcacggaaattgggcgggtgcctagccatcttgctcaccgcaccagaaatgccctggacaacctcgttatgctgcatacatctgagcacggaggccgggcctaccgccacgctgtggaggaactgcccgagaccatggaaacactccttctgctgggcctcatgatcctgcttaccgggggagcgatgctgtttctcgtgtccggcaaggggatcggaaaaacgaccattggcctgatctgtgtcattgttagctccgggatgctgtggatggccgatatccctctccagtggattgcttctgccatcgtgcttgagttctttatgatggtgctgctgattcccgagccggaaaagcaaagaacacctcaggacaatcagctcgcctatgtcgtgatcggaatcctgacccttgctgccattgttgcggccaacgagatgggcctgctcgaaacaaccaagcgggatctgggcatgagcaaagagcccggggtggtctcccccacgagctacctggacgtggacctccatcctgcttctgcctggacactttatgctgtcgccaccacagtgatcaccccgatgctgagacacaccattgaaaattccacagcgaacgttagcctggccgctatcgccaaccaagctgtggtcctcatgggactggataagggctggcccatttctaaaatggaccttggggtgcctctgctcgccctgggatgctacagccaggttaatcccctgacgctcaccgctgccgtgcttctgctggtcacacattacgcgatcatcggccctgggctccaggccaaggctacccgcgaggcccagaaacggacagctgccggaattatgaagaaccccaccgtggatggcatcatgacgattgacctggatcctgtgatctatgactccaagttcgagaaacaacttggccaggttatgctgctcgtcctgtgtgccgtgcagctgctccttatgagaacatcttgggcgctgtgcgaagctctgaccctcgccaccgggccgattacaaccctgtgggagggaagccccggcaagttttggaatacaacgatcgctgtgtccatggccaacatcttccgcgggtcttaccttgccggagctggcctggcctttagcattatgaaatccgtcgggaccggacggagaggcacaggcagccagggggaaaccctcggagagaagtggaaaaagaagctgaatcaactgtctcggaaagagttcgatctctataagaaatccggcatcacagaggttgaccgcaccgaggcgaaggaagggcttaaaagaggagagacgacccaccatgccgtgagccggggctccgctaagctgcagtggtttgtggaacgcaacatggtcattcctgaggggagagtgatcgatctgggatgtggccggggcgggtggtcttactattgcgccggactcaaaaaggttacagaagtgcgcggctacaccaaagggggacccggccacgaggagcctgtccccatgagcacatatgggtggaatattgtgaaactgatgtccggaaaggacgttttctaccttccgcctgaaaaatgtgataccctgctctgcgacatcggcgagtctagcccctcccccacagtggaagagagcagaaccattcgggtcctgaagatggtggagccttggctgaaaaacaatcagttctgtatcaaggtgctcaacccctacatgcctacggtcatcgaacaccttgagcgcctgcagagaaagtatggcgggatgctggttcggaatccgctctctagaaactccacacatgaaatgtactggattagcaatggaaccggcaacatcgtgtcttccgtgaatatggtcagccgcctgcttctgaaccggtttaccatgacacacagacgccccacgattgagaaagatgtggacctcggggctggaacccggcatgttaacgccgaacctgagacacccaatatggacgtgatcggcgagagaattaagcgcatcaaagaagaacactctagcacctggcactatgatgacgaaaacccttacaagacatgggcgtatcatgggtcctacgaggtcaaagccaccggatctgctagctccatgatcaatggcgtggttaagctgctgacaaagccctgggatgtggtcccgatggtgacccaaatggccatgacggacaccacacctttcggccagcagcgggtttttaaagaaaaggtggataccagaacaccccgccctatgcccgggacccggaaagtcatggagattacggctgagtggctctggagaacactgggacgcaacaagaaacctcggctttgcaccagagaagagttcacaaagaaggtgcgcaccaatgccgctatgggcgccgtctttacggaagagaaccaatgggacagcgcgagagccgctgtggaagatgaggagttctggaaactggttgaccgggaacgcgagctccacaagctggggaaatgtggatcctgcgtgtataatatgatgggcaagagagagaagaaacttggggagtttggcaaagccaagggatctcgggctatctggtacatgtggctgggcgccagattcctcgagtttgaagccctggggttcctgaacgaggatcattggtttagccgggaaaattcctactctggagtcgagggcgaagggctccacaagctgggatatattcttcgcgacatcagcaaaattcccggcggggcgatgtacgctgatgacaccgccggctgggacacaagaatcaccgaggatgacctgcataacgaggaaaagatcacacagcagatggatccggagcaccggcagctcgccaatgctattttcaaactgacctatcaaaacaaggtggtgaaagttcagcgccctacacccaagggaaccgtgatggacatcatttccagaaaggatcagcggggctctgggcaggtcggaacgtacggccttaatacatttaccaacatggaagcccaactggtgcgccagatggagggggaaggagttctcagcaaaaccgacctggagaatccccatctgctcgagaagaaaatcacacagtggctggaaaacaagggcgtggagagacttaaacggatggctatttccggggatgactgcgtcgtgaagcctatcgatgaccgcttcgccaacgcgctgctcgccctgaatgatatgggcaaggtcagaaaagacatcccgcagtggcaacccagcaagggatggcatgattggcaacaggtgcctttctgttctcaccattttcacgaacttattatgaaagacggccggaagctggttgtgccctgccgccctcaggacgagctcatcgggagagctcggatttcccaaggagccggctggagcctgaaagaaaccgcttgtctggggaaggcctatgcgcagatgtggtctctcatgtacttccaccgcagagatctgcggcttgcctccaacgctatctgcagcgccgtccccgtgcattgggttcctacatctagaacgacctggtccattcacgctcatcaccagtggatgacaaccgaggacatgctgacagtgtggaatcgcgtctggatcgaggataacccctggatggaagacaagaccccggtgacgacctgggaggatgtgccttatctcggaaaacgggaagaccaatggtgtggcagcctgattgggcttacatccagagccacctgggctcagaatatcctgacagccatccagcaggttcgcagcctcattggcgatgaggagtttctggactacatgccctctatgaagcggttcagaaaagaagaggaaagcgagggagcgatctggtga

SEQ ID NO: 20500 - RNA, 9873 nt, synthetic construct
  misc_feature 1..9873: note = derived and/or modified CDS sequence (opt5) from DENV-3__FJ639722__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccacaggcattaatatgtgtacccttatcgcgatggatctgggggagatgtgcgacgatacagtcacctacaagtgtccgctcattgctgaagttgagcccgaagacatcgattgctggtgtaacctgacaagcacctgggtgacgtatggaacctgcaatcaggccggcgagcaccggcgggacaagcgctccgtggccctggctcctcacgtcgggatgggactcgatacaagaacccagacatggatgtctgccgagggcgcttggagacaggtggaaaaagttgagacctgggccctgcgccatcccggcttcacgattcttgcgctgtttctcgcccactacatcgggacaagcctgatccagaaggtggtcattttcatccttctgatgctcgtgaccccttccatgacaatgagatgtgttggagtgggcaaccgggactttgtcgaagggctgtctggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggatagcagatgccctacacagggcgaagcgattctgccggaggaacaggaccagaattatgtgtgtaaacacacctacgtggatcggggctgggggaacggatgcggccttttcgggaagggatccctggtgacatgcgccaagtttcaatgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggctagcaccgtcgaagccgtgctgcccgagtatggcacactcgggctggaatgctctcctcgcaccggacttgatttcaatgagatgattctgctcacgatgaaaaacaaggcttggatggtccacagacagtggtttttcgacctgccccttccgtggacctccggcgccacaaccgagacacctacctggaatcggaaagaactgctcgtgacgtttaagaacgcccatgctaaaaagcaagaggttgtggtcctggggagccaggaaggagcgatgcacacagccctgaccggcgctacagagatccaaaattctgggggcacctccattttcgccggacacctcaagtgtcgcctgaaaatggataaacttgaactgaaaggcatgagctacgccatgtgcctcaacacctttgtgctgaagaaagaggtttctgagacacagcatgggacgatcctgatcaaggtggaatacaagggagaggacgctccctgtaaaattcctttctccaccgaagatggccaagggaaggcccacaacggaagacttatcacagcgaatcccgtcgtgaccaaaaaggaggagcccgtgaacattgaagctgagcctccgttcggcgaaagcaatatcgttattgggatcggcgagaaagccctcaagatcaactggtataagaaaggatcctctattggcaagatgtttgaagccacagctagaggggccagacgcatggctatcctgggagacaccgcctgggatttcggcagcgtcgggggagtgctgaatagcctcggcaaaatggtgcatcagatttttgggagcgcgtacacggccctgttctctggcgtctcctggatcatgaagattggaatcggcgtgcttctgacatggattgggctcaacagcaaaaatacctctatgagcttttcctgcatcgttatcggaattatcaccctgtatctgggcgctgtggtccaggccgacatggggtgtgtgattaactggaagggaaaggagcttaaatgcggctctgggatcttcgttacaaatgaggtgcacacctggacagaacagtacaagtttcaagctgatagccccaaacggctcgccacggcgattgccggcgcttgggagaacggagtctgtggcatcagatccaccacacgcatggaaaatctgctgtggaagcagatcgccaacgagctcaattatattctgtgggaaaacaatatcaaacttaccgtggttgtgggggacattatcggagtcctggagcagggcaagcggacactcacccctcagcccatggagctgaaatacagctggaagacgtgggggaaggctaaaattgtgaccgccgaaacacaaaactcttccttcatcatcgatggacctaacacccccgagtgcccgagcgcctctagagcttggaatgtgtgggaagtcgaggactatggctttggcgttttcacaaccaacatttggctgaaacttcgcgaagtgtacacacagtcctgtgaccatcggctcatgagcgcggccatcaaagatgagagagctgtgcacgccgacatggggtactggattgagtcccagaagaatggatcttggaaactggaaaaggccagctttatcgaggtcaagacctgcacgtggcctaaatcccacacactgtggtctaacggcgtgctcgaaagcgatatgattatccccaagtccctggctgggcctatcagccagcataatcaccgccccggatatcatacccaaaccgccggcccttggcaccttgggaaactggagctcgacttcaactactgcgagggaacaaccgttgtgattacggaaaattgtggcacacggggcccctctctgagaaccacaaccgtctccgggaagctgatccacgagtggtgctgtcgcagctgcacacttccgcctctccggtatatgggagaagatggctgttggtacgggatggagattagacccatcaacgaaaaagaggagaatatggtgaagtctctggtttccgcgggaagcggcaaggtggacaactttaccatgggggtcctgtgcctcgctattctgttcgaagaggtgatgcggggaaaattcggcaagaaacatatgatcgccggcgttctttttacgttcgtgctgctcctgtctgggcagattacctggcgcgatatggcccacacactgatcatgatcggaagcaatgcttccgacagaatgggcatgggggtcacctatcttgccctgattgcgacatttaagatccagcccttcctcgctctgggatttttcctccggaaactgaccagcagagaaaaccttctgctcggcgtggggctggccatggccacgacactgcaacttcctgaggatattgaacagatggctaatggaatcgccctgggcctcatgaccctgaagctcattacacagtttgagacctaccagctgtggaccgctcttgtgtctctgacatgttccaacacgatcttcaccctcacagtcgcctggcgcaccgcgacactgatcctggccggcgttagccttctgccgctctgccaatcctctagcatgcggaagaccgactggctgcccatgacggtggctgccatgggggtgcctcccctccctctgtttattttctcccttaaagatgctcccaagagacgctcttggcctctgaatgagggagtcatggccgtgggcctggttagcatcctcgcctcctctctgcttagaaacgacgtgcccatggctgggccgctggtcgcgggaggcctcctgattgcctgttatgtgatcacagggaccagcgctgatctcaccgttgaaaaagccgccgacgtgacatgggaggaagaggctgaacagaccggagtctcccataacctgatgattacagtggacgatgacggcacgatgcggatcaaggatgacgagaccgagaatatccttacagtcctgctgaaaaccgccctcctgattgtgagcggcatctttccttactctattcccgcgacacttctggtttggcacacctggcagaagcagacgcaacgctccggggtgctctgggatgtcccttctcccccggaaacccagaaagctgagctggaagagggagtgtacagaatcaagcagcagggcattttcgggaagacacaagttggagtgggcgtccagaaagagggggtgtttcataccatgtggcacgtgacacggggagccgttctcacccacaacggcaagcgcctggaacctaattgggcctccgtcaaaaaggaccttatctcctatggcgggggatggagactgagcacacagtggcaaaaaggcgaggaagtccaggtgattgctgtcgagcccgggaagaaccctaagaatttccagacgatgcccggaatcttccagaccacaaccggcgaaatcggggccattgcgctggattttaaacccggaacctctggctcccctatcattaaccgggagggcaaggtggttgggctctacggaaatggcgtggtcaccaagaacgggggatatgtgagcggcatcgctcaaacgaatgccgagccggacgggcccacccctgaactggaggaagagatgttcaagaaacgcaaccttacaattatggatctgcatcccggctccggaaagaccagaaagtacctccctgccatcgttcgggaagctatcaaacgcagactgcggacactcattctggcccccaccagagtggtcgctgccgagatggaggaagcgcttaagggcctgcctatccgctatcagacgacagccaccaaaagcgagcacaccgggcgggaaattgtggacctgatgtgccatgctacatttaccatgagactcctgtctccggttcgcgtgcccaattacaaccttatcattatggatgaggcccacttcacagaccctgctagcatcgccgcccggggatatatctccaccagagtcggcatgggggaagctgcggccatttttatgacggctacaccccctggaaccgccgaggccttcccccagtctaatgctccgatccaggatgaggaacgcgacattcctgagcggagctggaactccggcaatgaatggatcacagactttgtggggaagaccgtgtggttcgtcccctctattaaagccggcaacgatatcgcgaactgtctgagaaagaatggaaagaaagttattcaactcagccgcaagacgtttgacaccgagtaccagaaaacacggctgaacgattgggacttcgtggtgaccacagatatctccgagatgggcgctaattttaaggccgacagagtcatcgatccccggcgctgcctgaaacctgtgattctcaccgacgggcccgaaagagttatccttgccggacctatgccggtgacagctgcctctgcggcccagcggcgcggcagagtcgggcggaacccccagaaggagaatgatcaatacattttcaccggacagcctctgaacaatgacgaagatcatgctcactggacggaggccaagatgctgctcgacaacatcaatacacccgaaggcattatccctgctctgttcgagcccgagagagagaaaagcgccgctatcgacggggagtatcgccttaagggcgaatcccggaaaacctttgtggagctgatgagacgcggagatctcccggtttggctggcccacaaggtggcgagcgaaggcattaaatacaccgaccggaagtggtgcttcgatggggagagaaacaatcagatcctggaggaaaacatggacgtcgagatttggacaaaagaaggagagcgcaagaagctccggcctagatggcttgatgcccgcacctattctgaccccctggctctgaaagaatttaaggatttcgccgctggcagaaaatccatcgccctcgacctggtgacagagattgggcgggtccctagccatcttgcccaccgcacgagaaatgctctggataacctcgtgatgctgcatacctctgagcacggaggccgggcgtaccgccacgccgttgaggaactgcccgaaacaatggagaccctccttctgctgggcctcatgatcctgcttacagggggagctatgctgtttctcgtgtccggcaaggggatcggaaaaaccacgattggcctgatctgtgtgattgtcagctccgggatgctgtggatggccgacatccctctccagtggattgcctctgctatcgttcttgagttctttatgatggtgctgctgattcccgaaccggagaagcaaagaacccctcaggataatcagctcgcctatgtggtcatcggaatcctgacacttgcggccattgtggctgccaacgaaatgggcctgctcgagaccacaaagcgggacctgggcatgagcaaagaacccggggttgtgtcccccaccagctacctggatgtcgacctccatcctgcttctgcctggacgctttatgcggtggccacaaccgtcatcacaccgatgctgagacacaccattgaaaattccaccgctaacgtgagcctggccgctatcgccaaccaagctgttgtgctcatgggactggacaagggctggcccatttctaaaatggatcttggggtccctctgctcgccctgggatgctacagccaggtgaatcccctgacactcacggcggccgttcttctgctggtgacccattacgctatcatcggccctgggctccaggccaaggctacacgcgaggcccagaaacggaccgccgcgggaattatgaagaaccccacagtcgacggcatcatgaccattgatctggaccctgtgatctatgattccaagttcgaaaaacaacttggccaggtgatgctgctcgttctgtgtgctgtccagctgctccttatgagaacgtcttgggccctgtgcgaggctctgacactcgccaccgggccgattaccacactgtgggaaggaagccccggcaagttttggaataccacaatcgccgtgtccatggctaacatcttccgcgggtcttaccttgccggagcgggcctggcctttagcattatgaaatccgtggggacgggacggagaggcaccggcagccagggggagacactcggagaaaagtggaaaaagaagctgaatcaactgtctcggaaagagttcgacctctataagaaatccggcatcaccgaggtcgatcgcacagaagctaaggaggggcttaaaagaggagaaaccacgcaccatgccgttagccggggctccgctaagctgcagtggtttgtggagcgcaacatggtgattcctgaagggagagtcatcgacctgggatgtggccggggcgggtggtcttactattgcgccggactcaaaaaggtgaccgaggttcgcggctacacaaaaggcgggcccgggcacgaggaacctgtgcccatgagcacctatgggtggaatattgtcaaactgatgtccggaaaggatgtgttctaccttccgcctgagaaatgtgacacactgctctgcgatatcggcgaatctagcccctcccccaccgttgaggagagcagaacaattcgggtgctgaagatggtcgaaccttggctgaaaaacaatcagttctgtatcaaggtgctcaacccctacatgcctaccgtgatcgagcaccttgaacgcctgcagagaaagtatggcgggatgctggtccggaatccgctctctagaaactccacgcatgagatgtactggattagcaatggaacaggcaacatcgtttcttccgtgaatatggtgagccgcctgcttctgaaccggtttaccatgacccacagacgccccacaattgaaaaagacgtcgatctcggggcgggaacgcggcatgtgaacgccgagcctgagacccccaatatggacgttatcggcgaaagaattaagcgcatcaaagaggaacactctagcacatggcactatgacgatgagaacccttacaagacctgggcttatcatgggtcctacgaagtgaaagccacaggatctgctagctccatgatcaatggcgtcgtgaagctgctgaccaagccctgggacgttgtgccgatggtcacacaaatggccatgaccgatacgacccctttcggccagcagcgggtgtttaaagagaaggttgacacaagaacaccccgccctatgcccgggacacggaaagtgatggagattaccgctgaatggctctggagaacgctgggacgcaacaagaaacctcggctttgcacaagagaggagttcaccaagaaggtccgcacaaatgccgcgatgggcgccgtgtttaccgaggaaaaccaatgggatagcgctagagccgctgtcgaggacgaggagttctggaaactggtggatcgggagcgcgaactccacaagctggggaaatgtggatcctgcgtttataatatgatgggcaagagagagaagaaacttggggagtttggcaaagccaagggatctcgggccatctggtacatgtggctgggcgcgagattcctcgaatttgaggctctggggttcctgaacgaagaccattggtttagccgggaaaattcctactctggagtggaaggcgaggggctccacaagctgggatatattcttcgcgatatcagcaaaattcccggcggggccatgtacgccgacgatacggctggctgggacaccagaatcacagaggacgatctgcataacgaagagaagatcacccagcagatggacccggaacaccggcagctcgccaatgctattttcaaactgacatatcaaaacaaggtcgtgaaagtgcagcgccctacccccaagggaacagttatggatatcatttccagaaaggaccagcggggctctggacaggtgggaacctacggccttaatacgtttacaaacatggaggcccaactggtccgccagatggaaggggagggagtgctcagcaaaaccgatctggagaatccccatctgctcgaaaagaaaatcacccagtggctggagaacaagggcgttgaaagacttaaacggatggcgatttccggggacgattgcgtggtcaagcctatcgacgatcgcttcgccaacgctctgctcgccctgaatgacatgggcaaggtgagaaaagatatcccgcagtggcaacccagcaagggatggcatgactggcagcaggtccctttctgttctcaccattttcacgagcttattatgaaagatggccggaagctggtggttccctgccgccctcaggacgaactcatcgggagagctcggatttcccaaggagccggctggagcctgaaagagacagcgtgtctggggaaggcctatgctcagatgtggtctctcatgtacttccaccgcagagacctgcggcttgcctccaacgctatctgcagcgccgtgcccgtccattgggtgcctacctctagaacaacgtggtccattcacgctcatcaccagtggatgaccacagaggatatgctgaccgtttggaatcgcgtgtggatcgaagacaacccctggatggaggataagacaccggtcaccacgtgggaagacgtgccttatctcggaaaacgggaggatcaatggtgtggcagcctgattgggcttacctccagagccacatgggcgcagaatatcctgaccgccatccaacaggtgcgcagcctcattggcgacgaggaatttctggattacatgccctctatgaagcggttcagaaaagaggaagagagcgaaggagctatctggtga

SEQ ID NO: 20501 - RNA, 9873 nt, synthetic construct
  misc_feature 1..9873: note = derived and/or modified CDS sequence (opt5) from DENV-3__FJ639723__SS-prME
  source 1..9873: mol_type = other RNA
accagcctgtgcctcatgatgatgctgcccgccacacttgctttccacctgacgtcccgggacggcgagcctcggatgatcgtggggaagaacgaacgcggaaaatctctcctgtttaagaccgccaccggcattaatatgtgtacccttatcgcgatggatctgggggagatgtgcgacgatacagtcacctacaaatgtccgctcattgctgaagttgagcccgaagacatcgattgctggtgtaacctgacaagcgcctgggtgacctatggaacgtgcaatcaggccggcgagcatagacgggacaagcgctccgtggctctggcccctcacgtcgggatgggactcgataccagaacacagacctggatgtctgctgagggcgcctggagacaggtggaaaaagttgagacatgggcgctgcgccatcccggcttcaccattcttgccctgtttctcgctcactacatcgggacgagcctgatccagaaggtggtcattttcatccttctgatgctcgtgacaccttccatgaccatgagatgtgttggagtgggcaaccgggactttgtcgaagggctgtctggagccacatgggtggatgtggtcctggagcatggcgggtgcgttaccaccatggctaagaataaacccacactcgacattgagctgcagaagacggaagccacccagcttgcgacactgcgcaaactctgtatcgagggaaagattaccaacatcacaaccgatagcagatgccctacgcagggcgaagccattctgccggaggaacaggaccagaattatgtgtgtaaacacacatacgtggatcggggctgggggaacggatgcggccttttcgggaagggatccctggtgacatgcgctaagtttcagtgtctcgagcccatcgagggcaaagtggttcagtatgaaaatctgaagtacaccgtgatcattacagtccacaccggggaccagcatcaggtgggaaacgacacacaaggcgttacggtggagatcacccctcaggccagcacagtcgaagctgtgctgcccgagtatggcaccctcgggctggaatgctctcctcgcacaggacttgatttcaatgagatgattctgctcaccatgaaaaacaaggcctggatggtccacagacagtggtttttcgacctgccccttccgtggacgtccggcgccaccacagagacccctacatggaatcggaaagaactgctcgtgacctttaagaacgctcatgcgaaaaagcaagaggttgtggtcctggggagccaggaaggagccatgcacacggctctgacaggcgccaccgagatccaaaattctgggggcacatccattttcgccggacacctcaagtgtcgcctgaaaatggataaacttgaactgaaaggcatgagctacgctatgtgcctcaacacctttgtgctgagaaaggaggtttctgagacccagcatgggacaatcctgatcaaagtggaatacaagggagaggacgccccctgtaagattcctttctccacggaagatggccaagggaaagcgcacaacggacggcttatcaccgctaatcccgtcgtgacaaagaaagaggagcccgtgaacattgaagccgagcctccgttcggcgaaagcaatatcgttattgggatcggcgacaaggccctcaaaatcaactggtataagaagggatcctctattggcaaaatgtttgaggctaccgccagaggggctcgccggatggccatcctgggagatacagcgtgggacttcggcagcgtcgggggagtgctgaatagcctcggcaagatggtgcatcagatttttgggagcgcctacaccgctctgttctctggcgtctcctggatcatgaaaattggaatcggcgtgcttctgacgtggattgggctcaacagcaagaatacatctatgagcttttcctgcatcgttatcggaattatcaccctgtatctgggcgccgtggtccaggctgatatggggtgtgtgattaactggaaaggaaaggaacttaagtgcggctctgggatcttcgttaccaatgaggtgcacacatggaccgagcagtacaaatttcaagccgacagccccaagagactcgcgacagccattgctggcgcctgggaaaacggagtctgtggcatccgctccacgacccggatggagaatctgctgtggaaacagatcgctaacgaactcaattatattctgtgggagaacaatatcaaacttacagtggttgtgggggatattatcggagtcctggaacagggcaaaagaaccctcacacctcagcccatggagctgaagtacagctggaaaacctgggggaaggccaagattgtgacggccgagacccaaaactcttccttcatcatcgacggacctaacacacccgaatgcccgagcgcttctcgcgcgtggaatgtgtgggaggtcgaagactatggctttggcgttttcaccacaaacatttggctgaaacttcgggaggtgtacacccagtcctgtgatcatagactcatgagcgccgctatcaaggacgaacgcgccgtgcacgccgatatggggtactggattgagtcccagaaaaatggatcttggaagctggagaaagctagctttatcgaagtcaagacatgcacctggcctaagtcccacacgctgtggtctaacggcgtgctcgagagcgacatgattatccccaaatccctggccgggcctatcagccagcataatcaccggcccggatatcatacacaaaccgcgggcccttggcaccttgggaagctggaactcgatttcaactactgcgagggaaccacagttgtgattaccgagaattgtggcacgagaggcccctctctgcgcacaaccacagtctccgggaaactgatccacgaatggtgctgtcggagctgcacccttccgcctctcagatatatgggagaggacggctgttggtacgggatggaaattcggcccacaaacgagaaggaagagaatatggtgaaatctctggtttccgctggaagcggcaaggtggataactttaccatgggggtcctgtgcctcgccatcctgttcgaggaagtgatgcgcggaaagttcggcaaaaagcatatgattgccggcgttctttttacgttcgtgctgctcctgtctgggcagatcacctggagagacatggctcacacactgattatgatcggaagcaatgcctccgatcggatgggcatgggggtcacctatcttgcgctgatcgctacatttaaaattcagcccttcctcgccctgggatttttcctcagaaagctgaccagccgcgagaaccttctgctcggcgtggggctggccatggctacgacactgcaacttcctgaagacatcgagcagatggccaatggaattgctctgggcctcatgaccctgaaactcatcacacagtttgaaacctaccagctgtggaccgcccttgtgtctctgacatgttccaacacgattttcaccctcacagtcgcgtggcggaccgccacactgatcctggctggcgttagccttctgccgctctgccaatcctctagcatgagaaagaccgattggctgcccatgacggtggccgctatgggggtgcctcccctccctctgtttatcttctcccttaaggacacacccaaacgcagatcttggcctctgaatgagggagtcatggccgtgggcctggttagcattctcgcctcctctctgcttcggaacgatgtgcccatggctgggccgctggtcgcgggaggcctcctgatcgcctgttatgtgattaccgggaccagcgctgacctcacagttgagaaggccgccgacgtgacctgggaagaggaagctgagcagacaggagtctcccataacctgatgatcacggtggatgacgatggcaccatgcgcattaaagacgatgaaacagagaatatccttaccgtcctgctgaagacagccctcctgatcgtgagcggcatttttccttactctatccccgcgacccttctggtttggcacacgtggcagaaacagacccaaagatccggggtgctctgggacgtcccttctcccccggagacacagaaggctgaactggaggaaggagtgtaccggattaaacagcagggcatcttcgggaagacccaagttggagtgggcgtccagaaggagggggtgtttcatacaatgtggcacgtgacccgcggagccgttctcacacacaacggcaaaagactggagcctaattgggcctccgtcaagaaagatcttatttcctatggcgggggatggcggctgagcacgcagtggcaaaagggcgaagaggtccaggtgatcgctgtcgaacccgggaaaaaccctaagaatttccagaccatgcccggaattttccagacaaccaccggcgagatcggggccatcgcgctggactttaagcccggaacatctggctcccctattatcaaccgcgaaggcaaagtggttgggctctacggaaatggcgtggtcacgaagaacgggggatatgtgagcggcattgctcaaaccaatgccgagccggatgggcccacacctgagctggaagaggaaatgttcaaaaagagaaaccttaccatcatggacctgcatcccggctccggaaaaacacggaagtacctccctgccattgttcgcgaggctatcaagagacggctgagaaccctcatcctggcccccacgcgcgtggtcgctgccgaaatggaggaggcgcttaaaggcctgcctattcggtatcagacaaccgccaccaagagcgaacacacagggagagagatcgtggatctgatgtgccatgctacctttacaatgcgcctcctgtctccggttcgggtgcccaattacaaccttattatcatggacgaagcccacttcaccgatcctgctagcattgccgccagaggatatatctccacgcgcgtcggcatgggggaggctgcggccatctttatgacagctacaccccctggaacagccgaagccttcccccagtctaatgctccgattcaggacgaggagcgggacatccctgaaagaagctggaactccggcaatgagtggattaccgattttgtggggaaaacggtgtggttcgtcccctctatcaaggccggcaacgacattgcgaactgtctgcgcaaaaatggaaagaaggttatccaactcagccggaaaacctttgatacagaataccagaagaccagactgaacgactgggatttcgtggtgacaaccgacatttccgagatgggcgctaattttaaagccgatcgggtcatcgacccccgcagatgcctgaagcctgtgatcctcacagatgggcccgagcgggttattcttgccggacctatgccggtgaccgctgcctctgcggcccagcgcagaggccgggtcgggagaaacccccagaaagaaaatgaccaatacatcttcacgggacagcctctgaacaatgatgaggaccatgctcactggacagaagccaagatgctgctcgacaacattaatacccccgagggcatcattcctgctctgttcgaacccgagcgcgaaaagagcgccgctatcgatggggaatatcggcttaaaggcgagtccagaaagacctttgtggaactgatgcgccggggagacctcccggtttggctggcctacaaagtggcgagcgagggcatcaagtatacagatagaaaatggtgcttcgacggggaacgcaacaatcagattctggaggagaacatggatgtcgaaatctggaccaaggagggagaacggaaaaagctcagacctcgctggcttgacgccagaacatactctgatcccctggctctgaaggagtttaaagacttcgccgctggccggaagtccattgccctcgatctggtgacggaaatcgggcgcgtccctagccaccttgcccatagaacccggaatgctctggacaacctcgtgatgctgcacacatctgagcatggaggccgcgcgtatagacacgccgttgaggaactgcccgagaccatggaaacactccttctgctgggcctcatgattctgcttaccgggggagctatgctgtttctcatctccggcaaagggatcggaaagacgaccattggcctgatctgtgtgattgtgagctccgggatgctgtggatggccgatatccctctccagtggattgcctctgctatcgtccttgagttctttatgatggttctgctgattcccgagccggaaaaacaacggacacctcaggacaatcagctcgcctacgtggtgatcggaatcctgacccttgcggccattgtcgctgccaacgagatgggcctgctcgaaacaaccaagagagatctgggcatgagcaaggagcccggggtggtttcccccacgagctatctggacgtggacctccaccctgcttctgcctggacactttacgcggtcgccaccacagtgatcaccccgatgctgcgccataccattgaaaattccacagctaacgtcagcctggccgctatcgccaaccaagctgtggttctcatgggactggataaaggctggcccatttctaagatggaccttggggtgcctctgctcgccctgggatgctacagccaggtcaatcccctgacgctcaccgcggccgtgcttctgctggttacacactatgctatcatcggccctgggctccaggccaaagctacccgggaggcccagaagagaacagccgcgggaattatgaaaaaccccaccgtggatggcatcatgacgattgacctggatcctgtcatctacgactccaagttcgagaagcaacttggccaggtgatgctgctcgtgctgtgtgctgttcagctgctccttatgcgcacatcttgggccctgtgcgaagctctgaccctcgccaccgggccgattacaaccctgtgggagggaagccccggcaaattttggaatacaacgatcgccgtctccatggctaacatcttccgggggtcttatcttgccggagcgggcctggcctttagcattatgaagtccgtggggaccggaagacggggcacaggcagccagggggaaaccctcggagagaaatggaagaaaaagctgaatcaactgtctcgcaaggagttcgatctctacaaaaagtccggcatcacagaggtggacagaaccgaggctaaagaagggcttaagcggggagagacgacccatcacgccgtcagccgcggctccgctaaactgcagtggtttgttgaaagaaacatggtgattcctgaggggcgggtgatcgatctgggatgtggccgcggcgggtggtcttattactgcgccggactcaagaaagtcacagaagtgagaggctataccaaagggggacccggccatgaggagcctgttcccatgagcacatacgggtggaatattgtgaagctgatgtccggaaaagacgtcttctaccttccgcctgaaaagtgtgataccctgctctgcgacatcggcgagtctagcccctcccccacagtggaagagagccggaccattcgcgttctgaaaatggtggagccttggctgaagaacaatcagttctgtatcaaagtcctcaacccctatatgcctacggtgatcgaacaccttgagagactgcagcggaagtacggcgggatgctggtgagaaatccgctctctcgcaactccacacacgaaatgtattggattagcaatggaaccggcaacatcgtctcttccgttaatatggtgagccggctgcttctgaacagatttaccatgacacatcgccggcccacgattgagaaggatgtggacctcggggcgggaaccagacacgtcaacgccgaacctgagacacccaatatggacgtgatcggcgagcgcattaaacggatcaaggaagaacactctagcacctggcactacgatgacgaaaacccttataaaacatgggcttaccacgggtcctatgaggttaaggccaccggatctgctagctccatgatcaatggcgtggtcaaactgctgacaaagccctgggatgtggttccgatggtgacccaaatggccatgacggacaccacacctttcggccagcagagagtctttaaggaaaaagtggatacccgcacaccccggcctatgcccgggaccagaaaggttatggagattacggctgagtggctctggcgcacactgggacggaacaaaaagcctagactttgcacccgcgaagagttcaccaagaaggtgagaaccaatgccgcgatgggcgccgtctttacggaagagaaccaatgggacagcgctcgggccgctgtggaagatgaggagttctggaagctggtcgaccgcgaaagagagctccataaactggggaagtgtggatcctgcgtgtacaatatgatgggcaaacgggaaaagaaacttggggagtttggcaaggccaaaggatctagagccatctggtacatgtggctgggcgcgcggttcctcgagtttgaagctctggggttcctgaacgaggatcactggtttagccgcgaaaattcctattctggagttgagggcgaagggctccataagctgggatacattcttagagacatcagcaagattcccggcggggccatgtatgccgatgacaccgctggctgggacacacggatcaccgaggatgacctgcacaacgaggagaagatcacacagcagatggatccggagcatcgccagctcgccaatgctattttcaagctgacctaccaaaacaaagtggtcaaggtgcagagacctacacccaaaggaaccgtgatggacatcatttcccggaaggatcagcgcggctctgggcaggttggaacgtatggccttaatacatttaccaacatggaagcccaactggtgagacagatggagggggaaggagtcctcagcaaggcggacctggagaatccccatctgctcgagaaaaagatcacccagtggctggaaaacaaaggcgtggagcggcttaagcgcatggccatttccggggatgactgcgttgtgaaacctatcgatgacagattcgctaacgccctgctcgctctgaatgatatgggcaaggtccggaaggacatcccgcagtggcaacccagcaaaggatggcacgattggcaacaggtgcctttctgttctcatcactttcatgaacttattatgaaggacggccgcaaactggtcgtgccctgcagacctcaggacgagctcatcgggcgggcccgcatttcccaaggagcgggctggagcctgaaggaaacagcctgtctggggaaggcttacgcccagatgtggtctctcatgtatttccacagacgggatctgagacttgcttccaacgccatctgcagcgctgttcccgtgcactgggtccctacctctcgcacaacgtggtccattcatgcccaccatcagtggatgaccacagaggacatgctggcggtgtggaatcgggtttggatcgaggataacccctggatggaagacaagaccccggtgacaacctgggaggatgtcccttacctcggaaagagagaagaccaatggtgtggcagcctgattgggcttacgtcccgcgccacctgggctcagaatatcctgacagccatccaacaggtgcggagcctcattggcgatgaggagtttctggactacatgccctctatgaaaagattccgcaaggaagaggaaagcgagggagccatctggtga

SEQ ID NO: 20502 - RNA, 9873 nt, synthetic construct
  misc_feature 1..9873: note = derived and/or modified CDS sequence (opt5) from DENV-3__FJ639724__SS-prME
  source 1..9873: mol_type = other RNA
acctccctgtgcctcatgatgatgctgcccgccacgcttgctttccacctgacgtcccgggacggcgagcctcggatgatcgtggggaagaacgaacgcggaaagtctctcctgtttaagaccgccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaacgcgttgagacatgggccctgagacatcccggcttcaccattcttgcgctgtttctcgcccactacatcgggacgtccctgacacagaaagtggtcatcttcattcttctgatgctcgtgaccccttctatgacaatgcggtgtgttggagtgggcaaccgcgactttgtcgaagggctgagcggagctacctgggtggatgtggtcctggagcatggcgggtgcgttaccacaatggccaagtccaagcccacgctcgacatcgagctgcagaaaaccgaagctacacagcttgccaccctgagaaagctctgtattgagggaaaaatcacaaatattaccacggatagccggtgccctacacagggcgaagcgaccctgccggaggaacaggaccagaactatgtgtgtaagcacacctacgtggatcgcggctgggggaatggatgcggccttttcgggaaaggatctctggtcacatgcgccaagtttcaatgtctcgagcccatcgagggcaaggtggttcagtatgaaaacctgaaatacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctagaacgggacttgatttcaacgagatgattctgctcaccatgaagaataaggcttggatggtccaccggcagtggtttttcgacctgccccttccgtggacatctggcgccaccacagagacccctacgtggaaccgcaaggaactgctcgtgacatttaaaaatgcccatgctaagaaacaagaggttgtggtcctggggtcccaggaaggagcgatgcacaccgccctgacaggcgctaccgagatccagaacagcgggggcacctctattttcgccggacacctcaagtgtagactgaagatggataaacttgaactgaagggcatgtcctacgccatgtgcctcaatacatttgtgctgaaaaaggaggttagcgagacgcagcatgggaccatcctgattaaagtggaatacaagggagaggacgctccctgtaagatccctttctccacagaagatggccaagggaaagcccacaacggacggcttatcaccgcgaaccccgtcgtgacaaagaaagaggagcccgtgaatattgaagctgagcctccgttcggcgaatctaacatcgttattgggatcggcgacaaggccctcaaaattaattggtataagaagggaagctccatcggcaaaatgtttgaggccaccgctagaggggcccgccggatggctatcctgggagatacggcctgggacttcggcagcgtcgggggagtgctgaactctctcggcaagatggtgcatcagatttttgggtccgcgtacacagccctgttcagcggcgtctcttggatcatgaaaattggaatcggcgtgcttctgacctggattgggctcaatagcaagaacacctccatgtcttttagctgcatcgttattggaatcatcacactgtatctgggcgctgtggtccaggccgatatggggtgtgtgattaattggaaaggaaaggaacttaagtgcggctccgggatcttcgttaccaacgaggtgcacacatggacggagcagtacaaatttcaagctgacagccccaagagactcgccaccgcgattgccggcgcttgggaaaatggagtctgtggcatccgctctacaacccggatggagaacctgctgtggaaacagattgccaatgaactcaactatatcctgtgggagaataacatcaaacttacagtggttgtgggggatattatcggagtcctggaacagggcaaaagaaccctcacgcctcagcccatggagctgaagtactcctggaaaacctgggggaaggctaagattgtgacagccgagacccaaaatagctctttcatcattgacggacctaacacacccgaatgcccgtccgccagccgcgcttggaacgtgtgggaggtcgaagactatggctttggcgttttcaccacaaatatctggctgaaacttcgggaggtgtacacccagtcctgtgatcatagactcatgtctgcggccatcaaggacgaacgcgctgtgcacgccgatatggggtactggattgagagccagaaaaacggatcctggaagctggagaaagcctcttttatcgaagtcaagacgtgcacatggcctaagagccacaccctgtggtccaatggcgtgctcgagagcgacatgattatccccaaatctctggctgggcctatttcccagcataaccaccggcccggatatcatacccaaacaaccggcccttggcaccttgggaagctggaactcgatttcaattactgcgagggaacgacagttgtgatcaccgagaactgtggcacaagaggccccagcctgcgcaccacaaccgtctctgggaaactgatccacgaatggtgctgtcggtcctgcacgcttccgcctctcagatatatgggagaggacggctgttggtacgggatggaaattcggcccatcaatgagaaggaagagaacatggtgaaaagcctggtttctgccggaagcggcaaggtggataattttaccatgggggtcctgtgcctcgcgattctgttcgaggaagtgatgcgcggaaagttcggcaaaaagcatatgatcgctggcgttctttttacattcgtgctgctcctgtccgggcagattacctggagagacatggcccacacactgatcatgattggaagcaacgcctctgatcggatgggcatgggggtcacctatcttgctctgatcgccacgtttaaaatccagcccttcctcgcgctgggatttttcctcagaaagctgacatcccgcgagaatcttctgctcggcgtggggctggctatggccaccacactgcaacttcctgaagacattgagcagatggccaacggaatcgctctgggcctcatgaccctgaaactcattacccagtttgaaacataccagctgtggacggcccttgtgagcctgacctgttccaatacaatcttcaccctcacagtcgcttggcggaccgccacgctgattctggcgggcgtttctcttctgccgctctgccaaagctcctctatgagaaagacagattggctgcccatgaccgtggccgctatgggggtgcctcccctccctctgtttatcttcagccttaaggacacccccaaacgcagatcctggcctctgaacgagggagtcatggccgtgggcctggtttctatcctcgctagctccctgcttcggaatgatgtgcccatggccgggccgctggtcgccggaggcctcctgattgcttgttatgtgatcacagggaccagcgcggacctcacagttgagaaggccgctgacgtgacgtgggaagaggaagccgagcagaccggagtctctcataacctgatgattacagtggatgacgatggcaccatgcgcatcaaagacgatgaaacagagaacattcttaccgtcctgctgaagacggccctcctgatcgtgtccggcatctttccttacagcattcccgctacccttctggtttggcacacatggcagaaacagacccaaagatctggggtgctctgggacgtcccttctcccccggagacacagaaggccgaactggaggaaggagtgtaccggatcaaacagcagggcattttcgggaagacccaagttggagtgggcgtccagaaggagggggtgtttcatacaatgtggcacgtgacgcgcggagcggttctcacccacaatggcaaaagactggagcctaactgggctagcgtcaagaaagatcttatcagctatggcgggggatggcggctgtccgcccagtggcaaaagggcgaagaggtccaggtgattgccgtcgaacccgggaaaaatcctaagaacttccagacaatgcccggaatcttccagaccaccacaggcgagattggggctatcgccctggactttaagcccggaacgagcggctcccctatcattaatcgcgaaggcaaagtggttgggctctacggaaacggcgtggtcaccaagaatgggggatatgtgagcggcatcgcgcaaacaaacgctgagccggatgggcccacccctgagctggaagaggaaatgttcaaaaagagaaatcttacaattatggacctgcatcccggctctggaaaaacccggaagtacctccctgccatcgttcgcgaggccattaagagacggctgagaacgctcatcctggctcccacacgcgtggtcgccgctgaaatggaggaggcccttaaaggcctgcctatccggtatcagaccaccgcgacaaagagcgaacacaccgggagagagattgtggatctgatgtgccatgccacatttaccatgcgcctcctgtccccggttcgggtgcccaactacaatcttgtcatcatggacgaagctcacttcacggatcctgcctctattgctgccagaggatatatcagcacacgcgtgggcatgggggaggccgctgcgatttttatgaccgccacaccccctggaaccgctgaagccttcccccagtccaacgccccgatccaggacgaggagcgggacatccctgaaagatcttggaatagcggcaacgagtggattacggattttgtggggaaaaccgtctggttcgttccctccatcaaggctggcaatgacattgccaactgtctgcgcaaaaacggaaagaaggtgatccaactctctcggaaaacatttgataccgaataccagaagacaagactgaatgactgggatttcgtggtcaccacagacattagcgagatgggcgcgaactttaaagctgatcgggtgatcgacccccgcagatgcctgaagcctgttattctcaccgatgggcccgagcgggtgatccttgccggacctatgccggtcacggccgcttccgccgcgcagcgcagaggccgggtggggagaaatccccagaaagaaaacgaccaatacatcttcacaggacagcctctgaataacgatgaggaccatgcccactggaccgaagctaagatgctgctcgacaatattaacacccccgagggcatcattcctgccctgttcgaacccgagcgcgaaaagagcgctgccatcgatggggaatatcggcttaaaggcgagtctagaaagacatttgttgaactgatgcgccggggagacctcccggtgtggctggctcacaaagtcgcctccgagggcattaagtacaccgatagaaaatggtgcttcgacggggaacgcaataaccagatcctggaggagaatatggatgtggaaatctggacaaaggagggagaacggaaaaagctcagacctcgctggcttgacgcgagaacgtatagcgatcccctggccctgaaggagtttaaagacttcgctgccggccggaagtctattgctctcgatctggtcaccgaaatcgggcgcgtgccttcccatcttgcccacagaacacggaacgccctggacaatctcgttatgctgcataccagcgagcacggaggccgcgcttacagacacgcggtggaggaactgcccgagacaatggaaaccctccttctgctgggcctcatgattctgcttacagggggagccatgctgtttctcatctccggcaaagggattggaaagacctctatcggcctgatctgtgtgattgtcagctccgggatgctgtggatggctgatgttcctctccagtggatcgccagcgccattgtgcttgagttctttatgatggtgctgctgatccccgagccggaaaaacaacggacacctcaggacaaccagctcgcttatgtcgtgattggaatcctgacccttgccgcgattgttgccgctaatgagatgggcctgctcgaaacaaccaagagagatctgggcatgtctaaggagcccggggtggtctcccccacgagctacctggacgtggacctccatcctgcctctgcttggacactttatgccgtcgcgaccacagtgatcaccccgatgctgcgccacaccatcgaaaacagcacagccaatgtttccctggctgccattgctaaccaagccgtggtcctcatgggactggataaaggctggcccatctctaagatggaccttggggtgcctctgctcgctctgggatgctacagccaggttaaccccctgacgctcaccgccgcggtgcttctgctggtcacacattacgccattatcggccctgggctccaggctaaagccacccgggaggctcagaagagaacagccgccggaattatgaaaaatcccaccgtggatggcatcatgacgatcgacctggatcctgtgatttatgactccaagttcgagaagcaacttggccaggttatgctgctcgtcctgtgtgcggtgcagctgctccttatgcgcacatcttgggctctgtgcgaagccctgaccctcgctaccgggccgatcacaaccctgtgggagggaagccccggcaaattttggaacacaacgattgccgtgtccatggccaatatcttccgggggagctaccttgctggagccggcctggcgttttctattatgaagtccgtcgggaccggaagacggggcacaggcagccagggggaaaccctcggagagaaatggaagaaaaagctgaaccaactgtcccgcaaggagttcgatctctataaaaagtctggcatcacagaggttgacagaaccgaggccaaagaagggcttaagcggggagagacgacccaccatgctgtgagccgcggctccgccaaactgcagtggtttgtggaaagaaatatggtcatccctgaggggcgggtgattgatctgggatgtggccgcggcgggtggtcttactattgcgctggactcaagaaagttacagaagtgagaggctacaccaaagggggacccggccacgaggagcctgtccccatgagcacatatgggtggaacatcgtgaagctgatgtccggaaaagacgttttctaccttccgcctgaaaagtgtgataccctgctctgcgacattggcgagagctctccctcccccacagtggaagagagccggaccatccgcgtcctgaaaatggtggagccttggctgagaaataaccagttctgtattaaggtgctcaatccctacatgcctacggtcatcgaacaccttgagcggctgcagagaaaatatggcgggatgctggttcgcaacccgctctctagaaattccacacatgaaatgtactggattagcaacggaaccggcaatatcgtgtctagcgtgaacatggtctccagactgcttctgaatcgctttaccatgacacaccggagacccacgatcgagaaggatgtggacctcggggccggaacccgccatgttaacgcggaacctgagacacccaacatggacgtgattggcgagcggatcaagagaattaaagaagaacactctagcacctggcactatgatgacgaaaatccttacaagacatgggcctatcatgggtcctacgaggtcaaagctaccggaagcgcctcctctatgatcaacggcgtggttaagctgctgacaaaaccctgggatgtggtcccgatggtgacccaaatggctatgacggacaccacacctttcggccagcagcgcgtttttaaggaaaaggtggatacccggacacccagacctatgcccgggacccgcaaagtcatggagattacggccgagtggctctggcggacactgggaagaaataagaaacctcgcctttgcaccagagaagagttcacaaagaaagtgcggaccaacgctgccatgggcgcggtctttacggaagagaatcaatgggacagcgcccgcgctgccgtggaagatgaggagttctggaagctggttgacagagaacgggagctccacaagctggggaaatgtggatcctgcgtgtataacatgatgggcaagagagagaagaaacttggggagtttggcaaagctaagggatctcgggccatctggtacatgtggctgggcgcccgctacctcgagttcgaagcgctggggtttctgaatgaggatcattggttcagcagagaaaactcctattctggagtcgagggcgaagggctccacaaactgggatacatccttcgggacattagcaagatccccggcggggctatgtatgccgatgacaccgccggctgggacacacgcattaccgaggatgacctgcataatgaggaaaagatcacacagcagatggatccggagcacagacagctcgctaacgccatttttaaactgacctaccaaaataaggtggtgaaagttcagcggcctacacccaagggaaccgtgatggacatcatctcccgcaaagatcagagaggcagcgggcaggtcggaacgtatggccttaacacattcaccaatatggaagctcaactggtgcggcagatggagggggaaggagttctctctaaggccgacctggagaacccccatctgctcgagaagaaaattacccagtggctggaaacaaagggcgtggagcgccttaaaagaatggcgatctccggggatgactgcgtcgtgaagcctattgatgaccggtttgccaatgctctgctcgccctgaacgatatgggcaaagtccgcaaggacatcccgcagtggcaacccagcaagggatggcatgattggcaacaggtgcctttctgttctcaccatttccacgaacttattatgaaagacggcagaaagctggttgtgccctgccggcctcaggacgagctcatcgggcgcgctagaatctcccaaggagccggctggagcctgaaagaaaccgcgtgtctggggaaggcctacgctcagatgtggtctctcatgtattttcaccggagagatctgcgccttgcctccaacgctatttgcagcgccgtccccgtgcattggatccctacatcccggacgacctggagcattcacgctcatcaccagtggatgacaaccgaggacatgctgacagtttggaatagagtgtggatcgaggataacccctggatggaagacaaaaccccggtcacgacctgggaggatgtgccttacctcggaaagcgcgaagaccaatggtgtggctctctgattgggcttacaagccgggccacctgggcgcagaatatcctgacagccattcaacaggtgagatccctcatcggcgatgaggagttcctggactacatgccctctatgaagcgctttcggaaagaagaggaaagcgagggagctatctggtga

SEQ ID NO: 20503 - RNA, 9873 nt, synthetic construct
  misc_feature 1..9873: note = derived and/or modified CDS sequence (opt5) from DENV-3__FJ639725__SS-prME
  source 1..9873: mol_type = other RNA
acctccctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacccttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccagcagagcttggaacgtgtgggaggtcgaagactatggctttggcgttttcaccacaaatatctggctgaaacttcgcgaggtgtacacccagtcctgtgatcatcggctcatgtctgcggccatcaaagacgaaagagctgtgcacgccgatatggggtactggattgagagccagaagaacggatcctggaaactggagaaggcctcttttatcgaagtcaagacgtgcacatggcctaaaagccacaccctgtggtccaatggcgtgctcgagagcgacatgattatccccaagtctctggctgggcctatttcccagcataaccaccgccccggatatcatacccaaacagccggcccttggcaccttgggaaactggaactcgatttcaattactgcgagggaaccacggttgtgatcacagagaactgtggcacccggggccccagcctgagaacaaccacagtctctgggaagctgatccacgaatggtgctgtcgctcctgcacccttccgcctctccggtatatgggagaggacggctgttggtacgggatggaaattagacccatcaatgagaaagaagagaacatggttaagagcctggtgtctgcgggaagcggcaaggtggataattttacgatgggggtcctgtgcctcgctattctgttcgaggaagtgatgcggggaaaattcggcaagaaacatatgatcgccggcgttctttttaccttcgtgctgctcctgtccgggcagattacatggcgcgacatggcccacaccctgatcatgattggaagcaacgcttctgatagaatgggcatgggggtcacatatcttgccctgatcgcgacctttaagatccagcccttcctcgctctgggatttttcctccggaaactgacgtccagagagaatcttctgctcggcgtggggctggccatggccacaaccctgcaacttcctgaagacattgagcagatggctaacggaatcgccctgggcctcatgacactgaagctcattacccagtttgaaacctaccagctgtggacagctcttgtgagcctgacgtgttccaataccatcttcacactcaccgtcgcctggcgcacagcgaccctgattctggccggcgtttctcttctgccgctctgccaaagctcctctatgcggaagacggattggctgcccatgacagtggctgccatgggggtgcctcccctccctctgtttatcttcagccttaaagacacccccaagagacgctcctggcctctgaacgagggagtcatggctgtgggcctggtttctatcctcgccagctccctgcttagaaatgatgtgcccatggccgggccgctggtcgctggaggcctcctgattgcgtgttatgtgatcaccgggacaagcgccgacctcaccgttgagaaagctgccgacgtgacatgggaagaggaagccgagcagacgggagtctctcataacctgatgattaccgtggatgacgatggcacaatgcggatcaaggacgatgaaaccgagaacattcttacagtcctgctgaaaaccgctctcctgatcgtgtccggcatctttccttacagcattcccgccacgcttctggtttggcacacctggcagaagcagacacaacgctctggggtgctctgggacgtcccttctcccccggagacccagaaagcggaactggaggaaggagtgtacagaatcaagcagcagggcattttcgggaagacacaagttggagtgggcgtccagaaagagggggtgtttcataccatgtggcacgtgacacggggagctgttctcacgcacaatggcaagcgcctggagcctaactgggccagcgtcaaaaaggatcttatcagctatggcgggggatggagactgtccgcccagtggcaaaaaggcgaagaggtccaggtgattgctgtcgaacccgggaagaatcctaagaacttccagaccatgcccggaatcttccagacaaccaccggcgagattggggccatcgcgctggactttaaacccggaacaagcggctcccctatcattaatcgggaaggcaaggtggttgggctctacggaaacggcgtggtcacgaaaaatgggggatatgtgagcggcatcgctcaaaccaacgccgagccggatgggcccacacctgagctggaagaggaaatgttcaagaaacgcaatcttaccattatggacctgcatcccggctctggaaagacaagaaagtacctccctgccatcgttcgggaggctattaaacgcagactgcggaccctcatcctggcccccacgagagtggtcgctgccgaaatggaggaggcgcttaagggcctgcctatccgctatcagacaaccgccaccaaaagcgaacacacagggcgggagattgtggatctgatgtgccatgctacctttacaatgagactcctgtccccggttcgcgtgcccaactacaatcttgtcatcatggacgaagcccacttcaccgatcctgcttctattgccgcccggggatatatcagcacgagagtgggcatgggggaggctgcggccatttttatgacagctacaccccctggaacagccgaagccttcccccagtccaacgctccgatccaggacgaggagcgcgacatccctgaacggtcttggaatagcggcaacgagtggattaccgattttgtggggaagacggtctggttcgttccctccatcaaagccggcaatgacattgcgaactgtctgagaaagaacggaaagaaagtgatccaactctctcgcaagacctttgatacagaataccagaaaacccggctgaatgactgggatttcgtggtcacaaccgacattagcgagatgggcgctaactttaaggccgatagagtgatcgacccccggcgctgcctgaaacctgttattctcacagatgggcccgagagagtgatccttgccggacctatgccggtcaccgctgcctccgcggcccagcggcgcggcagagtggggcggaatccccagaaggaaaacgaccaatacatcttcacgggacagcctctgaataacgatgaggaccatgctcactggacagaagccaagatgctgctcgacaatattaacacccccgagggcatcattcctgctctgttcgaacccgagagagagaaaagcgccgctatcgatggggaatatcgccttaagggcgagtctcggaaaacctttgttgaactgatgagacgcggagacctcccggtgtggctggcccacaaggtcgcgtccgagggcattaaatacacagatcggaagtggtgcttcgacggggaaagaaataaccagatcctggaggagaatatggatgtggaaatctggaccaaagagggagaacgcaagaagctccggcctagatggcttgacgcccgcacatatagcgatcccctggctctgaaagagtttaaggacttcgccgctggcagaaaatctattgccctcgatctggtcacggaaatcgggcgggtgccttcccatcttgcccaccgcaccagaaacgctctggacaatctcgttatgctgcatacaagcgagcacggaggccgggcgtaccgccacgccgtggaggaactgcccgagaccatggaaacactccttctgctgggcctcatgattctgcttaccgggggagctatgctgtttctcatctccggcaaggggattggaaaaacgtctatcggcctgatctgtgtgattgccagctccgggatgctgtggatggccgatgtccctctccagtggatcgctagcgccattgttcttgagttctttatgatggtgctgctgatccccgagccggaaaagcaaagaacccctcaggacaaccagctcgcgtatgtggtcattggaatcctgacacttgccgctattgtggccgctaatgagatgggcctgctcgaaaccacaaagcgggatctgggcatgtctaaagagcccggggttgtgtcccccaccagctacctggacgtcgacctccatcctgcctctgcgtggacgctttatgccgtggctacaaccgtcatcacaccgatgctgagacacaccatcgaaaacagcaccgccaatgtgtccctggctgccattgctaaccaagccgttgtgctcatgggactggataagggctggcccatctctaaaatggaccttggggtccctctgctcgcgctgggatgctacagccaggtgaaccccctgacactcacggccgctgttcttctgctggtgacccattacgccattatcggccctgggctccaggctaaggccacacgcgaggcccagaaacggaccgcggctggaattatgaagaatcccacagtcgatggcatcatgaccatcgacctggatcctgtgatttatgactccaagttcgagaaacaacttggccaggtgatgctgctcgttctgtgtgccgtccagctgctccttatgagaacgtcttgggctctgtgcgaagccctgacactcgccaccgggccgatcaccacactgtgggagggaagccccggcaagttttggaacaccacaattgctgtgtccatggccaatatcttccgcgggagctaccttgcgggagccggcctggctttttctattatgaaatccgtggggacgggacggagaggcaccggcagccagggggaaacactcggagagaagtggaaaaagaagctgaaccaactgtcccggaaagagttcgatctctataagaaatctggcatcaccgaggtcgaccgcacagaggccaaggaagggcttaaaagaggagagaccacgcaccatgctgttagccggggctccgccaagctgcagtggtttgtggaacgcaatatggtgatccctgaggggagagtcattgatctgggatgtggccggggcgggtggtcttactattgcgcgggactcaaaaaggtgaccgaagttcgcggctacacaaaaggcgggcccgggcacgaggagcctgtgcccatgagcacctatgggtggaacatcgtcaaactgatgtccggaaaggacgtgttctaccttccgcctgaaaaatgtgatacactgctctgcgacattggcgagagctctccctcccccaccgttgaagagagcagaacaatccgggtgctgaagatggtcgagccttggctgcgcaataaccagttctgtattaaagtgctcaatccctacatgcctaccgtgatcgaacaccttgagagactgcagcggaagtatggcgggatgctggtcagaaacccgctctctcgcaattccacgcatgaaatgtactggattagcaacggaacaggcaatatcgtttctagcgtgaacatggtgtcccggctgcttctgaatagatttaccatgacccaccgccggcccacaatcgagaaggatgtcgacctcggggccggaacgagacatgtgaacgctgaacctgagacccccaacatggacgttattggcgagcgcatcaaacggattaaggaagaacactctagcacatggcactatgatgacgaaaatccttacaaaacctgggcctatcatgggtcctacgaggtgaaggctacaggaagcgcctcctctatgatcaacggcgtcgtgaaactgctgaccaagccctgggatgttgtgccgatggtcacacaaatggctatgaccgacacgacccctttcggccagcagagagtgtttaaggaaaaagttgatacacgcacaccccggcctatgcccgggacaagaaaggtgatggagattaccgccgagtggctctggcgcacgctgggacggaataaaaagcctagactttgcacacgcgaagagttcaccaaaaaggtcagaacaaacgcggccatgggcgctgtgtttaccgaagagaatcaatgggacagcgcccgggctgccgtcgaagatgaggagttctggaagctggtggaccgcgaaagagagctccacaaactggggaagtgtggatcctgcgtttataacatgatgggcaaacgggaaaagaaacttggggagtttggcaaggccaaaggatctagagcgatctggtacatgtggctgggcgctcggtacctcgagttcgaagccctggggtttctgaatgaggatcattggttcagccgcgaaaactcctattctggagtggagggcgaagggctccacaagctgggatacatccttagagacattagcaagatccccggcggggccatgtatgctgatgacacggccggctgggacacccggattacagaggatgacctgcataatgaggagaagatcacccagcagatggatccggagcaccgccagctcgctaacgccatttttaagctgacataccaaaataaagtcgtgaaggtgcagagacctacccccaaaggaacagttatggacatcatctcccggaaggatcagcgcggcagcggacaggtgggaacctatggccttaacacgttcacaaatatggaagcgcaactggtcagacagatggagggggaaggagtgctctctaaggccgacctggagaacccccatctgctcggcaaaaagattacccagtggctggagaccaaaggggttgaacggcttaagcgcatggctatctccggcgatgactgcgtggtcaaacctattgatgacagatttgccaatgctctgctcgccctgaacgatatgggaaaggtgcggaaggacatcccgcagtggcaacccagcaaaggctggcatgattggcagcaggtccctttctgttctcaccatttccacgagcttattatgaaggacgggcgcaaactggtggttccctgcagacctcaggacgaactcatcggacgggcgcgcatctcccaaggcgccgggtggagcctgaaggagacagcttgtctgggaaaagcctacgctcagatgtggtctctcatgtattttcacagacgggatctgagacttgcctccaacgctatttgcagcgccgtgcccgtccattggatccctacctcccgcacaacgtggagcattcacgcgcatcaccagtggatgaccacagaagacatgctgaccgtgtggaatcgggtttggatcgaggataacccctggatggaggacaagacaccggtgaccacgtgggaagatgtcccttacctcggcaagagagaggaccaatggtgtgggtctctgattggccttaccagccgcgccacatgggctcagaatatcctgaccgccattcaacaggtgcggtccctcatcggagatgaagagttcctggactacatgccctctatgaaaagatttcgcaaggaggaagagagcgaaggcgccatctggtga

SEQ ID NO: 20504 - RNA, 9873 nt, synthetic construct
  misc_feature 1..9873: note = derived and/or modified CDS sequence (opt5) from DENV-3__FJ639726__SS-prME
  source 1..9873: mol_type = other RNA
acctccctgtgcctcatgatgatgctgcccgccacacttgctttccacctgacgtcccgggacggcgagcctcggatgatcgtggggaagaacgaacgcggaaagtctctcctgtttaagaccgccagcggcattaatatgtgtacccttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggagacaggtggaacgcgttgagacatgggccctgagacatcccggcttcaccattcttgcgctgtttctcgcccactacatcgggacgtccctgacacagaaagtggtcatcttcattcttctgatgctcgtgaccccttctatgacaatgcggtgtgttggagtgggcaaccgcgactttgtcgaagggctgagcggagctacctgggtggatgtggtcctggagcatggcgggtgcgttaccacaatggccaagtccaagcccacgctcgacatcgagctgcagaaaaccgaagctacacagcttgccaccctgagaaagctctgtattgagggaaaaatcacaaatattaccacggatagccggtgccctacacagggcgaagcgaccctgccggaggaacaggaccagaactatgtgtgtaagcacacctacgtggatcgcggctgggggaatggatgcggccttttcgggaaaggatctctggtcacatgcgccaagtttcaatgtctcgagcccatcgagggcaaggtggttcagtatgaaaacctgaaatacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctagaacgggacttgatttcaacgagatgattctgctcaccatgaagaataaggcttggatggtccaccggcagtggtttttcgacctgccccttccgtggacatctggcgccaccacagagacccctacgtggaaccgcaaggaactgctcgtgacatttaaaaatgcccatgctaagaaacaagaggttgtggtcctggggtcccaggaaggagcgatgcacaccgccctgacaggcgctaccgagatccagaacagcgggggcacctctattttcgccggacacctcaagtgtagactgaagatggataaacttgaactgaagggcatgtcctacgccatgtgcctcaatacatttgtgctgaaaaaggaggttagcgagacgcagcatgggaccatcctgattaaagtggaatacaagggagaggacgctccctgtaagatccctttctccacagaagatggccaagggaaagcccacaacggacggcttatcaccgcgaaccccgtcgtgacaaagaaagaggagcccgtgaatattgaagctgagcctccgttcggcgaatctaacatcgttattgggatcggcgacaaggccctcaaaattaattggtataagaagggaagctccatcggcaaaatgtttgaggccaccgctagaggggcccgccggatggctatcctgggagatacggcctgggacttcggcagcgtcgggggagtgctgaactctctcggcaagatggtgcatcagatttttgggtccgcgtacacagccctgttcagcggcgtctcttggatcatgaaaattggaatcggcgtgcttctgacctggattgggctcaatagcaagaacacctccatgtcttttagctgcatcgttattggaatcatcacactgtatctgggcgctgtggtccaggccgatatggggtgtgtgattaattggaaaggaaaggaacttaagtgcggctccgggatcttcgttaccaacgaggtgcacacatggacggagcagtacaaatttcaagctgacagccccaagagactcgccaccgcgattgccggcgcttgggaaaatggagtctgtggcatccgctctacaacccggatggagaacctgctgtggaaacagattgccaatgaactcaactatatcctgtgggagaataacatcaaacttacagtggttgtgggggatattatcggagtcctggaacagggcaaaagaaccctcacgcctcagcccatggagctgaagtactcctggaaaacctgggggaaggctaagattgtgacagccgagacccaaaatagctctttcatcattgacggacctaacacacccgaatgcccgtccgccagccgcgcttggaacgtgtgggaggtcgaagactatggctttggcgttttcaccacaaatatctggctgaaacttcgggaggtgtacacccagtcctgtgatcatagactcatgtctgcggccatcaaggacgaacgcgctgtgcacgccgatatggggtactggattgagagccagaaaaacggatcctggaagctggagaaagcctcttttatcgaagtcaagacgtgcacatggcctaagagccacaccctgtggtccaatggcgtgctcgagagcgacatgattatccccaaatctctggctgggcctatttcccagcataaccaccggcccggatatcatacccaaacagccggcccttggcaccttgggaagctggaactcgatttcaattactgcgagggaaccacggttgtgatcacagagaactgtggcaccagaggccccagcctgcgcacaaccacagtctctgggaaactgatccacgaatggtgctgtcggtcctgcacccttccgcctctcagatatatgggagaggacggctgttggtacgggatggaaattcggcccatcaatgagaaggaagagaacatggtgaaaagcctggtttctgcgggaagcggcaaggtggataattttacgatgggggtcctgtgcctcgctattctgttcgaggaagtgatgcgcggaaagttcggcaaaaagcatatgatcgccggcgttctttttaccttcgtgctgctcctgtccgggcagattacatggagagacatggcccacaccctgatcatgattggaagcaacgcttctgatcggatgggcatgggggtcacatatcttgccctgatcgcgacctttaaaatccagcccttcctcgctctgggatttttcctcagaaagctgacgtcccgcgagaatcttctgctcggcgtggggctggccatggccacaaccctgcaacttcctgaagacattgagcagatggctaacggaatcgccctgggcctcatgacactgaaactcattacccagtttgaaacctaccagctgtggacagctcttgtgagcctgacgtgttccaataccatcttcacactcaccgtcgcctggcggacagcgaccctgattctggccggcgtttctcttctgccgctctgccaaagctcctctatgagaaagacggattggctgcccatgacagtggctgccatgggggtgcctcccctccctctgtttatcttcagccttaaggacacccccaaacgcagatcctggcctctgaacgagggagtcatggctgtgggcctggtttctatcctcgccagctccctgcttcggaatgatgtgcccatggccgggccgctggtcgctggaggcctcctgattgcgtgttatgtgatcaccgggacaagcgccgacctcaccgttgagaaggctgccgacgtgacatgggaagaggaagccgagcagacgggagtctctcataacctgatgattaccgtggatgacgatggcacaatgcgcatcaaagacgatgaaaccgagaacattcttacagtcctgctgaagaccgctctcctgatcgtgtccggcatctttccttacagcattcccgccacgcttctggtttggcacacctggcagaaacagacacaaagatctggggtgctctgggacgtcccttctcccccggagacccagaaggcggaactggaggaaggagtgtaccggatcaaacagcagggcattttcgggaagacacaagttggagtgggcgtccagaaggagggggtgtttcataccatgtggcacgtgacacgcggagctgttctcacgcacaatggcaaaagactggagcctaactgggccagcgtcaagaaagatcttatcagctatggcgggggatggcggctgtccgcccagtggcaaaagggcgaagaggtccaggtgattgctgtcgaacccgggaaaaatcctaagaacttccagaccatgcccggaatcttccagacaaccaccggcgagattggggccatcgcgctggactttaagcccggaacaagcggctcccctatcattaatcgcgaaggcaaagtggttgggctctacggaaacggcgtggtcacgaagaatgggggatatgtgagcggcatcgctcaaaccaacgccgagccggatgggcccacacctgagctggaagaggaaatgttcaaaaagagaaatcttaccattatggacctgcatcccggctctggaaaaacacggaagtacctccctgccatcgttcgcgaggctattaagagacggctgagaaccctcatcctggcccccacgcgcgtggtcgctgccgaaatggaggaggcgcttaaaggcctgcctatccggtatcagacaaccgccaccaagagcgaacacacagggagagagattgtggatctgatgtgccatgctacctttacaatgcgcctcctgtccccggttcgggtgcccaactacaatcttgtcatcatggacgaagcccacttcaccgatcctgcttctattgccgccagaggatatatcagcacgcgcgtgggcatgggggaggctgcggccatttttatgacagctacaccccctggaacagccgaagccttcccccagtccaacgctccgatccaggacgaggagcgggacatccctgaaagatcttggaatagcggcaacgagtggattaccgattttgtggggaaaacggtctggttcgttccctccatcaaggccggcaatgacattgcgaactgtctgcgcaaaaacggaaagaaggtgatccaactctctcggaaaacctttgatacagaataccagaagaccagactgaatgactgggatttcgtggtcacaaccgacattagcgagatgggcgctaactttaaagccgatcgggtgatcgacccccgcagatgcctgaagcctgttattctcacagatgggcccgagcgggtgatccttgccggacctatgccggtcaccgctgcctccgcggcccagcgcagaggccgggtggggagaaatccccagaaagaaaacgaccaatacatcttcacgggacagcctctgaataacgatgaggaccatgctcactggacagaagccaagatgctgctcgacaatattaacacccccgagggcatcattcctgctctgttcgaacccgagcgcgaaaagagcgccgctatcgatggggaatatcggcttaaaggcgagtctagaaagacctttgttgaactgatgcgccggggagacctcccggtgtggctggcccacaaagtcgcgtccgagggcattaagtacacagatagaaaatggtgcttcgacggggaacgcaataaccagatcctggaggagaatatggatgtggaaatctggaccaaggagggagaacggaaaaagctcagacctcgctggcttgacgccagaacatatagcgatcccctggctctgaaggagtttaaagacttcgccgctggccggaagtctattgccctcgatctggtcacggaaatcgggcgcgtgccttcccatcttgcccacagaacccggaacgctctggacaatctcgttatgctgcatacaagcgagcacggaggccgcgcgtacagacacgccgtggaggaactgcccgagaccatggaaacactccttctgctgggcctcatgattctgcttaccgggggagctatgctgtttctcatctccggcaaagggattggaaagacgtctatcggcctgatctgtgtgattgtcagctccgggatgctgtggatggccgatgttcctctccagtggatcgccagcgctattgtgcttgagttctttatgatggtgctgctgatccccgagccggaaaaacaacggacccctcaggacaaccagctcgcctatgtcgtgattggaatcctgacacttgcggccattgttgctgccaatgagatgggcctgctcgaaaccacaaagagagatctgggcatgtctaaggagcccggggtggtctcccccaccagctacctggacgtggacctccatcctgcttctgcctggacgctttatgcggtcgccacaaccgtgatcacaccgatgctgcgccacaccatcgaaaacagcaccgctaatgtttccctggccgctattgccaaccaagctgtggtcctcatgggactggataaaggctggcccatctctaagatggaccttggggtgcctctgctcgccctgggatgctacagccaggttaaccccctgacactcacggcggccgtgcttctgctggtcacccattacgctattatcggccctgggctccaggccaaagctacacgggaggcccagaagagaaccgccgcgggaattatgaaaaatcccacagtggatggcatcatgaccatcgacctggatcctgtgatttatgactccaagttcgagaagcaacttggccaggttatgctgctcgtcctgtgtgctgtgcagctgctccttatgcgcacgtcttgggccctgtgcgaagctctgacactcgccaccgggccgatcaccacactgtgggagggaagccccggcaaattttggaacaccacaattgccgtgtccatggctaatatcttccgggggagctaccttgccggagcgggcctggccttttctattatgaagtccgtcgggacgggaagacggggcaccggcagccagggggaaacactcggagagaaatggaagaaaaagctgaaccaactgtcccgcaaggagttcgatctctataaaaagtctggcatcaccgaggttgacagaacagaggctaaagaagggcttaagcggggagagaccacgcaccatgccgtgagccgcggctccgctaaactgcagtggtttgtggaaagaaatatggtcatccctgaggggcgggtgattgatctgggatgtggccgcggcgggtggtcttactattgcgccggactcaagaaagttaccgaagtgagaggctacacaaaagggggacccggccacgaggagcctgtccccatgagcacctatgggtggaacatcgtgaagctgatgtccggaaaagacgttttctaccttagcccggaaaagtgtgatacactgctctgcgacattggcgagtcttcccctagccccaccgtggaagagtctcggacaatccgcgtcctgaaaatggtggagccctggctgagaaataaccagttctgtattaaggtgctcaatccttacatgcccaccgtcatcgaacaccttgagcggctgcagagaaaatatggcgggatgctggttcgcaaccctctctcccggaatagcacgcatgaaatgtactggatttctaacggaacaggcaatatcgtgagctccgtgaacatggtctctagactgcttctgaatcgctttaccatgacccaccggagaccgacaatcgagaaggatgtggacctcggggcgggaacgcgccatgttaacgccgaacccgagacccctaacatggacgtgattggcgagcggatcaagagaattaaagaagaacacagctccacatggcactatgatgacgaaaatccctacaagacctgggcttatcatgggagctacgaggtcaaagccacaggatccgcttctagcatgatcaacggcgtggttaagctgctgaccaaaccttgggatgtggtccccatggtgacacaaatggccatgaccgacacgaccccgttcggccagcagcgcgtttttaaggaaaaggtggatacacggacccctagacccatgcctgggacacgcaaagtcatggagattaccgctgagtggctctggcggacgctgggaagaaataagaaaccccgcctttgcacaagagaagagttcaccaagaaagtgcggacaaacgccgcgatgggcgccgtctttaccgaagagaatcaatgggactccgctcgcgccgctgtggaagatgaggagttctggaagctggttgacagagaacgggagctccacaagctggggaaatgtggatcttgcgtgtataacatgatgggcaagagagagaagaaacttggggagtttggcaaagccaagggaagccgggccatctggtacatgtggctgggcgcgcgctacctcgagttcgaagctctggggtttctgaatgaggatcattggttctccagagaaaactcttatagcggagtcgagggcgaagggctccacaaactgggatacatccttcgggacatttccaagatccctggcggggccatgtatgccgatgacacggctggctgggacacccgcattacagaggatgacctgcataatgaggaaaagatcacccagcagatggatcccgagcacagacagctcgccaacgctatttttaaactgacataccaaaataaggtggtgaaagttcagcggccgacccctaagggaacagtgatggacatcatcagccgcaaagatcagagaggctctgggcaggtcggaacctatggccttaacacgttcacaaatatggaagcccaactggtgcggcagatggagggggaaggagttctctccaaggcggacctggagaacccccatctgctcgagaagaaaattacccagtggctggaaaccaagggcgtggagcgccttaaaagaatggccatcagcggggatgactgcgtcgtgaagcccattgatgaccggtttgctaatgccctgctcgctctgaacgatatgggcaaagtccgcaaggacatccctcagtggcaaccgtctaagggatggcatgattggcaacaggtgcccttctgttcccaccatttccacgaacttattatgaaagacggcagaaagctggttgtgccttgccggccccaggacgagctcatcgggcgcgccagaatcagccaaggagcgggctggtctctgaaagaaacagcctgtctggggaaggcttacgcccagatgtggtccctcatgtattttcaccggagagatctgcgccttgctagcaacgccatttgctccgctgtccctgtgcattggatccccaccagccggacaacgtggtctattcacgcccatcaccagtggatgaccacagaggacatgctgaccgtttggaatagagtgtggatcgaggataacccttggatggaagacaaaacacccgtcaccacgtgggaggatgtgccgtacctcggaaagcgcgaagaccaatggtgtggcagcctgattgggcttacctcccgggcgacatgggcccagaatatcctgaccgctattcaacaggtgagatctctcatcggcgatgaggagttcctggactacatgcctagcatgaagcgctttcggaaagaagaggaatccgagggagccatctggtga

SEQ ID NO: 20505 - RNA, 9873 nt, synthetic construct
  misc_feature 1..9873: note = derived and/or modified CDS sequence (opt5) from DENV-3__KF955333__SS-prME
  source 1..9873: mol_type = other RNA
acatccctgtgcctcatgatgatgctgcccgccacacttgctttccacctgacgtcccgggacggcgaacctcggatgatcgtggggaagaacgaacgcggaaaatctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctgggaaaatggagtgtgtggcatcagatctacaacccgcatggagaacctgctgtggaagcagattgctaatgaactcaactatatcctgtgggagaataacatcaaacttacagtcgtggttggggatattatcggagtgctggaacagggcaagcggaccctcacgcctcagcccatggagctgaaatactcctggaagacctgggggaaggccaaaattgtcacagccgagacccaaaatagctctttcatcattgacggacctaacacacccgaatgcccgtccgctagcagagcgtggaacgtgtgggaggtggaagactatggctttggcgtcttcaccacaaatatctggctgaaacttcgcgaggtttacacccagtcctgtgatcatcggctcatgtctgccgctatcaaagacgaaagagccgcccacgctgatatggggtactggattgagagccagaagaacggatcctggaaactggagaaggcctcttttatcgaagtgaagacgtgcacatggcctaaaagccacaccctgtggtccaatggcgtgctcgagagcgacatgattatccccaagtctctggcggggcctatttcccagcataaccaccgccccggatatcatacccaaacagctggcccttggcaccttgggaaactggaactcgatttcaattactgcgagggaaccacggtcgtgatcacagagaactgtggcacccggggccccagcctgagaacaaccacagtttctgggaagctgatccacgaatggtgctgtcgctcctgcacccttccgcctctccggtatatgggagaggacggctgttggtacgggatggaaattagacccatcaatgagaaagaagagaacatggtcaagagcctggtgtctgccggaagcggcaaggtggataattttacgatgggggttctgtgcctcgccattctgttcgaggaagtgatgcggggaaaattcggcaagaaacatatgatcgctggcgtcctttttaccttcgtgctgctcctgtccgggcagattacatggcgcgacatggcccacaccctgatcatgattggaagcaacgcgtctgatagaatgggcatgggggttacatatcttgctctgatcgccacctttaagatccagcccttcctcgccctgggatttttcctccggaaactgacgtccagagagaatcttctgctcggcgtggggctggctatggccacaaccctgcaacttcctgaagacattgagcagatggctaacggaatcgccctgggcctcatgacactgaagctcattacccagtttgaaacctaccagctgtggacagcgcttgtcagcctgacgtgttccaataccatcttcacactcaccgtggcctggcgcacagctaccctgattctggccggcgtgtctcttctgccgctctgccaaagctcctctatgcggaagacggattggctgcccatgacagtcgctgccatgggggttcctcccctccctctgtttatcttcagccttaaagacacccccaagagacgctcctggcctctgaacgagggagtgatggccgtgggcctggtctctatcctcgctagctccctgcttagaaatgatgtgcccatggcggggccgctggttgccggaggcctcctgattgcttgttatgtgatcaccgggacaagcgccgacctcaccgtcgagaaacctgccgacgtgccctgggaagaggaagctgagcagacaggagtttctcataacctgatgattacggtggatgacgatggccctatgcggatcaaggacgatgaaaccgagaacattcttacagtcctgctgaaaaccgccctcctgatcgtgtccggcatctttccctacagcattccggcgacacttctggtctggcacacctggcagaagcagacgcaacgctctggggtgctctgggacgttccttctccccctgagacccagaaagctgaactggaggaaggagtgtacagaatcaagcagcagggcattttcgggaagacacaagtcggagtgggcgttcagaaagagggggtgtttcataccatgtggcacgtcacacggggagccgtgctcacccacaatggcaagcgcctggagcccaactgggccagcgtgaaaaaggatcttatcagctatggcgggggatggagactgaatgctcagtggcaaaaaggcgaagaggttcaggtcattgccgtggaacccgggaagaaccctaagaatttccagacaatgccgggaatcttccagacgaccacaggcgagattggggcgatcgctctggactttaaacccggaacctccggcagccctatcattaaccgggaaggcaaggtggtcgggctctacggaaatggcgtggttaccaaaaacgggggatatgtgtccggcatcgcccaaacaaatgccgagcccgatgggcctacgcccgagctggaagaggaaatgttcaagaaacgcaaccttaccattatggacctgcatcctggcagcggaaagacaagaaagtacctcccggctatcgtccgggaggccattaaacgcagactgcggaccctcatcctggctcccacaagagtggttgccgcggaaatggaggaggcccttaagggcctgcctatccgctatcagaccacggctacaaaatctgaacacaccgggcgggagattgtggatctgatgtgccatgccacctttacaatgagactcctgagccccgtccgcgtgcctaattacaaccttgttatcatggacgaagctcacttcaccgatcccgcctccattgccgctcggggatatatctctacaagagtgggcatgggggaggcggccgctatttttatgaccgccacgccgcctggaacagccgaggctttcccccagagcaatgcccccatccaggacgaggagcgcgacatccctgaacggtcctggaactctggcaatgagtggattaccgattttgtcgggaagacagtgtggttcgtgcccagcatcaaagcgggcaacgacattgctaactgtctgagaaagaatggaaagaaagtcatccaactctcccgcaagacctttgatacggaataccagaaaacccggctgaacgactgggatttcgttgtgacaaccgacatttctgagatgggcgccaattttaaggccgatagagtgatcgaccctcggcgctgcctgaaaccggtcattctcacagatgggcccgagagagtgatccttgctggacctatgcccgttaccgccgcgagcgccgctcagcggcgcggcagagtggggcggaaccctcagaaggaaaatgaccaatacatcttcacaggacagcccctgaacaatgatgaggaccatgcccactggaccgaagctaagatgctgctcgacaacattaatacgccggagggcatcattcctgccctgttcgaacccgagagagagaaatccgctgccatcgatggggaatatcgccttaagggcgagagccggaaaacatttgtcgaactgatgagacgcggagacctccctgtgtggctggcgcacaaggttgcctctgagggcattaaatacaccgatcggaagtggtgcttcgacggggaaagaaacaatcagatcctggaggagaacatggatgtggaaatctggaccaaagagggagaacgcaagaagctccggcccagatggcttgacgctcgcacatattccgatcctctggccctgaaagagtttaaggacttcgctgccggcagaaaaagcattgccctcgatctggtcaccgaaatcgggcgggtgccctctcatcttgctcaccgcacaagaaatgcgctggacaacctcgtcatgctgcatacgtccgagcacggaggccgggcctaccgccacgctgtggaggaactgccggagaccatggaaacactccttctgctgggcctcatgattctgcttaccgggggagccatgctgtttctcatcagcggcaaggggattggaaaaacatccatcggcctgatctgtgttattgtgtctagcgggatgctgtggatggccgatgtgcctctccagtggatcgcttccgccattgtccttgagttctttatgatggttctgctgatccccgagcccgaaaagcaaagaacccctcaggacaatcagctcgcgtatgtggtgattggaatcctgacgcttgccgctattgtcgccgctaacgagatgggcctgctcgaaaccacaaagcgggatctgggcatgagcaaagagccgggggtggtttctcccacctcctacctggacgtggacctccatcctgccagcgcgtggacactttatgccgtcgctaccacggtgatcacacccatgctgagacacaccatcgaaaattctacagccaacgtcagcctggctgccattgctaaccaagccgtggttctcatgggactggataagggctggcctatctccaaaatggaccttggggtgcccctgctcgcgctgggatgctactctcaggtcaatcctctgaccctcaccgccgctgtgcttctgctggttacacattacgccattatcggcccggggctccaggctaaggccacgcgcgaggcccagaaacggaccgcggctggaattatgaagaaccccacagtggatggcatcatgaccatcgacctggatcctgtcatttatgacagcaagttcgagaaacaacttggccaggtgatgctgctcgtgctgtgtgccgttcagctgctccttatgagaacatcctgggctctgtgcgaagccctgaccctcgccacggggcccatcacaaccctgtgggagggatctcctggcaagttttggaataccacaattgctgtcagcatggccaacatcttccgcgggtcctaccttgcgggagccggcctggcttttagcattatgaaatctgtggggaccggacggagaggcacaggctcccagggggaaacgctcggagagaagtggaaaaagaagctgaatcaactgagccggaaagagttcgatctctataagaaatccggcatcaccgaggtggaccgcacagaggccaaggaagggcttaaaagaggagagaccacacaccatgctgtctctcggggcagcgccaagctgcagtggtttgttgaacgcaacatggtgatccccgaggggagagtgattgatctgggatgtggccggggcgggtggtcctactattgcgcgggactcaaaaaggtcaccgaagtgcgcggctacacgaaagggggaccgggccacgaggagcctgttcccatgtctacctatgggtggaatatcgtgaaactgatgagcggaaaggacgtcttctaccttccccctgaaaaatgtgatacactgctctgcgacattggcgagtccagcccctctcctaccgtggaagagtccagaacaatccgggttctgaagatggtggagccgtggctgcgcaacaatcagttctgtattaaagtcctcaacccctacatgcctaccgtgatcgaacaccttgagagactgcagcggaagtatggcgggatgctggtgagaaatcccctcagccgcaactctacacatgaaatgtactggatttccaatggaaccggcaacatcgtcagctctgttaatatggtgagccggctgcttctgaacagatttacgatgacacaccgccggcctaccatcgagaaggatgtggacctcggggccggaaccagacatgtcaacgctgaacccgagacaccgaatatggacgtgattggcgagcgcatcaaacggattaaggaagaacactcctctacgtggcactatgatgacgaaaacccttacaaaacctgggcctatcatgggagctacgaggttaaggctacaggatccgccagctccatgatcaatggcgtggtcaaactgctgaccaagccctgggatgtggttcctatggtgacacaaatggctatgaccgacacaacccccttcggccagcagagagtctttaaggaaaaagtggatacgcgcacccctcggcccatgccggggacaagaaaggttatggagattaccgccgagtggctctggcgcacactgggacggaacaaaaagcctagactttgcacccgcgaagagttcacgaaaaaggtgagaacaaatgcggccatgggcgctgtctttaccgaagagaaccaatgggactctgcccgggctgccgtggaagatgaggagttctggaagctggtcgaccgcgaaagagagctccacaaactggggaagtgtggaagctgcgtgtataatatgatgggcaaacgggaaaagaaacttggggagtttggcaaggccaaaggatccagagcgatctggtacatgtggctgggcgctcggtacctcgagttcgaagccctggggtttctgaacgaggatcattggttctctcgcgaaaatagctattccggagttgagggcgaagggctccacaagctgggatacatccttagagacatttctaagatccccggcggggccatgtatgctgatgacacagccggctgggacacccggattacggaggatgacctgcataacgaggagaagatcaccgctcagatggatcccgagcaccgccagctcgccaatgcgatttttaagctgacataccagaacaaagtggtcaaggtgcaaagacctaccccgaaaggaacagtgatggacatcatcagccggaaggatcagcgcggctccgggcaggttggaacctatggccttaatacattcaccaacatggaagcccagctggtgagacaaatggagggggaaggagtcctcagcaaggctgacctggagaatccccatctgctcgagaaaaagattacgcagtggctggaaacaaaaggcgtggagcggcttaagcgcatggccatctctggggatgactgcgttgtgaaacctattgatgacagatttgctaacgccctgctcgcgctgaacgatatgggcaaggtccggaaggacatcccccagtggcagccttccaaaggatggcatgattggcaacaggtgcccttctgtagccaccatttccacgaacttattatgaaggacggccgcaaactggtcgtgccttgcagaccccaggacgagctcatcgggcgggcccgcatctctcagggagctggctggtccctgaaggaaaccgcctgtctggggaaggcttacgcccaaatgtggagcctcatgtattttcacagacgggatctgagacttgcttctaatgccatttgctccgcggttccggtgcattggatccctaccagccgcacaacctggtccattcacgcccatcaccagtggatgacaacggaggacatgctgaccgtctggaaccgggtgtggatcgaggataatccctggatggaagacaagacacctgttaccacatgggaggatgtgccctacctcggaaagagagaagaccagtggtgtggcagcctgattgggcttacctctcgcgctacgtgggcccaaaacatcctgaccgccattcagcaggtccggagcctcatcggcgatgaggagttcctggactacatgccgtccatgaaaagatttcgcaaggaagaggaatctgagggagctatctggtga

SEQ ID NO: 20506 - RNA, 9873 nt, synthetic construct
  misc_feature 1..9873: note = derived and/or modified CDS sequence (opt5) from DENV-3__GQ868628__SS-prME
  source 1..9873: mol_type = other RNA
acatccctgtgcctcatgatgatgctgcccgccacacttgctttccacctgacgtcccgggacggcgaacctcggatgatcgtggggaagaacgaacgcggaaaatctctcctgtttaagacagccagcggcattaatatgtgtacacttatcgcgatggatctgggggaaatgtgcgacgatacagtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccagcagagcttggaacgtgtgggaggtcgaagactatggctttggcgttttcaccacaaatatctggctgaaacttcgcgaggtgtacacccagtcctgtgatcatcggctcatgtctgcggccatcaaagacgaaagagctgtgcacgccgatatggggtactggattgagagccagaagaacggatcctggaaactggagaaggcctcttttatcgaagtcaagacgtgcgcttggcctaaaagccacacactgtggtccaatggcgtgctcgagagcgacatgattatccccaagtctctggccgggcctatttcccagcataaccaccgccccggatatcatacccaaaccgcgggcccttggcaccttgggaaactggaactcgatttcaattactgcgagggaacaaccgttgtgatcacggagaactgtggcacacggggccccagcctgagaaccacaaccgtctctgggaagctgatccacgaatggtgctgtcgctcctgcacacttccgcctctccggtatatgggagaggacggctgttggtacgggatggaaattagacccatcaatgagaaagaagagaacatggttaagagcctggtgtctgctggaagcggcaaggtggataattttaccatgggggtcctgtgcctcgccattctgttcgaggaagtgatgcggggaaaattcggcaagaaacatatgatcgccggcgttctttttacgttcgtgctgctcctgtccgggcagattacctggcgcgacatggctcacacactgatcatgattggaagcaacgcctctgatagaatgggcatgggggtcacctatcttgcgctgatcgctacatttaagatccagcccttcctcgccctgggatttttcctccggaaactgacctccagagagaatcttctgctcggcgtggggctggccatggctacgacactgcaacttcctgaagacattgagcagatggccaacggaatcgctctgggcctcatgaccctgaagctcattacacagtttgaaacctaccagctgtggaccgcccttgtgagcctgacatgttccaatacgatcttcaccctcacagtcgcgtggcgcaccgccacactgattctggctggcgtttctcttctgccgctctgccaaagctcctctatgcggaagaccgattggctgcccatgacggtggccgctatgggggtgcctcccctccctctgtttatcttcagccttaaagacacacccaagagacgctcctggcctctgaacgagggagtcatggccgtgggcctggtttctatcctcgccagctccctgcttagaaatgatgtgcccatggctgggccgctggtcgcgggaggcctcctgattgcctgttatgtgatcaccgggaccagcgctgacctcacagttgagaaagccgccgacgtgacctgggaagaggaagctgagcagacaggagtctctcataacctgatgattacggtggatgacgatggcaccatgcggatcaaggacgatgaaacagagaacattcttaccgtcctgctgaaaacagccctcctgatcgtgtccggcatctttccttacagcattcccgcgacccttctggtttggcacacgtggcagaagcagacccaacgctctggggtgctctgggacgtcccttctcccccggagacacagaaagctgaactggaggaaggagtgtacagaatcaagcagcagggcattttcgggaagacccaagttggagtgggcgtccagaaagagggggtgtttcatacaatgtggcacgtgacccggggagccgttctcacacacaatggcaagcgcctggagcctaactgggccagcgtcaaaaaggatcttatcagctatggcgggggatggagactgtccgctcagtggcaaaaaggcgaagaggtccaggtgattgccgtcgaacccgggaagaatcctaagaacttccagacgatgcccggaatcttccagaccacaaccggcgagattggggcgatcgctctggactttaaacccggaaccagcggctcccctatcattaatcgggaaggcaaggtggttgggctctacggaaacggcgtggtcaccaagaatgggggatatgtgagcggcatcgcccaaacgaacgccgagccggatgggcccacccctgagctggaagaggaaatgttcaagaaacgcaatcttacaattatggacctgcatcccggctctggaaagaccagaaagtacctccctgctatcgttcgggaggccattaaacgcagactgcggacactcatcctggctcccaccagagtggtcgccgcggaaatggaggaggcccttaagggcctgcctatccgctatcagacgacagctaccaaaagcgaacacaccgggcgggagattgtggatctgatgtgccatgccacatttaccatgagactcctgtccccggttcgcgtgcccaactacaatcttgtcatcatggacgaagctcacttcacagatcctgcctctattgccgctcggggatatatcagcaccagagtgggcatgggggaggcggccgctatttttatgacggccacaccccctggaaccgccgaggctttcccccagtccaacgccccgatccaggacgaggagcgcgacatccctgaacggtcttggaatagcggcaacgagtggattacagattttgtggggaagaccgtctggttcgttccctccatcaaagcgggcaatgacattgctaactgtctgagaaagaacggaaagaaagtgatccaactctctcgcaagacgtttgataccgaataccagaaaacacggctgaatgactgggatttcgtggtcaccacagacattagcgagatgggcgccaactttaaggccgatagagtgatcgacccccggcgctgcctgaaacctgttattctcaccgatgggcccgagagagtgatccttgctggacctatgccggtcacagccgcgtccgccgctcagcggcgcggcagagtggggcggaatccccagaaggaaaacgaccaatacatcttcaccggacagcctctgaataacgatgaggaccatgcccactggacggaagctaagatgctgctcgacaatattaacacacccgagggcatcattcctgccctgttcgaacccgagagagagaaaagcgctgccatcgatggggaatatcgccttaagggcgagtctcggaaaacctttgttgaactgatgagacgcggagacctcccggtgtggctggcgcacaaggtcgcctccgagggcattaaatacaccgatcggaagtggtgcttcgacggggaaagaaataaccagatcctggaggagaatatggatgtggaaatctggacaaaagagggagaacgcaagaagctccggcctagatggcttgacgctcgcacctatagcgatcccctggccctgaaagagtttaaggacttcgctgccggcagaaaatctattgccctcgatctggtcacagaaatcgggcgggtgccttcccatcttgctcaccgcacgagaaacgcgctggacaatctcgttatgctgcataccagcgagcacggaggccgggcctaccgccacgctgtggaggaactgcccgagacaatggaaaccctccttctgctgggcctcatgattctgcttacagggggagccatgctgtttctcatctccggcaaggggattggaaaaacctctatcggcctgatctgtgtgattgtcagctccgggatgctgtggatggccgatgttcctctccagtggatcgctagcgccattgtgcttgagttctttatgatggtgctgctgatccccgagccggaaaagcaaagaacgcctcaggacaaccagctcgcgtatgtcgtgattggaatcctgacccttgccgctattgttgccgctaatgagatgggcctgctcgaaacaaccaagcgggatctgggcatgtctaaagagcccggggtggtctcccccacaagctacctggacgtggacctccatcctgcctctgcgtggaccctttatgccgtcgctacgacagtgatcaccccgatgctgagacacacaatcgaaaacagcaccgccaatgtttccctggctgccattgctaaccaagccgtggtcctcatgggactggataagggctggcccatctctaaaatggaccttggggtgcctctgctcgcgctgggatgctacagccaggttaaccccctgaccctcacagccgctgtgcttctgctggtcacgcattacgccattatcggccctgggctccaggctaaggccacccgcgaggcccagaaacggacagcggctggaattatgaagaatcccaccgtggatggcatcatgacaatcgacctggatcctgtgatttatgactccaagttcgagaaacaacttggccaggttatgctgctcgtcctgtgtgccgtgcagctgctccttatgagaacctcttgggctctgtgcgaagccctgacgctcgccacagggccgatcaccaccctgtgggagggaagccccggcaagttttggaacacaaccattgctgtgtccatggccaatatcttccgcgggagctaccttgcgggagccggcctggctttttctattatgaaatccgtcgggacaggacggagaggcacgggcagccagggggaaaccctcggagagaagtggaaaaagaagctgaaccaactgtcccggaaagagttcgatctctataagaaatctggcatcacagaggttgaccgcaccgaggccaaggaagggcttaaaagaggagagacaacccaccatgctgtgagccggggctccgccaagctgcagtggtttgtggaacgcaatatggtcatccctgaggggagagtgattgatctgggatgtggccggggcgggtggtcttactattgcgcgggactcaaaaaggttacggaagtgcgcggctacaccaaagggggacccggccacgaggagcctgtccccatgagcacatatgggtggaacatcgtgaaactgatgtccggaaaggacgttttctaccttccgcctgaaaaatgtgataccctgctctgcgacattggcgagagctctccctcccccacagtggaagagagcagaaccatccgggtcctgaagatggtggagccttggctgcgcaataaccagttctgtattaaagtgctcaatccctacatgcctacagtcatcgaacaccttgagagactgcagcggaagtatggcgggatgctggttagaaacccgctctctcgcaattccacccatgaaatgtactggattagcaacggaacgggcaatatcgtgtctagcgtgaacatggtctcccggctgcttctgaatagatttacaatgacccaccgccggcccaccatcgagaaggatgtggacctcggggccggaacaagacatgttaacgctgaacctgagacgcccaacatggacgtgattggcgagcgcatcaaacggattaaggaagaacactctagcacctggcactatgatgacgaaaatccttacaaaacatgggcctatcatgggtcctacgaggtcaaggctaccggaagcgcctcctctatgatcaacggcgtggttaaactgctgacaaagccctgggatgtggtcccgatggtgacccaaatggctatgacagacaccacgcctttcggccagcagagagtttttaaggaaaaagtggatacccgcacaccccggcctatgcccgggaccagaaaggtcatggagattacagccgagtggctctggcgcaccctgggacggaataaaaagcctagactttgcacgcgcgaagagttcaccaagaaggtgagaaccaacgcggccatgggcgctgtctttacagaagagaatcaatgggacagcgcccgggctgccgtggaagatgaggagttctggaagctggttgaccgcgaaagagagctccacaaactggggaagtgtggatcctgcgtgtataacatgatgggcaaacgggaaaagaaacttggggagtttggcaaggccaaaggatctagagcgatctggtacatgtggctgggcgctcggtacctcgagttcgaagccctggggtttctgaatgaggatcattggttcagccgcgaaaactcctattctggagtcgagggcgaagggctccacaagctgggatacatccttagagacattagcaagatccccggcggggccatgtatgctgatgacaccgccggctgggacacgcggattaccgaggatgacctgcataatgaggagaaaatcacacagcagatggatccggagcaccgccagctcgctaacgccatttttaagctgacctaccaaaataaagtggtgaaggttcagagacctacacccaaaggaaccgtgatggacatcatctcccggaaggatcagcgcggcagcgggcaggtcggaacatatggccttaacaccttcacgaatatggaagcgcaactggtgagacagatggagggggaaggagttctctctaaggccgacctggagaacccccatctgctcgagaaaaagattacacagtggctggaaaccaaaggcgtggagcggcttaagcgcatggctatctccggggatgactgcgtcgtgaaacctattgatgacagatttgccaatgctctgctcgccctgaacgatatgggcaaggtccggaaggacatcccgcagtggcaacccagcaaaggatggcatgattggcaacaggtgcctttctgttctcaccatttccacgaacttattatgaaggacggccgcaaactggttgtgccctgcagacctcaggacgagctcatcgggcgggcgcgcatctcccaaggagccggctggagcctgaaggaaaccgcttgtctggggaaagcctacgctcagatgtggtctctcatgtattttcacagacgggatctgagacttgcctccaacgctatttgcagcgccgtccccgtgcattggatccctacatcccgcaccacatggagcattcacgcgcatcaccagtggatgacgaccgaggacatgctgacagtttggaatcgggtgtggatcgaggataacccctggatggaagacaagaccccggtcacaacctgggaggatgtgccttacctcggaaagagagaagaccaatggtgtggctctctgattgggcttacgagccgcgccacctgggctcagaatatcctgacagccattcaacaggtgcggtccctcatcggcgatgaggagttcctggactacatgccctctatgaaaagatttcgcaaggaagaggaaagcgagggagccatctggtga

SEQ ID NO: 20507 - RNA, 9873 nt, synthetic construct
  misc_feature 1..9873: note = derived and/or modified CDS sequence (opt5) from DENV-3__FJ639727__SS-prME
  source 1..9873: mol_type = other RNA
accagcctgtgcctcatgatgatgctgcccgccacccttgctttccacctgacgtcccgggacggagaacctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaagtctcacaacggaagacttatcaccgccaaccccgtcgtgaccaagaaggaggagcccgtgaatattgaagcggagcctccgttcggcgaaagcaacatcgttattgggatcggcgacaaagctctcaagattaattggtataagaaaggatccagcatcggcaagatgtttgaggccaccgccagaggggctagacgcatggccatcctgggagatacggcttgggacttcggctctgtcgggggagtgctgaactccctcggcaaaatggtgcatcagatttttgggagcgcctacacagcgctgttctctggcgtcagctggatcatgaagattggaatcggcgtgcttctgacctggattgggctcaattccaaaaacacctctatgagcttttcctgcatcgttattggaatcatcacactgtatctgggcgccgtggtccaggctgatatggggtgtgtgattaattggaagggaaaggaacttaaatgcggcagcgggatcttcgttaccaacgaggtgcacacatggacggagcagtacaagtttcaagccgactctcccaaacggctcgctaccgccattgcgggcgcctgggaaaatggagtctgtggcatcagatccacaacccgcatggagaacctgctgtggaagcagattgctaatgaactcaactatatcctgtgggagaataacatcaaacttacagtggttgtgggggatattatcggagtcctggaacagggcaagcggaccctcacgcctcagcccatggagctgaaatacagctggaagacctgggggaaggccaaaattgtgacagctgagacccaaaattcttccttcatcattgacggacctaacacacccgaatgcccgagcgcctccagagcctggaacgtgtgggaggtcgaagactatggctttggcgttttcaccacaaatatctggctgaaacttcgcgaggtgtacacccagtcttgtgatcatcggctcatgagcgctgcgatcaaagacgaaagagccgtgcacgctgatatggggtactggattgagtcccagaagaacggatcttggaaactggagaaggccagctttatcgaagtcaagacgtgcacatggcctaaatcccacaccctgtggagcaatggcgtgctcgagtctgacatgattatccccaagtccctggccgggcctattagccagcataaccaccgccccggatattacacccaaacagctggcccttggcatcttgggaaactggaactcgatttcaattattgcgagggaaccacggttgtgatcacagagaactgtggcacccggggcccctctctgagaacaaccacagtctccgggaagctgatccacgaatggtgctgtcgcagctgcacccttccgcctctccggtacatgggagaggacggctgttggtatgggatggaaattagacccatcaatgagaaagaagagaacatggtgaagtctctggttagcgccggatccggcaaggtggataattttacgatgggggtcctgtgcctcgcgattctgttcgaggaagtgatgcggggaaaattcggcaagaaacacatgatcgctggcgccctttttaccttcgttctgctcctgagcgggcagattacatggcgcgacatggcccataccctgatcatgattggatctaacgcttccgatagaatgggcatgggggtgacataccttgccctgatcgcgacctttaagatccagcccttcctcgctctgggatttttcctccggaaactgacgagcagagagaatcttctgctcggcgtcgggctggccatggccacaaccctgcaacttcctgaagacattgagcagatggctaacggaatcgccctgggcctcatgacactgaagctcattacccagtttgaaacctatcagctgtggacagctcttgtgtccctgacgtgttctaataccatcttcacactcaccgtggcctggcgcacagcgaccctgattctggccggcgtcagccttctgccgctctgccaatcctctagcatgcggaagacggattggctgcccatgacagttgctgccatgggggtgcctcccctccctctgtttatcttctcccttaaagacacccccaagagacgctcttggcctctgaacgagggagtgatggctgtcggcctggtgagcatcctcgcctccagcctgcttagaaatgatgttcccatggccgggccgctggtggctggaggcctcctgattgcgtgttacgtcatcaccgggacatctgccgacctcaccgtggagaaagctgccgacgttacatgggaagaggaagccgagcagacgggagtgtcccacaacctgatgattaccgtcgatgacgatggcacaatgcggatcaaggacgatgaaaccgagaacattcttacagtgctgctgaaaaccgctctcctgatcgtcagcggcatctttccttactctattcccgccacgcttctggtgtggcatacctggcagaagcagacacaacgctccggggttctctgggacgtgccttctcccccggagacccagaaagcggaactggaggaaggagtctatagaatcaagcagcagggcattttcgggaagacacaagtgggagttggcgtgcagaaagagggggtctttcacaccatgtggcatgtgacacggggagctgtgctcacgcacaatggcaagcgcctggagcctaactgggcctccgttaaaaaggatcttatctcctacggcgggggatggagactgagcgcccagtggcaaaaaggcgaagaggtccaggtgattgctgtggaacccgggaagaatcctaagaacttccagaccatgcccggaatcttccagacaaccaccggcgagattggggccatcgcgctggactttaaacccggaacatccggcagccctatcattaatcgggaaggcaaggtcgtggggctctatggaaacggcgttgtgacgaaaaatgggggatacgtctctggcatcgctcaaaccaacgccgagccggatgggcccacacctgagctggaagaggaaatgttcaagaaacgcaatcttaccattatggacctgcaccccggcagcggaaagacaagaaagtatctccctgccatcgtgcgggaggctattaaacgcagactgcggaccctcatcctggcccccacgagagttgtggctgccgaaatggaggaggcgcttaagggcctgcctatccgctaccagacaaccgccaccaaatccgaacatacagggcgggagattgtcgatctgatgtgccacgctacctttacaatgagactcctgtctccggtgcgcgttcccaactataatcttgtggtcatggacgaagcccatttcaccgatcctgctagcatcgccgcccggggatacatttccacgagagtgggcatgggggaggctgcggccatctttatgacagctacaccccctggaacagccgaagccttcccccagtctaacgctccgattcaggacgaggagcgcgacatccctgaacggagctggaatagcggcaacgagtggatcaccgattttgtggggaagacggtctggttcgttccctctattaaagccggcaatgacatcgcgaactgtctgagaaagaacggaaagaaagtgattcaactcagccgcaagacctttgatacagaataccagaaaacccggctgaatgactgggatttcgtggtcacaaccgacatctccgagatgggcgctaactttagagccgatcgggtgattgacccccgcagatgcctgaagcctgttatcctcacagatgggcccgagcgggtgattcttgccggacctatgccggtcaccgctgccagcgcggcccagcgcagaggccgggtggggagaaatccccagaaagaaaacgaccaatatatcttcacgggacagcctctgaataacgatgaggaccacgctcattggacagaagccaagatgctgctcgacaatatcaacacccccgagggcattatccctgctctgttcgaacccgagcgcgagaagtctgccgctattgatggggaataccggcttaaaggcgagtccagaaagacctttgttgaactgatgcgccggggagacctcccggtgtggctggcccacaaagtcgcgagcgagggcatcaagtatacagatagaaaatggtgcttcgacggggaacgcaataaccagattctggaggagaatatggatgtggaaatctggaccaaggagggagaacggaaaaagctcagacctcgctggcttgacgccagaacatactctgatcccctggctctgaaggagtttaaagacttcgccgctggccggaagtccatcgccctcgatctggtcacggaaattgggcgcgtgcctagccaccttgcccatagaacccggaacgctctggacaatctcgttatgctgcacacatccgagcatggaggccgcgcgtatagacacgccgtggaggaactgcccgagaccatggaaacactccttctgctgggcctcatgatcctgcttaccgggggagctatgctgtttctcatttctggcaaagggatcggaaagacgagcattggcctgatctgtgtgatcgtctccagcgggatgctgtggatggccgatgttcctctccagtggattgcctctgctatcgtgcttgagttctttatgatggtgctgctgattcccgagccggaaaaacaacggacccctcaggacaaccagctcgcctacgtcgtgatcggcattctgacacttgcggccatcgttgctgccaatgagatgggcctgctcgaaaccacaaagagagatctgggcatgtccaaggagcccggggtggtcagccccacctcttatctggacgtggacctccaccctgctagcgcctggacgctttacgcggtcgccacaaccgtgattacaccgatgctgcgccataccatcgaaaactccaccgctaatgtttctctggccgctatcgccaaccaagctgtggtcctcatgggactggataaaggctggcccattagcaagatggaccttggggtgcctctgctcgccctgggatgctactcccaggttaaccccctgacactcacggcggccgtgcttctgctggtcacccactatgctatcattggccctgggctccaggccaaagctacacgggaggcccagaagagaaccgccgcgggaatcatgaaaaatcccacagtggatggcattatgaccatcgacctggatcctgtgatctacgactctaagttcgagaagcaacttggccaggttatgctgctcgtcctgtgtgctgtgcagctgctccttatgcgcacgagctgggccctgtgcgaagctctgacactcgccaccgggccgattaccacactgtgggagggatcccccggcaaattttggaacaccacaatcgccgtgagcatggctaatattttccgggggtcttatcttgccggagcgggcctggccttttccatcatgaaaagcgtcgggacgggaagacggggcaccggctcccagggggaaacactcggagagaaatggaagaaaaagctgaaccaactgtctcgcaaggagttcgatctctacaaaaagagcggcattaccgaggttgacagaacagaggctaaagaagggcttaagcggggagagaccacgcatcacgccgtgtcccgcggctctgctaaactgcagtggtttgtggaaagaaatatggtcatccctgaggggcgggtgatcgatctgggatgtggccgcggcgggtggagctattactgcgccggactcaagaaagttaccgaagtgagaggctatacaaaagggggacccggccatgaggagcctgtccccatgtccacctacgggtggaacattgtgaagctgatgagcggaaaagacgttttctaccttccgcctgaaaagtgtgatacactgctctgcgacatcggcgagtcttcccccagccccaccgtggaagagtctcggacaattcgcgtcctgaaaatggtggagccttggctgagaaataaccagttctgtatcaaggtgctcaatccctatatgcctaccgtcattgaacaccttgagcggctgcagagaaaatacggcgggatgctggttcgcaacccgctctcccggaatagcacgcacgaaatgtattggatctctaacggaacaggcaatattgtgagctccgtgaacatggtctctagactgcttctgaatcgctttaccatgacccatcggagacccacaatcgagaaggatgtggacctcggggcgggaacgcgccacgttaacgccgaacctgagacccccaacatggacgtgatcggcgagcggattaagagaatcaaagaagaacacagctccacatggcactacgatgacgaaaatccttataagacctgggcttaccacgggagctatgaggtcaaagccacaggatccgcttctagcatgattaacggcgtggttaagctgctgaccaaaccctgggatgtggtcccgatggtgacacaaatggccatgaccgacacgacccctttcggccagcagcgcgtttttaaggaaaaggtggatacacggacccccagacctatgcccgggacacgcaaagtcatggagatcaccgctgagtggctctggcggacgctgggaagaaataagaaacctcgcctttgcacaagagaagagttcaccaagaaagtgcggacaaacgccgcgatgggcgccgtctttaccgaagagaatcaatgggactccgctcgcgccgctgtggaagatgaggagttctggaagctggttgacagagaacgggagctccataagctggggaaatgtggatcttgcgtgtacaacatgatgggcaagagagagaagaaacttggggagtttggcaaagccaagggaagccgggccatttggtacatgtggctgggcgcgcgctatctcgagttcgaagctctggggtttctgaatgaggatcactggttctccagagaaaactcttacagcggagtcgagggcgaagggctccataaactgggatatatccttcgggacatctccaagattcccggcggggccatgtacgccgatgacacggctggctgggacacccgcatcacagaggatgacctgcacaatgaggaaaagattacccagcagatggatccggagcatagacagctcgccaacgctatctttaaactgacatatcaaaataaggtggtgaaagttcagcggcctacccccaagggaacagtgatggacattatcagccgcaaagatcagagaggctctgggcaggtcggaacctacggccttaacacgttcacaaatatggaagcccaactggtgcggcagatggagggggaaggagttctctccaaggcggacctggagaacccccatctgctcgagaagaaaatcacccagtggctggaaaccaagggcgtggagcgccttaaaagaatggccattagcggggatgactgcgtcgtgaagcctatcgatgaccggtttgctaatgccctgctcgctctgaacgatatgggcaaagtccgcaaggacattccgcagtggcaaccctctaagggatggcacgattggcaacaggtgcctttctgttcccatcacttccatgaacttatcatgaaagacggcagaaagctggttgtgccctgccggcctcaggacgagctcattgggcgcgccagaatcagccaaggagcgggctggtctctgaaagaaacagcctgtctggggaaggcttatgcccagatgtggtccctcatgtactttcaccggagagatctgcgccttgctagcaacgccatctgctccgctgtccccgtgcactggattcctaccagccggacaacgtggtctatccatgcccaccatcagtggatgaccacagaggacatgctgaccgtttggaatagagtgtggattgaggataacccctggatggaagacaaaacaccggtcaccacgtgggaggatgtgccttacctcggaaagcgcgaagaccaatggtgtggcagcctgatcgggcttacctcccgggcgacatgggcccagaatattctgaccgctatccaacaggtgagatctctcattggcgatgaggagttcctggactatatgcccagcatgaagcgctttcggaaagaagaggaatccgagggagccatctggtga

SEQ ID NO: 20508 - RNA, 9873 nt, synthetic construct
  misc_feature 1..9873: note = derived and/or modified CDS sequence (opt5) from DENV-3__GQ868629__SS-prME
  source 1..9873: mol_type = other RNA
acatccctgtgcctcatgatgatgctgcccgccacacttgctttccacctgacgtcccgggacggagaacctcggatgatcgtggggaagaacgaacgcggaaaatctctcctgtttaagacagccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccatcaccgagacacctacctggaaccggaaagaactgctcgtgacgtttaagaatgcccatgctaaaaagcaagaggttgtggtcctggggtcccaggaaggagcgatgcacacagccctgaccggcgctacagagattcagaacagcgggggcacctctatcttcgccggacacctcaagtgtcgcctgaaaatggataaacttgaactgaaaggcatgtcctacgccatgtgcctcaatacctttgtgctgaagaaagaggttagcgagacacagcatgggacgattctgatcaaggtggaatacaagggagaggacgctccctgtaaaatccctttctccaccgaagatggccaagggaaggcccacaacggaagacttattacagcgaaccccgtcgtgaccaaaaaggaggagcccgtgaatatcgaagctgagcctccgttcggcgaatctaacattgttatcgggattggcgacaaagccctcaagatcaattggtataagaaaggaagctccatcggcaagatgtttgaggccacagctagaggggccagacgcatggctattctgggagataccgcctgggacttcggcagcgtcgggggagtgctgaactctctcggcaaaatggtgcatcagatctttgggtccgcgtacacggccctgttcagcggcgtctcttggattatgaagatcggaattggcgtgcttctgacatggatcgggctcaatagcaaaaacacctccatgtcttttagctgcattgttatcggaatcattaccctgtatctgggcgctgtggtccaggccgatatggggtgtgtgatcaattggaagggaaaggaacttaaatgcggctccgggattttcgttacaaacgaggtgcacacctggacagagcagtacaagtttcaagctgacagccccaaacggctcgccacggcgatcgccggcgcttgggaaaatggagtctgtggcattagatctaccacacgcatggagaacctgctgtggaagcagatcgccaatgaactcaactatatcctgtgggagaataacattaaacttaccgtggttgtgggggatatcattggagtcctggaacagggcaagcggacactcacccctcagcccatggagctgaaatactcctggaagacgtgggggaaggctaaaatcgtgaccgccgagacacaaaatagctctttcattatcgacggacctaacacccccgaatgcccgtccgccagcagagcttggaacgtgtgggaggtcgaagactatggctttggcgttttcacaaccaatatctggctgaaacttcgcgaggtgtacacacagtcctgtgatcatcggctcatgtctgcggccattaaagacgaaagagctgtgcacgccgatatggggtactggatcgagagccagaagaacggatcctggaaactggagaaggcctcttttattgaagtcaagacctgcacgtggcctaaaagccacacactgtggtccaatggcgtgctcgagagcgacatgatcattcccaagtctctggctgggcctatctcccagcataaccaccgccccggatatcatacccaaaccgccggcccttggcaccttgggaaactggaactcgatttcaattactgcgagggaacaaccgttgtgatcacggagaactgtggcacacggggccccagcctgagaaccacaaccgtctctgggaagctgattcacgaatggtgctgtcgctcctgcacacttccgcctctccggtatatgggagaggacggctgttggtacgggatggaaatcagacccattaatgagaaagaagagaacatggtgaaaagcctggtttctgcgggaagcggcaaggtggataattttaccatgggggtcctgtgcctcgctatcctgttcgaggaagtgatgcggggaaaattcggcaagaaacatatgattgccggcgttctttttacgttcgtgctgctcctgtccgggcagatcacctggcgcgacatggcccacacactgattatgatcggaagcaacgcttctgatagaatgggcatgggggtcacctatcttgccctgatcgcgacatttaagattcagcccttcctcgctctgggatttttcctccggaaactgacctccagagagaatcttctgctcggcgtggggctggccatggccacgacactgcaacttcctgaagacatcgagcagatggctaacggaattgccctgggcctcatgaccctgaagctcatcacacagtttgaaacctaccagctgtggaccgctcttgtgagcctgacatgttccaatacgattttcaccctcacagtcgcctggcgcaccgcgacactgatcctggccggcgtttctcttctgccgctctgccaaagctcctctatgcggaagaccgattggctgcccatgacggtggctgccatgggggtgcctcccctccctctgtttatcttcagccttaaagacacacccaagagacgctcctggcctctgaacgagggagtcatggctgtgggcctggtttctattctcgccagctccctgcttagaaatgatgtgcccatggccgggccgctggtcgctggaggcctcctgatcgcgtgttatgtgattaccgggaccagcgccgacctcacagttgagaaagctgccgacgtgacctgggaagaggaagccgagcagacaggagtctctcataacctgatgatcacggtggatgacgatggcaccatgcggattaaggacgatgaaacagagaacatccttaccgtcctgctgaaaacagctctcctgatcgtgtccggcatttttccttacagcatccccgccacccttctggtttggcacacgtggcagaagcagacccaacgctctggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaatggcaagcgcctggagcctaactgggccagcgtcaaaaaggatcttattagctatggcgggggatggagactgtccgcccagtggcaaaaaggcgaagaggtccaggtgatcgctgtcgaacccgggaagaatcctaagaacttccagacgatgcccggaattttccagaccacaaccggcgagatcggggccatcgcgctggactttaaacccggaaccagcggctcccctattatcaatcgggaaggcaaggtggttgggctctacggaaacggcgtggtcaccaagaatgggggatatgtgagcggcattgctcaaacgaacgccgagccggatgggcccacccctgagctggaagaggaaatgttcaagaaacgcaatcttacaatcatggacctgcatcccggctctggaaagaccagaaagtacctccctgccattgttcgggaggctatcaaacgcagactgcggacactcatcctggcccccaccagagtggtcgctgccgaaatggaggaggcgcttaagggcctgcctattcgctatcagacgacagccaccaaaagcgaacacaccgggcgggagatcgtggatctgatgtgccatgctacatttaccatgagactcctgtccccggttcgcgtgcccaactacaatcttgtcattatggacgaagcccacttcacagatcctgcttctatcgccgcccggggatatattagcaccagagtgggcatgggggaggctgcggccatctttatgacggctacaccccctggaaccgccgaagccttcccccagtccaacgctccgatccaggacgaggagcgcgacattcctgaacggtcttggaatagcggcaacgagtggatcacagattttgtggggaagaccgtctggttcgttccctccattaaagccggcaatgacatcgcgaactgtctgagaaagaacggaaagaaagtgattcaactctctcgcaagacgtttgataccgaataccagaaaacacggctgaatgactgggatttcgtggtcaccacagacatcagcgagatgggcgctaactttaaggccgatagagtgattgacccccggcgctgcctgaaacctgttatcctcaccgatgggcccgagagagtgatccttgccggacctatgccggtcacagctgcctccgcggcccagcggcgcggcagagtggggcggaatccccagaaggaaaacgaccaatacattttcaccggacagcctctgaataacgatgaggaccatgctcactggacggaagccaagatgctgctcgacaatatcaacacacccgagggcattatccctgctctgttcgaacccgagagagagaaaagcgccgctattgatggggaatatcgccttaagggcgagtctcggaaaacctttgttgaactgatgagacgcggagacctcccggtgtggctggcccacaaggtcgcgtccgagggcatcaaatacaccgatcggaagtggtgcttcgacggggaaagaaataaccagatcctggaggagaatatggatgtggaaatttggacaaaagagggagaacgcaagaagctccggcctagatggcttgacgcccgcacctatagcgatcccctggctctgaaagagtttaaggacttcgccgctggcagaaaatctatcgccctcgatctggtcacagaaattgggcgggtgccttcccatcttgcccaccgcacgagaaacgctctggacaatctcgttatgctgcataccagcgagcacggaggccgggcgtaccgccacgccgtggaggaactgcccgagacaatggaaaccctccttctgctgggcctcatgatcctgcttacagggggagctatgctgtttctcatttccggcaaggggatcggaaaaacctctatcggcctgatttgtgtgatcgtcagctccgggatgctgtggatggccgatgttcctctccagtggattgccagcgctatcgtgcttgagttctttatgatggtgctgctgattcccgagccggaaaagcaaagaacgcctcaggacaaccagctcgcctatgtcgtgatcggcattctgacccttgcggccatcgttgctgccaatgagatgggcctgctcgaaacaaccaagcgggatctgggcatgtctaaagagcccggggtggtctcccccacaagctacctggacgtggacctccatcctgcttctgcctggaccctttatgcggtcgccacgacagtgatcaccccgatgctgagacacacaattgaaaacagcaccgctaatgtttccctggccgctatcgccaaccaagctgtggtcctcatgggactggataagggctggcccatttctaaaatggaccttggggtgcctctgctcgccctgggatgctacagccaggttaaccccctgaccctcacagcggccgtgcttctgctggtcacgcattacgctatcattggccctgggctccaggccaaggctacccgcgaggcccagaaacggacagccgcgggaatcatgaagaatcccaccgtggatggcatcatgacaattgacctggatcctgtgatctatgactccaagttcgagaaacaacttggccaggttatgctgctcgtcctgtgtgctgtgcagctgctccttatgagaacctcttgggccctgtgcgaagctctgacgctcgccacagggccgattaccaccctgtgggagggaagccccggcaagttttggaacacaaccatcgccgtgtccatggctaatattttccgcgggagctaccttgccggagcgggcctggccttttctatcatgaaatccgtcgggacaggacggagaggcacgggcagccagggggaaaccctcggagagaagtggaaaaagaagctgaaccaactgtcccggaaagagttcgatctctataagaaatctggcatcacagaggttgaccgcaccgaggctaaggaagggcttaaaagaggagagacaacccaccatgccgtgagccggggctccgctaagctgcagtggtttgtggaacgcaatatggtcattcctgaggggagagtgatcgatctgggatgtggccggggcgggtggtcttactattgcgccggactcaaaaaggttacggaagtgcgcggctacaccaaagggggacccggccacgaggagcctgtccccatgagcacatatgggtggaacattgtgaaactgatgtccggaaaggacgttttctaccttccgcctgaaaaatgtgataccctgctctgcgacatcggcgagagctctccctcccccacagtggaagagagcagaaccattcgggtcctgaagatggtggagccttggctgcgcaataaccagttctgtatcaaagtgctcaatccctacatgcctacagtcattgaacaccttgagagactgcagcggaagtatggcgggatgctggttagaaacccgctctctcgcaattccacccatgaaatgtactggatcagcaacggaacgggcaatatcgtgtctagcgtgaacatggtctcccggctgcttctgaatagatttacaatgacccaccgccggcccaccattgagaaggatgtggacctcggggcgggaacaagacatgttaacgccgaacctgagacgcccaacatggacgtgatcggcgagcgcattaaacggatcaaggaagaacactctagcacctggcactatgatgacgaaaatccttacaaaacatgggcttatcatgggtcctacgaggtcaaggccaccggaagcgcttcctctatgattaacggcgtggttaaactgctgacaaagccctgggatgtggtcccgatggtgacccaaatggccatgacagacaccacgcctttcggccagcagagagtttttaaggaaaaagtggatacccgcacaccccggcctatgcccgggaccagaaaggtcatggagatcacagctgagtggctctggcgcaccctgggacggaataaaaagcctagactttgcacgcgcgaagagttcaccaagaaggtgagaaccaacgccgcgatgggcgccgtctttacagaagagaatcaatgggacagcgctcgggccgctgtggaagatgaggagttctggaagctggttgaccgcgaaagagagctccacaaactggggaagtgtggatcctgcgtgtataacatgatgggcaaacgggaaaagaaacttggggagtttggcaaggccaaaggatctagagccatctggtacatgtggctgggcgcgcggtacctcgagttcgaagctctggggtttctgaatgaggatcattggttcagccgcgaaaactcctattctggagtcgagggcgaagggctccacaagctgggatacattcttagagacatcagcaagattcccggcggggccatgtatgccgatgacaccgctggctgggacacgcggatcaccgaggatgacctgcataatgaggagaagattacacagcagatggatccggagcaccgccagctcgccaacgctatctttaagctgacctaccaaaataaagtggtgaaggttcagagacctacacccaaaggaaccgtgatggacatcatttcccggaaggatcagcgcggcagcgggcaggtcggaacatatggccttaacaccttcacgaatatggaagcccaactggtgagacagatggagggggaaggagttctctctaaggcggacctggagaacccccatctgctcgagaaaaagatcacacagtggctggaaaccaaaggcgtggagcggcttaagcgcatggccatttccggggatgactgcgtcgtgaaacctatcgatgacagatttgctaatgccctgctcgctctgaacgatatgggcaaggtccggaaggacattccgcagtggcaacccagcaaaggatggcatgattggcaacaggtgcctttctgttctcaccatttccacgaacttatcatgaaggacggccgcaaactggttgtgccctgcagacctcaggacgagctcatcgggcgggcccgcatttcccaaggagcgggctggagcctgaaggaaaccgcctgtctggggaaggcttacgcccagatgtggtctctcatgtattttcacagacgggatctgagacttgcttccaacgccatctgcagcgctgtccccgtgcattggattcctacatcccgcaccacatggagcatccacgcccatcaccagtggatgacgaccgaggacatgctgacagtttggaatcgggtgtggattgaggataacccctggatggaagacaagaccccggtcacaacctgggaggatgtgccttacctcggaaagagagaagaccaatggtgtggctctctgatcgggcttacgagccgcgcgacctgggcccagaatattctgacagctatccaacaggtgcggtccctcatcggcgatgaggagttcctggactacatgccctctatgaaaagatttcgcaaggaagaggaaagcgagggagccatttggtga

SEQ ID NO: 20509 - RNA, 9873 nt, synthetic construct
  misc_feature 1..9873: note = derived and/or modified CDS sequence (opt5) from DENV-3__FJ639728__SS-prME
  source 1..9873: mol_type = other RNA
accagcctgtgcctcatgatgatgctgcccgccacccttgctttccacctgacgtcccgggacggcgagcctcggatgatcgtggggaagaatgaacgcggaaagtctctcctgtttaagaccgccagcggcatcaatatgtgtacccttatcgcgatggatctgggggagatgtgcgacgataccgtgacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaagcccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggctccgggatcttcgttaccaacgaggtgcacacatggacggagcagtacaagtttcaagctgacagccccaaacggctcgccaccgcgattgccggcgcttgggaaaatggagtctgtggcatcagatctacaacccgcatggagaacctgctgtggaagcagattgccaatgaactcaactatatcctgtgggagaataacatcaaacttacagtggttgtgggggatattatcggagtcctggaacagggcaagcggaccctcacgcctcagcccatggagctgaaatactcctggaagacctgggggaaggctaaaattgtgacagccgagacccaaaatagctctttcatcattgacggacctaacacacccgaatgcccgtccgccctgagagcttggaacgtgtgggaggtcgaagactatggctttggcgttttcaccacaaatatctggcttaagctccgcgaggtgtacacccagagctgtgatcatcggctgatgtccgcggccatcaaagacgaaagagctgtgcacgccgatatggggtactggattgagtctcagaagaacggaagctggaaactggagaaggcctcctttatcgaagtcaagacgtgcacatggcctaaatctcacaccctctggagcaatggcgtgctggagtccgacatgattatccccaagagccttgctgggcctatttctcagcataaccaccgccccggatatcatacccaaacagccggcccttggcacctggggaaactcgaactggatttcaattactgcgagggaaccacggttgtgatcacagagaactgtggcacccggggcccctccctgagaacaaccacagtcagcgggaaacttatccacgaatggtgctgtcgctcttgcaccctcccgcctctgcggtatatgggagaggacggctgttggtacgggatggaaattagacccatcaatgagaaagaagagaacatggtgaagtccctggttagcgcgggatctggcaaggtggataattttacgatgggggtcctctgcctggctattcttttcgaggaagtgatgcggggaaaattcggcaagaaacatatgatcgccggcgttctgtttaccttcgtgctcctgctgagcgggcagattacatggcgcgacatggcccacacccttatcatgattggatccaacgctagcgatagaatgggcatgggggtcacatatctggccctcatcgcgacctttaagatccagcccttcctggctctcggatttttcctgcggaaacttacgtctagagagaatctgctcctgggcgtggggctggccatggccacaacccttcaactgcctgaagacattgagcagatggctaacggaatcgccctcggcctgatgacactcaagctgattacccagtttgaaacctaccagctttggacagctctggtgtccctcacgtgtagcaataccatcttcacactgaccgtcgcctggcgcacagcgaccctgattcttgccggcgtttccctgctcccgctgtgccaatctagctccatgcggaagacggattggctccccatgacagtggctgccatgggggtgcctcccctgcctctttttatcttctctctgaaagacacccccaagagacgcagctggcctctgaacgagggagtcatggctgtgggcctcgtttccatcctggcctctagccttctgagaaatgatgtgcccatggccgggccgctcgtcgctggaggcctgctcattgcgtgttatgtgatcaccgggacatccgccgacctgaccgttgagaaagctgccgacgtgacatgggaagaggaagccgagcagacgggagtcagccataaccttatgattaccgtggatgacgatggcacaatgcggatcaaggacgatgaaaccgagaacattctgacagtcctgctcaaaaccgctctgcttatcgtgtctggcatctttccttactccattcccgccacgctgctcgtttggcacacctggcagaagcagacacaacgcagcggggtgctgtgggacgtcccttctcccccggagacccagaaagcggaactcgaggaaggagtgtacagaatcaagcagcagggcattttcgggaagacacaagttggagtgggcgtccagaaagagggggtgtttcataccatgtggcacgtgacacggggagctgttctgacgcacaatggcaagcgccttgagcctaactgggcctccgtcaaaaaggatctgatcagctatggcgggggatggagactgtctgcccagtggcaaaaaggcgaagaggtccaggtgattgctgtcgaacccgggaagaatcctaagaacttccagaccatgcccggaatcttccagacaaccaccggcgagattggggccatcgcgctcgactttaaacccggaacatccggcagccctatcattaatcgggaaggcaaggtggttgggctgtacggaaacggcgtggtcacgaaaaatgggggatatgtgtccggcatcgctcaaaccaacgccgagccggatgggcccacacctgagcttgaagaggaaatgttcaagaaacgcaatctgaccattatggacctccatcccggcagcggaaagacaagaaagtacctgcctgccatcgttcgggaggctattaaacgcagactccggaccctgatccttgcccccacgagagtggtcgctgccgaaatggaggaggcgctgaagggcctgcctatccgctatcagacaaccgccaccaaatctgaacacacagggcgggagattgtggatctcatgtgccatgctacctttacaatgagactgcttagcccggttcgcgtgcccaactacaatctggtcatcatggacgaagcccacttcaccgatcctgcttccattgccgcccggggatatatctctacgagagtgggcatgggggaggctgcggccatttttatgacagctacaccccctggaacagccgaagccttcccccagagcaacgctccgatccaggacgaggagcgcgacatccctgaacggtcctggaactctggcaacgagtggattaccgattttgtggggaagacggtctggttcgttcccagcatcaaagccggcaatgacattgcgaactgtctcagaaagaacggaaagaaagtgatccaactgtcccgcaagacctttgatacagaataccagaaaacccggctgaatgactgggatttcgtggtcacaaccgacatttctgagatgggcgctaactttaaggccgatagagtgatcgacccccggcgctgcctcaaacctgttattcttacagatgggcccgagagagtgatcctggccggacctatgccggtcaccgctgccagcgcggcccagcggcgcggcagagtggggcggaatccccagaaggaaaacgaccaatacatcttcacgggacagcctctgaataacgatgaggaccatgctcactggacagaagccaagatgctcctggacaatattaacacccccgagggcatcattcctgctcttttcgaacccgagagagagaaatccgccgctatcgatggggaatatcgcctgaagggcgagagccggaaaacctttgttgaactcatgagacgcggagacctgccggtgtggctggcccacaaggtcgcgtctgagggcattaaatacacagatcggaagtggtgcttcgacggggaaagaaataaccagatcctcgaggagaatatggatgtggaaatctggaccaaagagggagaacgcaagaaacttcggcctagatggctggacgcccgcacatattccgatcccctggctctcaaagagtttaaggacttcgccgctggcagaaaaagcattgccctggatcttgtcacggaaatcgggcgggtgccttctcatctggcccaccgcaccagaaacgctctcgacaatctggttatgctgcatacatccgagcacggaggccgggcgtaccgccacgccgtggaggaactccccgagaccatggaaacacttctgctgctcggcctgatgattcttctgaccgggggagctatgctctttctgatcagcggcaaggggattggaaaaacgtccatcggcctgatctgtgtgattgtctctagcgggatgctctggatggccgatgttcctcttcagtggatcgcctccgctattgtgctggagttctttatgatggtgctgctcatccccgagccggaaaagcaaagaacccctcaggacaaccagctggcctatgtcgtgattggaatccttacactggcggccattgttgctgccaatgagatgggcctcctggaaaccacaaagcgggatctgggcatgagcaaagagcccggggtggtctctcccacctcctacctcgacgtggaccttcatcctgctagcgcctggacgctgtatgcggtcgccacaaccgtgatcacaccgatgctgagacacaccatcgaaaactctaccgctaatgttagcctcgccgctattgccaaccaagctgtggtcctgatgggacttgataagggctggcccatctccaaaatggacctgggggtgcctctcctggccctgggatgctactctcaggttaaccccctcacacttacggcggccgtgctgctgctcgtcacccattacgctattatcggccctgggctgcaggccaaggctacacgcgaggcccagaaacggaccgccgcgggaattatgaagaatcccacagtggatggcatcatgaccatcgaccttgatcctgtgatttatgacagcaagttcgagaaacaactgggccaggttatgctcctggtcctgtgtgctgtgcagctccttctgatgagaacgtcctgggccctgtgcgaagctctcacactggccaccgggccgatcaccacactttgggagggatctcccggcaagttttggaacaccacaattgccgtgagcatggctaatatcttccgcgggtcctacctggccggagcgggcctcgcctttagcattatgaaatctgtcgggacgggacggagaggcaccggctcccagggggaaacactgggagagaagtggaaaaagaagctgaaccaactcagccggaaagagttcgatctttataagaaatccggcatcaccgaggttgaccgcacagaggctaaggaagggctgaaaagaggagagaccacgcaccatgccgtgtctcggggcagcgctaagctgcagtggtttgtggaacgcaatatggtcatccctgaggggagagtgattgatctcggatgtggccggggcgggtggtcctactattgcgccggactgaaaaaggttaccgaagtgcgcggctacacaaaagggggacccggccacgaggagcctgtccccatgtctacctatgggtggaacatcgtgaaacttatgagcggaaaggacgttttctacctgccgcctgaaaaatgtgatacactcctgtgcgacattggcgagtccagcccctctcccaccgtggaagagtccagaacaatccgggtcctgaagatggtggagccttggctccgcaataaccagttctgtattaaagtgcttaatccctacatgcctaccgtcatcgaacacctggagagactgcagcggaagtatggcgggatgctcgttagaaacccgctgagccgcaattctacgcatgaaatgtactggatttccaacggaacaggcaatatcgtgagctctgtgaacatggtcagccggcttctgctcaatagatttaccatgacccaccgccggcccacaatcgagaaggatgtggacctgggggcgggaacgagacatgttaacgccgaacctgagacccccaacatggacgtgattggcgagcgcatcaaacggattaaggaagaacactcctctacatggcactatgatgacgaaaatccttacaaaacctgggcttatcatgggagctacgaggtcaaggccacaggatccgctagctccatgatcaacggcgtggttaaactgctcaccaagccctgggatgtggtcccgatggtgacacaaatggccatgaccgacacgacccctttcggccagcagagagtttttaaggaaaaagtggatacacgcacaccccggcctatgcccgggacaagaaaggtcatggagattaccgctgagtggctgtggcgcacgcttggacggaataaaaagcctagactgtgcacacgcgaagagttcaccaaaaaggtgagaacaaacgccgcgatgggcgccgtctttaccgaagagaatcaatgggactctgctcgggccgctgtggaagatgaggagttctggaagctcgttgaccgcgaaagagagctgcacaaacttgggaagtgtggaagctgcgtgtataacatgatgggcaaacgggaaaagaaactgggggagtttggcaaggccaaaggatccagagccatctggtacatgtggctcggcgcgcggtacctggagttcgaagctctggggtttctcaatgaggatcattggttctctcgcgaaaacagctattccggagtcgagggcgaagggctgcacaaacttggatacatcctgagagacatttctaagatccccggcggggccatgtatgccgatgacacggctggctgggacacccggattacagaggatgacctccataatgaggagaaaattacccagcagatggatccggaacaccgccagctggccaacgctatttttaaacttacataccaaaataaagtggtgaaggttcagagacctacccccaaaggaacagtgatggacatcatcagccggaaggatcagcgcggctccgggcaggtcggaacctatggcctgaacacgttcacaaatatggaagcccaactcgtgagacagatggagggggaaggagttctgagcaaggcggacctggagaacccccacctcctggagaaaaagattacccagtggcttgaaaccaaaggcgtggagcggctgaagcgcatggccatctctggggatgactgcgtcgtgaaacctattgatgacagatttgctaatgccctcctggctcttaacgatatgggcaaggtccggaaggacatcccgcagtggcaaccctccaaaggatggcatgattggcaacaggtgcctttctgtagccaccatttccacgaactgattatgaaggacggccgcaaactcgttgtgccctgcagacctcaggacgagctgatcgggcgggcccgcatctctcaaggagcgggctggtccctgaaggaaacagcctgtctcgggaaggcttacgcccagatgtggagcctgatgtattttcacagacgggatcttagactggcttctaacgccatttgctccgctgtccccgtgcattggatccctaccagccgcacaacgtggtccattcacgcccatcaccagtggatgaccacagaggacatgctcaccgtttggaatcgggtgtggatcgaggataacccctggatggaagacaagacaccggtcaccacgtgggaggatgtgccttacctgggaaagagagaagaccaatggtgtggcagccttattgggctgacctctcgcgcgacatgggcccagaatatcctcaccgctattcaacaggtgcggagcctgatcggcgatgaggagttcctggactacatgccctccatgaaaagatttcgcaaggaagaggaatctgagggagccatctggtga

SEQ ID NO: 20510 - RNA, 9873 nt, synthetic construct
  misc_feature 1..9873: note = derived and/or modified CDS sequence (opt5) from DENV-3__FJ639729__SS-prME
  source 1..9873: mol_type = other RNA
acatccctgtgcctcatgatgatgctgcccgccacacttgctttccacctgacgtcccgggacggagaacctcggatgatcgtggggaagaacgaacgcggaaaatctctcctgtttaagacagccagcggcattaatatgtgtacacttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccatcaccgagacacctacctggaaccggaaagaactgctcgtgacgtttaagaatgcccatgctaaaaagcaagaggttgtggtcctggggtcccaggaaggagcgatgcacacagccctgaccggcgctacagagattcagaacagcgggggcacctctatcttcgccggacacctcaagtgtcgcctgaaaatggataaacttgaactgaaaggcatgtcctacgccatgtgcctcaatacctttgtgctgaagaaagaggttagcgagacacagcatgggacgattctgatcaaggtggaatacaagggagaggacgctccctgtaaaatccctttctccaccgaagatggccaagggaaggcccacaacggaagacttattacagcgaaccccgtcgtgaccaaaaaggaggagcccgtgaatatcgaagctgagcctccgttcggcgaatctaacattgttatcgggattggcgacaaagccctcaagatcaattggtataagaaaggaagctccatcggcaagatgtttgaggccacagctagaggggccagacgcatggctattctgggagataccgcctgggacttcggcagcgtcgggggagtgctgaactctctcggcaaaatggtgcatcagatctttgggtccgcgtacacggccctgttcagcggcgtctcttggattatgaagatcggaattggcgtgcttctgacatggatcgggctcaatagcaaaaacacctccatgtcttttagctgcattgttatcggaatcattaccctgtatctgggcgctgtggtccaggccgatatggggtgtgtgatcaattggaagggaaaggaacttaaatgcggctccgggattttcgttacaaacgaggtgcacacctggacagagcagtacaagtttcaagctgacagccccaaacggctcgccacggcgatcgccggcgcttgggaaaatggagtctgtggcattagatctaccacacgcatggagaacctgctgtggaagcagatcgccaatgaactcaactatatcctgtgggagaataacattaaacttaccgtggttgtgggggatatcattggagtcctggaacagggcaagcggacactcacccctcagcccatggagctgaaatactcctggaagacgtgggggaaggctaaaatcgtgaccgccgagacacaaaatagctctttcattatcgacggacctaacacccccgaatgcccgtccgccagcagagcttggaacgtgtgggaggtcgaagactatggctttggcgttttcacaaccaatatctggctgaaacttcgcgaggtgtacacacagtcctgtgatcatcggctcatgtctgcggccattaaagacgaaagagctgtgcacgccgatatggggtactggatcgagagccagaagaacggatcctggaaactggagaaggcctcttttattgaagtcaagacctgcacgtggcctaaaagccacacactgtggtccaatggcgtgctcgagagcgacatgatcattcccaagtctctggctgggcctatctcccagcataaccaccgccccggatatcatacccaaaccgccggcccttggcaccttgggaaactggaactcgatttcaattactgcgagggaacaaccgttgtgatcacggagaactgtggcacacggggccccagcctgagaaccacaaccgtctctgggaagctgattcacgaatggtgctgtcgctcctgcacacttccgcctctccggtatatgggagaggacggctgttggtacgggatggaaatcagacccattaatgagaaagaagagaacatggtgaaaagcctggtttctgcgggaagcggcaaggtggataattttaccatgggggtcctgtgcctcgctatcctgttcgaggaagtgatgcggggaaaattcggcaagaaacatatgattgccggcgttctttttacgttcgtgctgctcctgtccgggcagatcacctggcgcgacatggcccacacactgattatgatcggaagcaacgcttctgatagaatgggcatgggggtcacctatcttgccctgatcgcgacatttaagattcagcccttcctcgctctgggatttttcctccggaaactgacctccagagagaatcttctgctcggcgtggggctggccatggccacgacactgcaacttcctgaagacatcgagcagatggctaacggaattgccctgggcctcatgaccctgaagctcatcacacagtttgaaacctaccagctgtggaccgctcttgtgagcctgacatgttccaatacgattttcaccctcacagtcgcctggcgcaccgcgacactgatcctggccggcgtttctcttctgccgctctgccaaagctcctctatgcggaagaccgattggctgcccatgacggtggctgccatgggggtgcctcccctccctctgtttatcttcagccttaaagacacacccaagagacgctcctggcctctgaacgagggagtcatggctgtgggcctggtttctattctcgccagctccctgcttagaaatgatgtgcccatggccgggccgctggtcgctggaggcctcctgatcgcgtgttatgtgattaccgggaccagcgccgacctcacagttgagaaagctgccgacgtgacctgggaagaggaagccgagcagacaggagtctctcataacctgatgatcacggtggatgacgatggcaccatgcggattaaggacgatgaaacagagaacatccttaccgtcctgctgaaaacagctctcctgatcgtgtccggcatttttccttacagcatccccgccacccttctggtttggcacacgtggcagaagcagacccaacgctctggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaatggcaagcgcctggagcctaactgggccagcgtcaaaaaggatcttattagctatggcgggggatggagactgtccgcccagtggcaaaaaggcgaagaggtccaggtgatcgctgtcgaacccgggaagaatcctaagaacttccagacgatgcccggaattttccagaccacaaccggcgagatcggggccatcgcgctggactttaaacccggaaccagcggctcccctattatcaatcgggaaggcaaggtggttgggctctacggaaacggcgtggtcaccaagaatgggggatatgtgagcggcattgctcaaacgaacgccgagccggatgggcccacccctgagctggaagaggaaatgttcaagaaacgcaatcttacaatcatggacctgcatcccggctctggaaagaccagaaagtacctccctgccattgttcgggaggctatcaaacgcagactgcggacactcatcctggcccccaccagagtggtcgctgccgaaatggaggaggcgcttaagggcctgcctattcgctatcagacgacagccaccaaaagcgaacacaccgggcgggagatcgtggatctgatgtgccatgctacatttaccatgagactcctgtccccggttcgcgtgcccaactacaatcttgtcattatggacgaagcccacttcacagatcctgcttctatcgccgcccggggatatattagcaccagagtgggcatgggggaggctgcggccatctttatgacggctacaccccctggaaccgccgaagccttcccccagtccaacgctccgatccaggacgaggagcgcgacattcctgaacggtcttggaatagcggcaacgagtggatcacagattttgtggggaagaccgtctggttcgttccctccattaaagccggcaatgacatcgcgaactgtctgagaaagaacggaaagaaagtgattcaactctctcgcaagacgtttgataccgaataccagaaaacacggctgaatgactgggatttcgtggtcaccacagacatcagcgagatgggcgctaactttaaggccgatagagtgattgacccccggcgctgcctgaaacctgttatcctcaccgatgggcccgagagagtgatccttgccggacctatgccggtcacagctgcctccgcggcccagcggcgcggcagagtggggcggaatccccagaaggaaaacgaccaatacattttcaccggacagcctctgaataacgatgaggaccatgctcactggacggaagccaagatgctgctcgacaatatcaacacacccgagggcattatccctgctctgttcgaacccgagagagagaaaagcgccgctattgatggggaatatcgccttaagggcgagtctcggaaaacctttgttgaactgatgagacgcggagacctcccggtgtggctggcccacaaggtcgcgtccgagggcatcaaatacaccgatcggaagtggtgcttcgacggggaaagaaataaccagatcctggaggagaatatggatgtggaaatttggacaaaagagggagaacgcaagaagctccggcctagatggcttgacgcccgcacctatagcgatcccctggctctgaaagagtttaaggacttcgccgctggcagaaaatctatcgccctcgatctggtcacagaaattgggcgggtgccttcccatcttgcccaccgcacgagaaacgctctggacaatctcgttatgctgcataccagcgagcacggaggccgggcgtaccgccacgccgtggaggaactgcccgagacaatggaaaccctccttctgctgggcctcatgatcctgcttacagggggagctatgctgtttctcatttccggcaaggggatcggaaaaacctctatcggcctgatttgtgtgatcgtcagctccgggatgctgtggatggccgatgttcctctccagtggattgccagcgctatcgtgcttgagttctttatgatggtgctgctgattcccgagccggaaaagcaaagaacgcctcaggacaaccagctcgcctatgtcgtgatcggcattctgacccttgcggccatcgttgctgccaatgagatgggcctgctcgaaacaaccaagcgggatctgggcatgtctaaagagcccggggtggtctcccccacaagctacctggacgtggacctccatcctgcttctgcctggaccctttatgcggtcgccacgacagtgatcaccccgatgctgagacacacaattgaaaacagcaccgctaatgtttccctggccgctatcgccaaccaagctgtggtcctcatgggactggataagggctggcccatttctaaaatggaccttggggtgcctctgctcgccctgggatgctacagccaggttaaccccctgaccctcacagcggccgtgcttctgctggtcacgcattacgctatcattggccctgggctccaggccaaggctacccgcgaggcccagaaacggacagccgcgggaatcatgaagaatcccaccgtggatggcatcatgacaattgacctggatcctgtgatctatgactccaagttcgagaaacaacttggccaggttatgctgctcgtcctgtgtgctgtgcagctgctccttatgagaacctcttgggccctgtgcgaagctctgacgctcgccacagggccgattaccaccctgtgggagggaagccccggcaagttttggaacacaaccatcgccgtgtccatggctaatattttccgcgggagctaccttgccggagcgggcctggccttttctatcatgaaatccgtcgggacaggacggagaggcacgggcagccagggggaaaccctcggagagaagtggaaaaagaagctgaaccaactgtcccggaaagagttcgatctctataagaaatctggcatcacagaggttgaccgcaccgaggctaaggaagggcttaaaagaggagagacaacccaccatgccgtgagccggggctccgctaagctgcagtggtttgtggaacgcaatatggtcattcctgaggggagagtgatcgatctgggatgtggccggggcgggtggtcttactattgcgccggactcaaaaaggttacggaagtgcgcggctacaccaaagggggacccggccacgaggagcctgtccccatgagcacatatgggtggaacattgtgaaactgatgtccggaaaggacgttttctaccttccgcctgaaaaatgtgataccctgctctgcgacatcggcgagagctctccctcccccacagtggaagagagcagaaccattcgggtcctgaagatggtggagccttggctgcgcaataaccagttctgtatcaaagtgctcaatccctacatgcctacagtcattgaacaccttgagagactgcagcggaagtatggcgggatgctggttagaaacccgctctctcgcaattccacccatgaaatgtactggatcagcaacggaacgggcaatatcgtgtctagcgtgaacatggtctcccggctgcttctgaatagatttacaatgacccaccgccggcccaccattgagaaggatgtggacctcggggcgggaacaagacatgttaacgccgaacctgagacgcccaacatggacgtgatcggcgagcgcattaaacggatcaaggaagaacactctagcacctggcactatgatgacgaaaatccttacaaaacatgggcttatcatgggtcctacgaggtcaaggccaccggaagcgcttcctctatgattaacggcgtggttaaactgctgacaaagccctgggatgtggtcccgatggtgacccaaatggccatgacagacaccacgcctttcggccagcagagagtttttaaggaaaaagtggatacccgcacaccccggcctatgcccgggaccagaaaggtcatggagatcacagctgagtggctctggcgcaccctgggacggaataaaaagcctagactttgcacgcgcgaagagttcaccaagaaggtgagaaccaacgccgcgatgggcgccgtctttacagaagagaatcaatgggacagcgctcgggccgctgtggaagatgaggagttctggaagctggttgaccgcgaaagagagctccacaaactggggaagtgtggatcctgcgtgtataacatgatgggcaaacgggaaaagaaacttggggagtttggcaaggccaaaggatctagagccatctggtacatgtggctgggcgcgcggtacctcgagttcgaagctctggggtttctgaatgaggatcattggttcagccgcgaaaactcctattctggagtcgagggcgaagggctccacaagctgggatacattcttagagacatcagcaagattcccggcggggccatgtatgccgatgacaccgctggctgggacacgcggatcaccgaggatgacctgcataatgaggagaagattacacagcagatggatccggagcaccgccagctcgccaacgctatctttaagctgacctaccaaaataaagtggtgaaggttcagagacctacacccaaaggaaccgtgatggacatcatttcccggaaggatcagcgcggcagcgggcaggtcggaacatatggccttaacaccttcacgaatatggaagcccaactggtgagacagatggagggggaaggagttctctctaaggcggacctggagaacccccatctgctcgagaaaaagatcacacagtggctggaaaccaaaggcgtggagcggcttaagcgcatggccatttccggggatgactgcgtcgtgaaacctatcgatgacagatttgctaatgccctgctcgctctgaacgatatgggcaaggtccggaaggacattccgcagtggcaacccagcaaaggatggcatgattggcaacaggtgcctttctgttctcaccatttccacgaacttatcatgaaggacggccgcaaactggttgtgccctgcagacctcaggacgagctcatcgggcgggcccgcatttcccaaggagcgggctggagcctgaaggaaaccgcctgtctggggaaggcttacgcccagatgtggaacctcatgtattttcacagacgggatctgagacttgcttctaatgccatctgctccgctgtccccgtgcattggattcctacaagccgcaccacatggtccatccacgcccatcaccagtggatgacgaccgaggacatgctgacagtttggaaccgggtgtggattgaggataatccctggatggaagacaagaccccggtcacaacctgggaggatgtgccttacctcggaaagagagaagaccaatggtgtggcagcctgatcgggcttacgtctcgcgcgacctgggcccagaacattctgacagctatccaacaggtgcggagcctcatcggcgatgaggagttcctggactacatgccctccatgaaaagatttcgcaaggaagaggaatctgagggagccatttggtga

SEQ ID NO: 20511 - RNA, 9873 nt, synthetic construct
  misc_feature 1..9873: note = derived and/or modified CDS sequence (opt5) from DENV-3__FJ639730__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgcctccggcattaatatgtgtacccttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgaacaccggcgggacaagcgctctgtggccctggctcctcacgtcgggatgggactcgataccagaacacagacctggatgagcgccgaaggcgcttggagacaggtggaaaaggttgaaacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctgggaaaatggagtgtgtggcatcagatctacaacccgcatggagaacctgctgtggaagcagattgctaatgaactcaactatatcctgtgggagaataacatcaaacttacagtcgtggttggggatattatcggagtgctggaacagggcaagcggaccctcacgcctcagcccatggagctgaaatactcctggaagacctgggggaaggccaaaattgtcacagccgagacccaaaatagctctttcatcattgacggacctaacacacccgaatgcccgtccgctagcagagcgtggaacgtgtgggaggtggaagactatggctttggcgtcttcaccacaaatatctggctgaaacttcgcgaggtttacacccagtcctgtgatcatcggctcatgtctgccgctatcaaagacgaaaaggccgtgcacgccgatatggggtactggattgagagccagaaaaacggatcctggaagctggagaaggcttcttttatcgaagtgaaaacgtgcacatggcctaagagccacaccctgtggtccaatggcgtcctcgagagcgacatgattatccccaaatctctggccgggcctatttcccagcataaccacagacccggatatcatacccaaacagcgggcccttggcaccttgggaagctggaactcgatttcaattactgcgagggaaccacggtggttatcacagagaactgtggcacccgcggccccagcctgcggacaaccacagtgtctgggaaactgatccacgaatggtgctgtagatcctgcacccttccgcctctccgctatatgggagaggacggctgttggtacgggatggaaattcggcccatcaatgagaaggaagagaacatggtcaagagcctggtgtctgctggaagcggcaaagttgataattttacgatgggggtgctgtgcctcgccattctgttcgaggaagtcatgagaggaaagttcggcaaaaagcatatgatcgccggcgtgctttttaccttcgttctgctcctgtccgggcagattacatggcgggacatggctcacaccctgatcatgattggaagcaacgcctctgatcgcatgggcatgggggtgacatatcttgcgctgatcgctacctttaaaatccagcccttcctcgccctgggatttttcctcagaaagctgacgtcccgggagaatcttctgctcggcgtcgggctggccatggctacaaccctgcaacttcctgaagacattgagcagatggccaacggaatcgctctgggcctcatgacactgaagctcattacccagtttgaaacctaccagctgtggacagcccttgtgagcctgacgtgttccaataccatcttcacactcaccgtggcgtggagaacagccaccctgattctggctggcgtctctcttctgccgctctgccaaagctcctctatgcgcaaaacggattggctgcccatgacagttgccgctatgggggtgcctcccctccctctgtttatcttcagccttaaggacacccccaaacggagatcctggcctctgaacgagggagtgatggccgtcggcctggtgtctatcctcgccagctccctgcttcgcaatgatgttcccatggctgggccgctggtggcgggaggcctcctgattgcctgttatgtcatcaccgggacaagcgctgacctcaccgtggagaaggccgccgacgttacatgggaagaggaagctgagcagacgggagtgtctcataacctgatgattaccgtcgatgacgatggcacaatgagaatcaaagacgatgaaaccgagaacattcttacagtgctgctgaagaccgccctcctgatcgtctccggcatctttccttacagcattcccgcgacgcttctggtgtggcacacctggcagaaacagacacaacggtctggggttctctgggacgtgccttctcccccggagacccagaaggctgaactggaggaaggagtctaccgcatcaagcagcagggcattttcgggaaaacacaagtgggagttggcgtgcagaaggagggggtctttcataccatgtggcacgtgacaagaggagccgtgctcacgcacaatggcaaacggctggagcctaactgggccagcgttaagaaagatcttatcagctatggcgggggatggcgcctgaatgctcagtggcaaaagggcgaagaggtccaggtgattgccgtggaacccgggaagaaccctaaaaatttccagaccatgcccggaatcttccagacaaccaccggcgagattggggcgatcgctctggactttaagcccggaacatccggcagccctatcattaacaaagaaggcaaggtcgtggggctctacggaaatggcgttgtgacgaaaaacgggggatatgtctccggcatcgcccaaaccaatgccgagccggatgggcccacacctgagctggaagaggaaatgttcaagaagagaaaccttaccattatggacctgcatcccggcagcggaaaaacacggaagtacctccctgctatcgtgcgcgaggccattaaaagacggctgcgcaccctcatcctggctcccacgagagttgtggccgcggaaatggaggaggcccttaagggcctgcctatccggtatcagacaaccgctaccaaatctgaacacacagggagagagattgtcgatctgatgtgccatgccacctttacaatgcgcctcctgagcccggtgcgggttcccaattacaaccttgtgatcatggacgaagctcacttcaccgatcctgcctccattgccgctagaggatatatctctacgcgcgtcggcatgggggaggcggccgctatttttatgacagccacaccccctggaacagccgaggctttcccccagagcaatgccccgatccaggacgaggagcgggacatccctgaaagatcctggaactctggcaatgagtggattaccgattttgtggggaagacggtgtggttcgtccccagcatcaaggcgggcaacgacattgctaactgtctgcgcaaaaatggaaagaaagttatccaactctcccggaagacctttgatacagaataccagaaaaccagactgaacgactgggatttcgtggtgacaaccgacatttctgagatgggcgccaattttaaggccgatcgcgtcatcgacccccggagatgcctgaagcctgtgattctcacagatgggcccgagcgggttatccttgctggacctatgccggtgaccgccgcgagcgccgctcagcgcagaggccgggtcgggcgcaacccccagaaagaaaatgaccaatacatcttcacgggacagcctctgaacaatgatgaggaccatgcccactggacagaagctaagatgctgctcgacaacattaatacccccgagggcatcattcctgccctgttcgaacccgagagagagaaatccgctgccatcgatggggaatatcggcttaagggcgagagcagaaaaacctttgtggaactgatgcgccggggagacctcccggtttggctggcgcacaaggtggcctctgagggcattaaatacacagatagaaagtggtgcttcgacggggaacgcaacaatcagatcctggaggagaacatggatgtcgaaatctggaccaaggagggagaacggaaaaagctcagacctcgctggcttgacgctcggacatattccgatcccctggccctgaaagagtttaaggacttcgctgccggcagaaaaagcattgccctcgatctggtgacggaaatcgggcgcgtcccttctcatcttgctcacagaacccggaatgcgctggacaacctcgtgatgctgcatacatccgagcacggaggccgcgcctacagacacgctgttgaggaactgcccgagaccatggaaacactccttctgctgggcctcatgattctgcttaccgggggagccatgctgtttctcatcagcggcaaggggattggaaagacgtccatcggcctgatctgtgtgattgtgtctagcgggatgctgtggatggccgatgtccctctccagtggatcgcttccgccattgttcttgagttctttatgatggtgctgctgatccccgagccggaaaaacaacggacccctcaggacaatcagctcgcgtatgtggtcattggaatcctgacacttgccgctattgtggccgctaacgagatgggcctgctcgaaaccacaaagcgcgatctgggcatgagcaaagagcccggggttgtgtctcccacctcctacctggacgtcgacctccatcctgccagcgcgtggacgctttatgccgtggctacaaccgtcatcacaccgatgctgagacacaccatcgaaaattctaccgccaacgtgagcctggctgccattgctaaccaagccgttgtgctcatgggactggataagggctggcccatctccaaaatggaccttggggtccctctgctcgcgctgggatgctactctcaggtgaatcccctgacactcacggccgctgttcttctgctggtgacccattacgccattatcggccctgggctccaggctaaggccacacgggaggcccagaagagaaccgcggctggaattatgaaaaaccccacagtcgatggcatcatgaccatcgacctggatcctgtgatttatgacagcaagttcgagaaacaacttggccaggtgatgctgctcgttctgtgtgccgtccagctgctccttatgcgcacgtcctgggctctgtgcgaagccctgacactcgccaccgggccgatcaccacactgtgggagggatctcccggcaagttttggaataccacaattgctgtgagcatggccaacatcttccgggggtcctaccttgcgggagccggcctggcttttagcattatgaaatctgtggggacgggaagacgcggcaccggctcccagggggaaacactcggagagaagtggaagaaaaagctgaatcaactgagccggaaagagttcgagctctataagaaatccggcatcaccgaggtcgatagaacagaagccaaggaggggcttaaacggggagaaaccacgcaccatgctgtttctcgcggcagcgccaagctgcagtggtttgtggagagaaacatggtgatccctgaagggcgggtcattgacctgggatgtggccgcggcgggtggtcctactattgcgcgggactcaagaaagtgaccgaggttagaggctacacaaaaggcgggcccgggcacgaggaacctgtgcccatgtctacctatgggtggaatatcgtcaaactgatgagcggaaaggatgtgttctaccttccgcctgagaaatgtgacacactgctctgcgatattggcgaatccagcccctctcccaccgttgaggagtcccggacaatccgcgtgctgaagatggtcgaaccttggctgagaaacaatcagttctgtattaaggtgctcaacccctacatgcctaccgtgatcgagcaccttgaaaaactgcagcggaagtatggcgggatgctggtccgcaatccgctcagcagaaactctacgcatgagatgtactggatttccaatggaacaggcaacatcgttagctctgtgaatatggtgagccggctgcttctgaacagatttaccatgacccaccgccggcccacaatcgaaaaagacgtcgatctcggggccggaacgagacatgtgaacgctgagcctgagacccccaatatggacgttattggcgaacgcatcaagcggattaaagaggaacactcctctacatggcactatgacgatgagaacccttacaagacctgggcctatcatgggagctacgaagtgaaggctacaggatccgccagctccatgatcaatggcgtcgtgaaactgctgaccaagccctgggacgttgtgccgatggtcacacaaatggctatgaccgatacgacccctttcggccagcagagagtgtttaaagagaaggttgacacacgcacaccccggcctatgcccgggacaagaaaagtgatggagattaccgccgaatggctctggcgcacgctgggacggaacaagaagcctagactttgcacacgcgaggagttcaccaaaaaggtccggacaaatgcggccatgggcgctgtgtttaccgaggaaaaccaatgggattctgccagagctgccgtcgaggacgaggagttctggaaactggtggatcgcgagagagaactccacaagctggggaaatgtggaagctgcgtttataatatgatgggcaagcgggagaagaaacttggggagtttggcaaagccaaaggatcccgcgcgatctggtacatgtggctgggcgctagatacctcgagttcgaggccctggggtttctgaacgaagaccattggttctctcgggagaatagctattccggagtggaaggcgaggggctccacaagctgggatacatccttagagatatttctaaaatccccggcggggccatgtatgctgacgatacggccggctgggacacccggattacagaggacgatctgcataacgaagagaagatcacccagcagatggacccggaacaccgccagctcgctaatgccatttttaaactgacataccaaaacaaggtcgtgaaggtgcagagacctacccccaaaggaacagttatggatatcatcagccggaaggaccagcgcggctccggacaggtgggaacctatggccttaatacgttcacaaacatggaggcgcaactggtcagacagatggaaggggagggagtgctcagcaaagccgatctggagaatccccatctgctcgaaaagaaaattacccagtggctggagaccaagggcgttgaacggcttaagcgcatggctatctctggggacgattgcgtggtcaaacctattgacgatagatttgccaacgctctgctcgccctgaacgacatgggcaaggtgcggaaagatatcccgcagtggcaaccctccaagggatggcatgactggcagcaggtccctttctgtagccaccatttccacgagcttattatgaaagatggccgcaagctggtggttccctgcagacctcaggacgaactcatcgggcgggcgcgcatctctcaaggagccggctggtccctgaaggagacagcttgtctggggaaagcctacgctcagatgtggagcctcatgtattttcacagacgggacctgcgccttgcctctaatgctatttgctccgccgtgcccgtccattggatccctaccagcagaacaacgtggtccattcacgcgcatcaccagtggatgaccacagaggatatgctgaccgtgtggaaccgggtttggatcgaagacaatccctggatggaggataagacaccggtgaccacgtgggaagacgtcccttacctcggaaaaagagaggatcaatggtgtggcagcctgattgggcttacctctcgcgccacatgggctcagaacatcctgaccgccattcaacaggtgcggagcctcatcggcgacgaggagttcctggattacatgccctccatgaagagatttcgcaaagaggaagagtctgaaggagccatctggtga

SEQ ID NO: 20512 - RNA, 9873 nt, synthetic construct
  misc_feature 1..9873: note = derived and/or modified CDS sequence (opt5) from DENV-3__KF955464__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggcggcaggtcgaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacagcttgccattctgcgcaaactctgtatcgagggaaagattaccaatatcacaaccgatagcagatgccctacgcagggcgaagcgacactgccggaggaacaggaccagaactatgtgtgtaaacacacctacgtggatcggggctgggggaatggatgcggccttttcgggaagggatctctggtgacctgcgccaagtttcaatgtctcgagcccattgagggcaaagtggttcagtatgaaaacctgaagtacacagtgatcatcaccgtccacacaggggaccagcatcaggtgggaaatgacacgcaaggcgttaccgtggagattacacctcaggcttccaccgtcgaagccgtgctgcccgagtatggcacactcgggctggaatgcagccctcgcaccggacttgatttcaacgagatgatcctgctcacgatgaaaaataaggcttggatggtccacagacagtggtttttcgacctgccccttccgtggacctctggcgccacaaccgagacacctacctggaaccggaaagaactgctcgtgacgtttaagaatgcccatgctaaaaagcaagaggttgtggtcctggggtcccaggaaggagcgatgcacacagccctgaccggcgctacagagattcagaacagcgggggcaccaatatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccatcaacattgaagctgagcctccgttcggcgaatccaatatcgtgattgggatcggcgacaaagccctcaagatcaactggtataagaaaggatctagcattggcaagatgtttgaggccacagctagaggggccagacgcatggctatcctgggagataccgcctgggacttcggctccgttgggggagtcctgaatagcctcggcaaaatggtgcatcagatttttgggtctgcgtacacggccctgttctccggcgtgagctggatcatgaagattggaatcggcgtccttctgacatggattgggctcaactctaaaaataccagcatgtccttttcttgcatcgtgatcggaattatcaccctgtatctgggcgctgttgtgcaggccgatatggggtgtgtcattaactggaagggaaaggaacttaaatgcggcaatgggatcttcgtgacaaacgaggttcacacctggacagagcagtacaagtttcaagctgacagccccaaacggctcgccacggcgattgccggcgcttgggaaaatggagtgtgtggcatcagatccaccacacgcatggagaacctgctgtggaagcagatcgccaatgaactcaactatattctgtgggagaataacatcaaacttaccgtcgtggttggggatattatcggagtgctggaacagggcaagcggacactcacccctcagcccatggagctgaaatacagctggaagacgtgggggaaggctaaaattgtcaccgccgagacacaaaactcttccttcatcatcgacggacctaatacccccgaatgcccgagcgcctctagagcttggaacgtgtgggaggtggaagactatggctttggcgtcttcacaaccaatatttggctgaaacttcgcgaggtttacacacagtcctgtgatcatcggctcatgagcgcggccatcaaagacgaaagagctgtgcacgccgatatggggtactggattgagtcccagaagaacggatcttggaaactggagaaggccagctttatcgaagtgaagacctgcacgtggcctaaatcccacacactgtggtctaatggcgtcctcgagagcgacatgattatccccaagtccctggctgggcctatcagccagcataaccaccgccccggatatcatacccaaaccgccggcccttggcaccttgggaaactggaactcgatttcaattactgcgagggaacaaccgtggttattgcggagaactgtggcacgcggggcccctctctgagaacaaccacagtgtccgggaagctgatccacgaatggtgctgtcgcagctgcacccttccgcctctccggtatatgggagaggacggctgttggtacgggatggaaattagacccatcaatgagaaagaagagaacatggtcaagtctctggtgtccgctggaagcggcaaggttgataattttacaatgggggtgctgtgcctcgccattctgttcgaggaagtcatgcggggaaaattcggcaagaaacatatgatcgccggcgtgctttttaccttcgttctgctcctgtctgggcagattacgtggcgcgacatggctcacaccctgatcatgatcggaagcaacgcctccgatagaatgggcatgggggtgacatatcttgcgctgattgctacctttaagatccagcccttcctcgccctgggatttttcctccggaaactgacaagcagagagaatcttctgctcggcgtcgggctggccatggctaccacgctgcaacttcctgaagacattgagcagatggccaacggaatcgctctgggcctcatgacactgaagctcattacccagtttgaaacataccagctgtggaccgcccttgtgtctctgacctgttccaatacaatcttcacgctcaccgtggcgtggcgcacagccaccctgatcctggctggcgtcagccttctgccgctctgccaatcctctagcatgcggaagacagattggctgcccatgaccgttgccgctatgggggtgcctcccctccctctgtttattttctcccttaaagacacgcccaagagaaaatcttggcctctgaacgagggagtgatggccgtcggcctggtgagcatcctcgcctcctctctgcttcgcaacgatgttcccatggctgggccgctggtggcgggaggcctcctgattgcctgttatgtcatcacagggaccagcgctgacctcaccgtggagaaggccgccgacgttacatgggaagaggaagctgagcagaccggagtgtcccataatctgatgattacagtcgatgacgatggcacgatgagaatcaaagacgatgaaaccgagaacatccttacagtgctgctgaagaccgccctcctgattgtcagcggcatctttccttactctattcccgcgacacttctggtgtggcacacctggcagaaacagacgcaacggtccggggttctctgggacgtgccttctcccccggagacccagaaggctgaactggaggaaggagtctaccgcatcaagcagcagggcattttcgggaaaacacaagtgggagttggcgtgcagaaggagggggtctttcataccatgtggcacgtgacaagaggagccgtgctcacccacaatggcaaacggctggagcctaactgggcctccgttaagaaagatcttatctcctatggcgggggatggcgcctgagcgctcagtggcaaaagggcgaagaggtccaggtgattgccgtggaacccgggaagaatcctaaaaacttccagacaatgcccggaatcttccagacgaccacaggcgagatcggggcgattgctctggactttaagcccggaacctctggctcccctatcattaatagagaaggcaaagtcgtggggctctacggaaacggcgttgtgaccaagaatgggggatatgtcagcggcatcgcccaaacaaacgccgagccggatgggcccacgcctgagctggaagaggaaatgttcaaaaagcggaatcttaccattatggacctgcatcccggctccggaaagacacgcaaatacctccctgctatcgtgagagaggccatcaagcggcgcctgagaaccctcattctggctcccacacgggttgtggccgcggaaatggaggaggcccttaaaggcctgcctatcagatatcagaccacggctacaaagagcgaacacaccgggcgcgagattgtcgatctgatgtgccatgccacctttacaatgcggctcctgtctccggtgagagttcccaactacaatcttatcattatggacgaagctcacttcaccgatcctgccagcatcgccgctcgcggatatatctccacacgggtgggcatgggggaggcggccgctatttttatgaccgccacgccccctggaacagccgaggctttcccccagtctaacgccccgatccaggacgaggagagagacattcctgaacgcagctggaatagcggcaacgagtggatcaccgattttgtcgggaaaacagtgtggttcgtgccctctattaaggcgggcaacgacatcgctaattgtctgcggaagaacggcaaaaaggtcattcaactcagcagaaaaacctttgatacggaataccagaagacccgcctgaatgactgggatttcgttgtgacaaccgacatctccgagatgggagccaactttaaagccgatcgggtgatcgaccccagacggtgcctgaagcctgtcattctcacagatgggcccgagcgcgtgatccttgctggacctatgccggttaccgccgcgtctgccgctcagagacggggccgcgtggggagaaatccccagaaggaaaacgaccaatacattttcacaggacagcctctgaataacgatgaggaccatgcccactggaccgaagctaaaatgctgctcgacaatatcaacacgcccgagggcattatccctgccctgttcgaacccgagcgggaaaagagcgctgccatcgatggggaatatagacttaaaggcgagtcccgcaagacatttgtcgaactgatgcggagaggagacctcccggtgtggctggcgcacaaagttgccagcgagggcattaagtacaccgatcgcaaatggtgcttcgacggggaacggaataaccagatcctggaggagaatatggatgtggaaatttggaccaaggagggagaaagaaagaaactccgccctcggtggcttgacgctagaacatattctgatcccctggccctgaaggagtttaaagacttcgctgccggccgcaagtccatcgccctcgatctggtcaccgaaattgggagagtgcctagccatcttgctcaccggacacgcaacgcgctggacaatctcgtcatgctgcatacgtctgagcacggaggcagagcctaccggcacgctgtggaggaactgcccgagaccatggaaacactccttctgctgggcctcatgatcctgcttaccgggggagccatgctgtttctcatctccggcaaagggattggaaagacaagcatcggcctgatttgtgttatcgtgtcctctgggatgctgtggatggccgatgtgcctctccagtggattgctagcgccatcgtccttgagttctttatgatggttctgctgattcccgagccggaaaagcaacgcacccctcaggacaaccagctcgcgtatgtggtgatcggaatcctgacgcttgccgctattgtcgccgctaatgagatgggcctgctcgaaaccacaaaaagagatctgggcatgtccaaggagcccggggtggttagccccacctcttacctggacgtggacctccatcctgcctccgcgtggacactttatgccgtcgctaccacggtgatcacaccgatgctgcggcacaccattgaaaacagcacagccaacgtctctctggctgccatcgctaatcaagccgtggttctcatgggactggataaaggctggcccattagcaagatggaccttggggtgcctctgctcgcgctgggatgctactcccaggtcaaccccctgaccctcaccgccgctgtgcttctgctggttacacattacgccatcatcggccctgggctccaggctaaagccacgagagaggcccagaagcgcaccgcggctggaattatgaagaatcccacagtggatggcatcatgaccattgacctggatcctgtcatctatgactctaaattcgagaagcaacttggccaggtgatgctgctcgtgctgtgtgccgttcagctgctccttatgcggacaagctgggctctgtgcgaagccctgaccctcgccacggggccgattacaaccctgtgggagggatcccccggcaaattttggaacaccacaatcgctgtctctatggccaatatcttcagagggagctaccttgcgggagccggcctggctttttccattatgaaaagcgtggggaccggacgccggggcacaggctctcagggggaaacgctcggagagaaatggaagaagaaactgaaccaactgtccagaaaggagttcgatctctataaaaagagcggcatcaccgaggtggaccggacagaggccaaagaagggcttaagcgcggagagaccacacaccatgctgtctccagaggctctgccaaactgcagtggtttgttgaacggaatatggtgattcctgaggggcgcgtgatcgatctgggatgtggcagaggcgggtggagctactattgcgcgggactcaagaaggtcaccgaagtgcggggctacacgaaagggggacccggccacgaggagcctgttcccatgtccacctatgggtggaacattgtgaagctgatgtctggaaaagacgtcttctaccttccgcctgaaaagtgtgatacactgctctgcgacatcggcgagagctcccccagccccaccgtggaagagtctcgcacaattagagttctgcggatggtggagccttggctgcgcaataaccagttctgtatcaaagtcctcaatccctacatgcctaacgtgatcgaacaccttgagagactgcagcggaagtatggcgggatgctggtgagaaatccgctctcccgcaacagcacccatgaaatgtactggatttctaatggaacaggcaacatcgtctccagcgttaacatggtgtctcggctgcttctgaatagatttaccatgacgcaccgccggcccacaattgagaaggatgtggacctcggggccggaaccagacatgtcaacgctgaacctgagacccccaatatggacgtgatcggcgagcgcattaaacggatcaaggaagaacacagctccacatggcactatgatgacgaaaacccttacaaaacgtgggcctatcatgggtcttacgaggttaaggctaccggaagcgcctccagcatgatcaatggcgtggtcaaactgctgacaaagccctgggatgtggttccgatggtgacccaaatggctatgacagacaccacacctttcggccagcagagagtctttaaggaaaaagtggatacccgcacgccccggcctatgcccgggaccagaaaggttatggagattacagccgagtggctctggcgcaccctgggacggaacaaaaagcctagactttgcacacgcgaagagttcaccaaaaaggtgagaacgaatgcggccatgggcgctgtctttacagaagagaaccaatgggactccgcccgggctgccgtggaagatgaggagttctggaagctggtcgacaaagaacgcgagctccacaagctggggaaatgtggatcttgcgtgtataatatgatgggcaagagagagaagaaacttggggagtttggcaaagccaagggaagccgggcgatctggtacatgtggctgggcgctagatacctcgagttcgaagccctggggtttctgaacgaggatcattggttctcccgggaaaattcttatagcggagttgagggcgaagggctccacaagctgggatacattcttcgcgacatctccaaaattcccggcggggccatgtatgctgatgacaccgccggctgggacacaagaatcaccgaggatgacctgcataacgaggaaaagatcacgcagcagatggatccggagcaccggcagctcgctaatgccatttttaaactgacctaccaaaacaaggtggtcaaagtgcagcgccctacacccaagggaaccgtgatggacatcatttctagaaaggatcagcggggcagcgggcaggttggaacatatggccttaataccttcacaaacatggaagcgcaactggtgcgccagatggagggggaaggagtcctctccgaggccgacctggagaacccccatctgctcgagaagaagatcacccagtggctggagacgaaaggcgtggaaagacttaagcggatggctattagcggggatgactgcgttgtgaaacctatcgatgaccgctttgccaatgctctgctcgccctgaacgatatgggcaaggtcagaaaggacatcccgcagtggcaaccctctaaaggatggcatgattggcaacaggtgcctttctgttcccaccatttccacgagcttattatgaaggacggccggaaactggtcgtgccctgccgccctcaggacgaactcatcgggagagcgcggattagccaaggagccggctggtctctgaaggagacagcttgtctggggaaagcctacgctcagatgtggtccctcatgtattttcaccgcagagatctgcggcttgccagcaatgctatctgctctgccgttcccgcgcattggattcctacctccagaaccacatggagcatccacgcccatcaccagtggatgaccacagaggacatgctgacggtgtggaaccgcgtctggattgaagataatccctggatggaggacaagaccccggtgacaacctgggaagatgttccttacctcggaaagcgggaggaccaatggtgtggctccctgatcgggcttacaagcagagctacctgggcccagaacatcctgacggccattcaacaggtgcgctctctcatcggcgatgaggagttcctggactacatgcccagcatgaaacggtttagaaaggaggaagagtccgaaggagctatttggtga

SEQ ID NO: 20513 - RNA, 9873 nt, synthetic construct
  misc_feature 1..9873: note = derived and/or modified CDS sequence (opt5) from DENV-3__FJ639731__SS-prME
  source 1..9873: mol_type = other RNA
acctccctgtgcctcatgatgatgctgcccgccacccttgctttccacctgacgtcccgggacggagaacctcggatgatcgtggggaagaacgaacgcggaaagtctctcctgtttaagaccgccagcggcattaatatgtgtacccttatcgcgatggatctgggggaaatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccgtgctgatcaaggtcgaatacaagggagaggacgctccctgtaaaattcctttctccacagaagatggccaagggaaggcccacaacggaagacttatcaccgcgaaccccgtggtgaccaagaaggaggagcccgttaatatcgaagctgagcctccgttcggcgaatctaacattgtcatcgggattggcgacaaagccctcaagatcaattggtataagaaaggaagctccattggcaagatgtttgaggccaccgctagaggggccagacgcatggctatcctgggagatacggcctgggacttcggcagcgtcggaggggtgctgaactctctcggcaaaatggtccatcagatctttgggtccgcgtacacagccctgttcagcggcgtgtcttggattatgaagatcggaattggcgttcttctgacctggatcgggctcaatagcaaaaacacctccatgtcttttagctgcattgtgatcggaattatcacactgtatctgggcgctgtcgtgcaggccgatatggggtgtgctatcaattggaagggaaaggaacttaaatgcggctccgggattttcgttaccaacgaggtgcacacatggacggagcagtacaagtttcaagccgacagccccaaacggctcgcgaccgccatcgctggcgcctgggaaaatggagtctgtggcattagatctacaacccgcatggagaacctgctgtggaagcagatcgctaatgaactcaactatattctgtgggagaataacatcaaacttacagtggttgtgggggatatcattggagtcctggaacagggcaagcggaccctcacgcctcagcccatggagctgaaatactcctggaagacctgggggaaggccaaaatcgtgacagccgagacccaaaatagctctttcattatcgacggacctaacacacccgaatgcccgtccgctagcagagcgtggaacgtgtgggaggtcgaagactatggctttggcgttttcaccacaaatatttggctgaaacttcgcgaggtgtacacccagtcctgtgatcatcggctcatgtctgccgctatcaaagacgaaagagccgtgcacgccgatatggggtactggatcgagagccagaagaacggatcctggaaactggagaaggcttcttttattgaagtcaagacgtgcacatggcctaaaagccacaccctgtggtccaatggcgtgctcgagagcgacatgatcattcccaagtctctggccgggcctatctcccagcataaccaccgccccggatatcatacccaaacagcgggcccttggcaccttgggaaactggaactcgatttcaattactgcgagggaaccacggttgtgattacagagaactgtggcacccggggccccagcctgagaacaaccacagtctctgggaagctgatccacgaatggtgctgtcgctcctgcacccttccgcctctccggtatatgggagaggacggctgttggtacgggatggaaatcagacccattaatgagaaagaagagaacatggttaagagcctggtgtctgctggaagcggcaagatggataattttacgatgggggtgctgtgcctcgccatcctgttcgaggaagtcatgcggggaaaattcggcaagaaacatatgattgccggcgtgctttttaccttcgttctgctcctgtccgggcagatcacatggcgcgacatggctcacaccctgattatgatcggaagcaacgcctctgatagaatgggcatgggggtgacatatcttgcgctgattgctacctttaagatccagcccttcctcgccctgggatttttcctccggaaactgacgtccagagagaatcttctgctcggcgtcgggctggccatggctacaaccctgcaacttcctgaagacatcgagcagatggccaacggaattgctctgggcctcatgacactgaagctcatcacccagtttgaaacctaccagctgtggacagcccttgtgagcctgacgtgttccaataccattttcacactcaccgtggcgtggcgcacagccaccctgatcctggctggcgtctctcttctgccgctctgccaaagctcctctatgcggaagacggattggctgcccatgacagttgccgctatgggggtgcctcccctccctctgtttattttcagccttaaagacacccccaagagacgctcctggcctctgaacgagggagtgatggccgtcggcctggtgtctatcctcgccagctccctgcttagaaatgatgttcccatggctgggccgctggtggcgggaggcctcctgatcgcctgttatgtcattaccgggacaagcgctgacctcaccgtggagaaagccgccgacgttacatgggaagaggaagctgagcagacgggagtgtctcataacctgatgatcaccgtcgatgacgatggcacaatgcggattaaggacgatgaaaccgagaacatccttacagtgctgctgaaaaccgccctcctgattgtctccggcatctttccttacagcatccccgcgacgcttctggtgtggcacacctggcagaagcagacacaacgctctggggttctctgggacgtgccttctcccccggagacccagaaagctgaactggaggaaggagtctacagaattaagcagcagggcatcttcgggaagacacaagtgggagttggcgtgcagaaagagggggtctttcataccatgtggcacgtgacacggggagccgtgctcacgcacaatggcaagcgcctggagcctaactgggccagcgttaaaaaggatcttattagctatggcgggggatggagactgaatgctcagtggcaaaaaggcgaagaggtccaggtgatcgccgtggaacccgggaagaaccctaagaatttccagaccatgcccggaattttccagacaaccaccggcgagatcggggcgattgctctggactttaaacccggaacatccggcagccctatcatcaacaaggaaggcaaagtcgtggggctctacggaaatggcgttgtgacgaagaacgggggatatgtctccggcattgcccaaaccaatgccgagccggatgggcccacacctgagctggaagaggaaatgttcaaaaagcggaaccttaccatcatggacctgcatcccggcagcggaaagacacgcaaatacctccctgctattgtgagagaggccatcaagcggcgcctgagaaccctcattctggctcccacgcgggttgtggccgcggaaatggaggaggcccttaaaggcctgcctatcagatatcagacaaccgctaccaagtctgaacacacagggcgcgagatcgtcgatctgatgtgccatgccacctttacaatgcggctcctgagcccggtgagagttcccaattacaaccttgtgattatggacgaagctcacttcaccgatcctgcctccatcgccgctcgcggatatatttctacgcgggtcggcatgggggaggcggccgctatctttatgacagccacaccccctggaacagccgaggctttcccccagagcaatgccccgattcaggacgaggagagagacatccctgaacgctcctggaactctggcaatgagtggatcaccgattttgtggggaaaacggtgtggttcgtccccagcattaaggcgggcaacgacatcgctaactgtctgcggaagaatgggaaaaaggttattcaactctccagaaaaacctttgatacagaataccagaagacccgcctgaacgactgggatttcgtggtgacaaccgacatctctgagatgggcgccaattttaaagccgatcgggtcattgaccccagacggtgcctgaagcctgtgatcctcacagatgggcccgagcgcgttattcttgctggacctatgccggtgaccgccgcgagcgccgctcagagacggggccgcgtcgggagaaacccccagaaggaaaatgaccaatacatcttcacgggacagcctctgaacaatgatgaggaccatgcccactggacagaagctaaaatgctgctcgacaacatcaatacccccgagggcattatccctgccctgttcgaacccgagcgggagaagtccgctgccattgatggggaatatagacttaaaggcgagagccgcaagacctttgtggaactgatgcggagaggagacctcccggtttggctggcgcacaaagtggcctctgagggcatcaagtacacagatcgcaaatggtgcttcgacggggaacggaacaatcagattctggaggagaacatggatgtcgaaatctggaccaaggagggagaaagaaagaaactccgccctcggtggcttgacgctagaacatattccgatcccctggccctgaaggagtttaaagacttcgctgccggccgcaagagcatcgccctcgatctggtgacggaaattgggagagtcccttctcatcttgctcaccggacccgcaatgcgctggacaacctcgtgatgctgcatacatccgagcacggaggcagagcctaccggcacgctgttgaggaactgcccgagaccatggaaacactccttctgctgggcctcatgatcctgcttaccgggggagccatgctgtttctcattagcggcaaagggatcggaaagacgtccattggcctgatctgtgtgatcgtgtctagcgggatgctgtggatggccgatgtccctctccagtggattgcttccgccatcgttcttgagttctttatgatggtgctgctgattcccgagccggaaaagcaacgcacccctcaggacaatcagctcgcgtatgtggtcatcggcattctgacacttgccgctatcgtggccgctaacgagatgggcctgctcgaaaccacaaaaagagatctgggcatgagcaaggagcccggggttgtgtctcccacctcctacctggacgtcgacctccatcctgccagcgcgtggacgctttatgccgtggctacaaccgtcattacaccgatgctgcggcacaccatcgaaaattctaccgccaacgtgagcctggctgccatcgctaaccaagccgttgtgctcatgggactggataaaggctggcccatttccaagatggaccttggggtccctctgctcgcgctgggatgctactctcaggtgaatcccctgacactcacggccgctgttcttctgctggtgacccattacgccatcattggccctgggctccaggctaaagccacaagagaggcccagaagcgcaccgcggctggaatcatgaagaaccccacagtcgatggcattatgaccatcgacctggatcctgtgatctatgacagcaaattcgagaagcaacttggccaggtgatgctgctcgttctgtgtgccgtccagctgctccttatgcggacgtcctgggctctgtgcgaagccctgacactcgccaccgggccgattaccacactgtgggagggatctcccggcaaattttggaataccacaatcgctgtgagcatggccaacattttcagagggtcctaccttgcgggagccggcctggcttttagcatcatgaagtctgtggggacgggacgccggggcaccggctcccagggggaaacactcggagagaaatggaagaagaaactgaatcaactgagcagaaaggagttcgatctctataaaaagtccggcattaccgaggtcgaccggacagaggccaaagaagggcttaagcgcggagagaccacgcaccatgctgtttctagaggcagcgccaaactgcagtggtttgtggaacggaacatggtgatccctgaggggcgcgtcatcgatctgggatgtggcagaggcgggtggtcctactattgcgcgggactcaagaaggtgaccgaagttcggggctacacaaaagggggacccggccacgaggagcctgtgcccatgtctacctatgggtggaatattgtcaagctgatgagcggaaaagacgtgttctaccttccgcctgaaaagtgtgatacactgctctgcgacatcggcgagtccagcccctctcccaccgttgaagagtcccgcacaattagagtgctgaaaatggtcgagccttggctgcggaacaatcagttctgtatcaaggtgctcaacccctacatgcctaccgtgattgaacaccttgagcgcctgcagagaaagtatggcgggatgctggtccggaatccgctcagcagaaactctacgcatgaaatgtactggatctccaatggaacaggcaacattgttagctctgtgaatatggtgagccgcctgcttctgaaccggtttaccatgacccacagacgccccacaatcgagaaagatgtcgacctcggggccggaacgcggcatgtgaacgctgaacctgagacccccaatatggacgttatcggcgagagaattaagcgcatcaaagaagaacactcctctacatggcactatgatgacgaaaacccttacaagacctgggcctatcatgggagctacgaggtgaaagctacaggatccgccagctccatgattaatggcgtcgtgaagctgctgaccaagccctgggatgttgtgccgatggtcacacaaatggctatgaccgacacgacccctttcggccagcagcgggtgtttaaagaaaaggttgatacaagaacaccccgccctatgcccgggacacggaaagtgatggagatcaccgccgagtggctctggagaacgctgggacgcaacaagaaacctcggctttgcacaagagaagagttcaccaagaaggtccgcacaaatgcggccatgggcgctgtgtttaccgaagagaaccaatgggactctgccagagctgccgtcgaagatgaggagttctggaaactggtggaccgggaacgcgagctccacaagctggggaaatgtggaagctgcgtttataatatgatgggcaagagagagaagaaacttggggagtttggcaaagccaagggatcccgggcgatttggtacatgtggctgggcgctagatacctcgagttcgaagccctggggtttctgaacgaggatcattggttctctcgggaaaatagctattccggagtggagggcgaagggctccacaagctgggatacatccttcgcgacatctctaaaattcccggcggggccatgtatgctgatgacacggccggctgggacaccagaatcacagaggatgacctgcataacgaggaaaagattacccagcagatggatccggagcaccggcagctcgctaatgccatctttaaactgacataccaaaacaaggtcgtgaaagtgcagcgccctacccccaagggaacagttatggacattatcagcagaaaggatcagcggggctccggacaggtgggaacctatggccttaatacgttcacaaacatggaagcgcaactggtccgccagatggagggggaaggagtgctcagcaaagccgacctggagaatccccatctgctcgagaagaaaatcacccagtggctggaaaccaagggcgttgagagacttaaacggatggctatttctggggatgactgcgtggtcaagcctatcgatgaccgctttgccaacgctctgctcgccctgaacgatatgggcaaggtgagaaaagacattccgcagtggcaaccctccaagggatggcatgattggcagcaggtccctttctgtagccaccatttccacgaacttatcatgaaagacggccggaagctggtggttccctgccgccctcaggacgagctcattgggagagcgcggatctctcaaggagccggctggtccctgaaagaaacagcttgtctggggaaggcctacgctcagatgtggagcctcatgtattttcaccgcagagatctgcggcttgcctctaatgctatctgctccgccgtgcccgtccattggattcctaccagcagaacaacgtggtccatccacgcgcatcaccagtggatgaccacagaggacatgctgaccgtgtggaaccgcgtttggattgaggataatccctggatggaagacaagacaccggtgaccacgtgggaggatgtcccttacctcggaaaacgggaagaccaatggtgtggcagcctgatcgggcttacctctagagccacatgggctcagaacattctgaccgccatccaacaggtgcgcagcctcattggcgatgaggagttcctggactacatgccctccatgaagcggtttagaaaagaagaggaatctgagggagccatctggtga

SEQ ID NO: 20514 - RNA, 9873 nt, synthetic construct
  misc_feature 1..9873: note = derived and/or modified CDS sequence (opt5) from DENV-3__HM181933__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaaatctctcctgtttaagaccgcctccggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataaacttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgaccaagaaggaggagcccgtgaatattgaagctgagcctccgttcggcgaatctaacatcgttattgggatcggcgacaaagccctcaagattaattggtataagaaaggaagctccatcggcaagatgtttgaggccaccgctagaggggcgagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgctattaattggaagggaaaggaacttaaatgcggctccgggatcttcgtgaccaacgaggttcacacatggacggagcagtacaagtttcaagccgacagccccaaacggctcgcgaccgccattgctggcgcctgggaaaatggagtgtgtggcatcagatctacaacccgcatggagaacctgctgtggaagcagattgctaatgaactcaactatatcctgtgggagaataacatcaaacttacagtcgtggttggggatattatcggagtgctggaacagggcaagcggaccctcacgcctcagcccatggagctgaaatactcctggaagacctgggggaaggccaaaattgtcacagccgagacccaaaatagctctttcatcattgacggacctaacacacccgaatgcccgtccgctagcagagcgtggaacgtgtgggaggtggaagactatggctttggcgtcttcaccacaaatatctggctgaaacttcgcgaggtttacacccagtcctgtgatcatcggctcatgtctgccgctatcaaagacgaaagagccgtgcacgccgatatggggtactggattgagagccagaagaacggatcctggaaactggagaaggcttcttttatcgaagtgaagacgtgcacatggcctaaaagccacaccctgtggtccaatggcgtcctcgagagcgacatgattatccccaagtctctggccgggcctatttcccagcataaccaccgccccggatatcatacccaaacagcgggcccttggcaccttgggaaactggaactcgatttcaattactgcgagggaaccacggtggttatcacagagaactgtggcacccggagacccagcctgcgcacaaccacagtgtctggcaagctgatccacgaatggtgctgtcggtcctgcacccttccgcctctcagatatatgggggaggacggatgttggtacggcatggaaattcggcccatcaatgagaaagaagagaacatggtcaagagcctggtgtctgctgggagcggaaaggttgataattttacgatgggcgtgctgtgcctcgccattctgttcgaggaagtcatgcgcgggaaattcggaaagaaacatatgatcgccggcgtgctttttaccttcgttctgctcctgtccggccagattacatggagagacatggctcacaccctgatcatgattgggagcaacgcctctgatcggatgggaatgggcgtgacatatcttgcgctgatcgctacctttaagatccagcccttcctcgccctggggtttttcctcagaaaactgacgtcccgcgagaatcttctgctcggagtcggcctggccatggctacaaccctgcaacttcctgaagacattgagcagatggccaacgggatcgctctgggactcatgacactgaagctcattacccagtttgaaacctaccagctgtggacagcccttgtgagcctgacgtgttccaataccatcttcacactcaccgtggcgtggcggacagccaccctgattctggctggcgtctctcttctgccgctctgccaaagctcctctatgagaaagacggattggctgcccatgacagttgccgctatgggcgtgcctcccctccctctgtttatcttcagccttaaagacacccccaagcgcagatcctggcctctgaacgagggggtgatggccgtcggactggtgtctatcctcgccagctccctgcttcggaatgatgttcccatggctggcccgctggtggccgggggactcctgattgcctgttatgtcatcaccggcacaagcgctgacctcaccgtggagaaagccgccgacgttacatgggaagaggaagctgagcagacgggggtgtctcataacctgatgattaccgtcgatgacgatggaacaatgcgcatcaaggacgatgaaaccgagaacattcttacagtgctgctgaaaaccgccctcctgatcgtctccggcatctttccttacagcattcccgcgacgcttctggtgtggcacacctggcagaagcagacacaaagatctggcgttctctgggacgtgccttctcccccggagacccagaaagctgaactggaggaaggggtctaccggatcaagcagcagggaattttcggcaagacacaagtgggggttggagtgcagaaagagggcgtctttcataccatgtggcacgtgacacgcggggccgtgctcacgcacaatggaaagagactggagcctaactgggccagcgttaaaaaggatcttatcagctatggcggcgggtggcggctgaatgctcagtggcaaaaaggagaagaggtccaggtgattgccgtggaacccggcaagaaccctaagaatttccagaccatgcccgggatcttccagacaaccaccggagagattggcgcgatcgctctggactttaaacccgggacatccggaagccctatcattaaccgcgaaggcaaggtcgtgggcctctacgggaatggagttgtgacgaaaaacggcgggtatgtctccggaatcgcccaaaccaatgccgagccggatggccccacacctgagctggaagaggaaatgttcaagaaaagaaaccttaccattatggacctgcatcccgggagcggcaagacacggaagtacctccctgctatcgtgcgcgaggccattaaaagacggctgagaaccctcatcctggctcccacgcgcgttgtggccgcggaaatggaggaggcccttaagggactgcctatccggtatcagacaaccgctaccaaatctgaacacacaggcagagagattgtcgatctgatgtgccatgccacctttacaatgcgcctcctgagcccggtgcgggttcccaattacaaccttgtgatcatggacgaagctcacttcaccgatcctgcctccattgccgctagagggtatatctctacgcgcgtcggaatgggcgaggcggccgctatttttatgacagccacaccccctgggacagccgaggctttcccccagagcaatgccccgatccaggacgaggagcgggacatccctgaaagatcctggaactctggaaatgagtggattaccgattttgtgggcaagacggtgtggttcgtccccagcatcaaagcggggaacgacattgctaactgtctgcgcaagaatggcaagaaagttatccaactctcccggaagacctttgatacagaataccagaaaaccagactgaacgactgggatttcgtggtgacaaccgacatttctgagatgggagccaattttaaggccgatcgggtcatcgacccccgcagatgcctgaaacctgtgattctcacagatggccccgagcgggttatccttgctgggcctatgccggtgaccgccgcgagcgccgctcagcgcagaggacgggtcggcagaaacccccagaaggaaaatgaccaatacatcttcacggggcagcctctgaacaatgatgaggaccatgcccactggacagaagctaagatgctgctcgacaacattaatacccccgagggaatcattcctgccctgttcgaacccgagcgcgagaaatccgctgccatcgatggcgaatatcggcttaagggggagagcagaaaaacctttgtggaactgatgcgccggggcgacctcccggtttggctggcgcacaaggtggcctctgagggaattaaatacacagatagaaagtggtgcttcgacggcgaacgcaacaatcagatcctggaggagaacatggatgtcgaaatctggaccaaagagggggaacggaagaagctcagacctcgctggcttgacgctagaacatattccgatcccctggccctgaaagagtttaaggacttcgctgccggacggaaaagcattgccctcgatctggtgacggaaatcggccgcgtcccttctcatcttgctcacagaacccggaatgcgctggacaacctcgtgatgctgcatacatccgagcacgggggacgcgcctacagacacgctgttgaggaactgcccgagaccatggaaacactccttctgctgggcctcatgattctgcttaccggcggggccatgctgtttctcatcagcggaaagggcattgggaaaacgtccatcggactgatctgtgtgattgtgtctagcggcatgctgtggatggccgatgtccctctccagtggatcgcttccgccattgttcttgagttctttatgatggtgctgctgatccccgagccggaaaagcaacggacccctcaggacaatcagctcgcgtatgtggtcattgggatcctgacacttgccgctattgtggccgctaacgagatgggactgctcgaaaccacaaagagagatctgggcatgagcaaagagcccggcgttgtgtctcccacctcctacctggacgtcgacctccatcctgccagcgcgtggacgctttatgccgtggctacaaccgtcatcacaccgatgctgcgccacaccatcgaaaattctaccgccaacgtgagcctggctgccattgctaaccaagccgttgtgctcatggggctggataagggatggcccatctccaaaatggaccttggcgtccctctgctcgcgctggggtgctactctcaggtgaatcccctgacactcacggccgctgttcttctgctggtgacccattacgccattatcggacctggcctccaggctaaggccacacgggaggcccagaaaagaaccgcggctgggattatgaagaaccccacagtcgatggaatcatgaccatcgacctggatcctgtgatttatgacagcaagttcgagaaacaacttggccaggtgatgctgctcgttctgtgtgccgtccagctgctccttatgcgcacgtcctgggctctgtgcgaagccctgacactcgccaccggcccgatcaccacactgtgggaggggtctcccggaaagttttggaataccacaattgctgtgagcatggccaacatcttccggggctcctaccttgcgggggccggactggcttttagcattatgaaatctgtgggcacggggagacggggaaccggctcccagggcgaaacactcggggagaagtggaaaaagaagctgaatcaactgagccgcaaagagttcgatctctataagaaatccggaatcaccgaggtcgacagaacagaggccaaggaaggccttaaacgcggggaaaccacgcaccatgctgtttctcggggaagcgccaagctgcagtggtttgtggaaagaaacatggtgatccctgagggccgggtcattgatctggggtgtggacgcggcggctggtcctactattgcgcggggctcaaaaaggtgaccgaagttagaggatacacaaagggcgggcccggacacgaggagcctgtgcccatgtctacctatggctggaatatcgtcaaactgatgagcgggaaggacgtgttctaccttccgcctgaaaaatgtgatacactgctctgcgacattggagagtccagcccctctcccaccgttgaagagtcccggacaatccgcgtgctgaagatggtcgagccttggctgagaaacaatcagttctgtattaaagtgctcaacccctacatgcctaccgtgatcgaacaccttgagcggctgcagagaaagtatggcggcatgctggtccgcaatccgctcagccggaactctacgcatgaaatgtactggatttccaatgggacaggaaacatcgttagctctgtgaatatggtgagcagactgcttctgaaccgctttaccatgacccaccggagacccacaatcgagaaggatgtcgacctcggcgccgggacgcgccatgtgaacgctgaacctgagacccccaatatggacgttattggagagcggatcaaaagaattaaggaagaacactcctctacatggcactatgatgacgaaaacccttacaaaacctgggcctatcatggcagctacgaggtgaaggctacagggtccgccagctccatgatcaatggagtcgtgaaactgctgaccaagccctgggatgttgtgccgatggtcacacaaatggctatgaccgacacgacccctttcggccagcagcgcgtgtttaaggaaaaagttgatacacggacccccagacctatgcccggcacacgcaaggtgatggagattaccgccgagtggctctggcggacgctggggagaaacaaaaagcctcgcctttgcacaagagaagagttcaccaaaaaggtccggacaaatgcggccatgggagctgtgtttaccgaagagaaccaatgggactctgcccgcgctgccgtcgaagatgaggagttctggaagctggtggacagagaacgggagctccacaaactgggcaagtgtgggagctgcgtttataatatgatgggaaaaagagaaaagaaacttggcgagtttgggaaggccaaaggctcccgggcgatctggtacatgtggctgggagctcgctacctcgagttcgaagccctgggctttctgaacgaggatcattggttctctagagaaaatagctattccggggtggagggagaaggcctccacaagctggggtacatccttcgggacatttctaagatccccggaggcgccatgtatgctgatgacacggccgggtgggacacccgcattacagaggatgacctgcataacgaggagaagatcacccagcagatggatccggagcacagacagctcgctaatgccatttttaagctgacataccaaaacaaagtcgtgaaggtgcagcggcctacccccaaaggcacagttatggacatcatcagccgcaaggatcagagaggatccggccaggtggggacctatggacttaatacgttcacaaacatggaagcgcaactggtccggcagatggagggcgaaggggtgctcagcaaggccgacctggagaatccccatctgctcgagaaaaagattacccagtggctggaaaccaaaggagttgagcgccttaagagaatggctatctctggcgatgactgcgtggtcaaacctattgatgaccggtttgccaacgctctgctcgccctgaacgatatggggaaggtgcgcaaggacatcccgcagtggcaaccctccaaaggctggcatgattggcagcaggtccctttctgtagccaccatttccacgaacttattatgaaggacggaagaaaactggtggttccctgccggcctcaggacgagctcatcggccgcgcgagaatctctcaaggggccggatggtccctgaaggaaacagcttgtctgggcaaagcctacgctcagatgtggagcctcatgtattttcaccggagagatctgcgccttgcctctaatgctatttgctccgccgtgcccgtccattggatccctaccagccggacaacgtggtccattcacgcgcatcaccagtggatgaccacagaggacatgctgaccgtgtggaacagagtttggatcgaggataatccctggatggaagacaagacaccggtgaccacgtgggaggatgtcccttacctcgggaagcgcgaagaccaatggtgtggaagcctgattggccttacctctcgggccacatgggctcagaacatcctgaccgccattcaacaggtgagaagcctcatcggggatgaggagttcctggactacatgccctccatgaaacgctttcggaaggaagaggaatctgagggcgccatctggtga

SEQ ID NO: 20515 - RNA, 9873 nt, synthetic construct
  misc_feature 1..9873: note = derived and/or modified CDS sequence (opt5) from DENV-3__JF295012__SS-prME
  source 1..9873: mol_type = other RNA
acctccctgtgcctcatgatgatgctgcccgccacacttgctttccacctgacgtcccgggacggagaacctcggatgatcgtggggaagaacgaacgcggaaagtctctcctgtttaagaccgccagcggcattaatatgtgtacccttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaacaaaaaggaactgctcgtgacatttaaaaatgcccatgctaagaagcaagaggttgtggtcctggggtcccaggaaggagcgatgcacaccgccctgacaggcgctaccgagatccagaacagcgggggcacctctattttcgccggacacctcaaatgtcggctgaagatggataaacttgaactgaagggcatgtcctacgccatgtgcctcaatacatttgtgctgaaaaaggaggttagcgagacgcagcatgggaccatcctgattaaggtggaatacaaaggagaggacgctccctgtaagatccctttctccacagaagatggccaagggaaagcccacaacggacgccttatcaccgcgaaccccgtcgtgacaaagaaagaggagcccgtgaatattgaagctgagcctccgttcggcgaatctaacatcgttattgggatcggcgacaaggccctcaagattaattggtataaaaagggaagctccatcggcaaaatgtttgaggccaccgctagaggggcccggagaatggctatcctgggagatacggcctgggacttcggcagcgtcgggggagtgctgaactctctcggcaagatggtgcatcagatttttgggtccgcgtacacagccctgttcagcggcgtctcttggatcatgaaaattggaatcggcgtgcttctgacctggattgggctcaatagcaagaacacctccatgtcttttagctgcatcgttattggaatcatcacactgtatctgggcgctgtggtccaggccgatatggggtgtgtgattaattggaagggaaaagaacttaagtgcggctccgggatcttcgttaccaacgaggtgcacacatggacggagcagtacaaatttcaagctgacagccccaagcgcctcgccaccgcgattgccggcgcttgggaaaatggagtctgtggcatccggtctacaaccagaatggagaacctgctgtggaaacagattgccaatgaactcaactatatcctgtgggagaataacatcaaacttacagtggttgtgggggatattatcggagtcctggaacagggcaaacgcaccctcacgcctcagcccatggagctgaagtactcctggaagacctgggggaaagctaagattgtgacagccgagacccaaaatagctctttcatcattgacggacctaacacacccgaatgcccgtccgccagccgggcttggaacgtgtgggaggtcgaagactatggctttggcgttttcaccacaaatatctggctgaaacttagagaggtgtacacccagtcctgtgatcatcgcctcatgtctgcggccatcaaggacgaacgggctgtgcacgccgatatggggtactggattgagagccagaaaaacggatcctggaagctggagaaggcctcttttatcgaagtcaaaacgtgcacatggcctaagagccacaccctgtggtccaatggcgtgctcgagagcgacatgattatccccaaatctctggctgggcctatttcccagcataaccacagacccggatatcatacccaaacagccggcccttggcaccttgggaagctggaactcgatttcaattactgcgagggaaccacggttgtgatcacagagaactgtggcacccgcggccccagcctgcggacaaccacagtctctgggaaactgatccacgaatggtgctgtagatcctgcacccttccgcctctccgctatatgggagaggacggctgttggtacgggatggaaattcggcccatcaatgagaaggaagagaacatggttaagagcctggtgtctgcgggaagcggcaaagtggataattttacgatgggggtcctgtgcctcgctattctgttcgaggaagtgatgagaggaaagttcggcaaaaagcatatgatcgccggcgttctttttaccttcgtgctgctcctgtccgggcagattacatggcgggacatggcccacaccctgatcatgattggaagcaacgcttctgatcgcatgggcatgggggtcacatatcttgccctgatcgcgacctttaaaatccagcccttcctcgctctgggatttttcctcagaaagctgacgtcccgggagaatcttctgctcggcgtggggctggccatggccacaaccctgcaacttcctgaagacattgagcagatggctaacggaatcgccctgggcctcatgacactgaagctcattacccagtttgaaacctaccagctgtggacagctcttgtgagcctgacgtgttccaataccatcttcacactcaccgtcgcctggagaacagcgaccctgattctggccggcgtttctcttctgccgctctgccaaagctcctctatgcgcaaaacggattggctgcccatgacagtggctgccatgggggtgcctcccctccctctgtttatcttcagccttaaggacacccccaaacggagatcctggcctctgaacgagggagtcatggctgtgggcctggtttctatcctcgccagctccctgcttcgcaatgatgtgcccatggccgggccgctggtcgctggaggcctcctgattgcgtgttatgtgatcaccgggacaagcgccgacctcaccgttgagaaggctgccgacgtgacatgggaagaggaagccgagcagacgggagtctctcataacctgatgattaccgtggatgacgatggcacaatgagaatcaaagacgatgaaaccgagaacattcttacagtcctgctgaagaccgctctcctgatcgtgtccggcatctttccttacagcattcccgccacgcttctggtttggcacacctggcagaaacagacacaacggtctggggtgctctgggacgtcccttctcccccggagacccagaaggcggaactggaggaaggagtgtaccgcatcaagcagcagggcattttcgggaaaacacaagttggagtgggcgtccagaaggagggggtgtttcataccatgtggcacgtgacaagaggagctgttctcacgcacaatggcaaacggctggagcctaactgggccagcgtcaagaaagatcttatcagctatggcgggggatggcgcctgtccgcccagtggcaaaagggcgaagaggtccaggtgattgctgtcgaacccgggaagaatcctaaaaacttccagaccatgcccggaatcttccagacaaccaccggcgagattggggccatcgcgctggactttaagcccggaacaagcggctcccctatcattaatagagaaggcaaagtggttgggctctacggaaacggcgtggtcacgaagaatgggggatatgtgagcggcatcgctcaaaccaacgccgagccggatgggcccacacctgagctggaagaggaaatgttcaaaaagcggaatcttaccattatggacctgcatcccggctctggaaagacacgcaaatacctccctgccatcgttagagaggctattaagcggcgcctgagaaccctcatcctggcccccacgcgggtggtcgctgccgaaatggaggaggcgcttaaaggcctgcctatcagatatcagacaaccgccaccaagagcgaacacacagggcgcgagattgtggatctgatgtgccatgctacctttacaatgcggctcctgtccccggttagagtgcccaactacaatcttgtcatcatggacgaagcccacttcaccgatcctgcttctattgccgcccgcggatatatcagcacgcgggtgggcatgggggaggctgcggccatttttatgacagctacaccccctggaacagccgacgccttcccccagtccaacgctccgatccaggacgaagagagagatatccctgagcgctcttggaatagcggcaacgaatggattaccgactttgccgggaaaacggtgtggttcgtcccctccatcaaggcgggcaatgatattgctaactgtctgcggaagaacggcaagaaggttatccaactctctagaaaaacctttgacacagagtaccagaagaccaaactgaatgattgggacttcgtggtgacaaccgatattagcgaaatgggcgccaactttaaggccgaccgcgtcatcgatccccggagatgcctgaagcctgtgattctcacagacgggcccgagcgggttatccttgctggacctatgccggtgaccgccgcgtccgccgctcagcgcagaggccgggtcgggcgcaatccccagaaagagaacgatcaatacatcttcacgggacagcctctgaataacgacgaagaccatgcccactggacagaggctaagatgctgctcgataatattaacacccccgaaggcatcattcctgccctgttcgagcccgaaagagagaaaagcgctgccatcgacggggagtatcggcttaagggcgaatctagaaaaacctttgtggagctgatgcgccggggagatctcccggtttggctggcgcacaaggtggcctccgaaggcattaaatacacagacagaaagtggtgcttcgatggggagcgcaataaccagatcctggaagagaatatggacgtcgagatctggaccaaggaaggagagcggaaaaagctcagacctcgctggcttgatgctcggacatatagcgaccccctggccctgaaagaatttaaggatttcgctgccggcagaaaatctattgccctcgacctggtgacggagatcgggcgcgtcccttcccatcttgctcacagaacccggaacgcgctggataatctcgtgatgctgcatacaagcgaacacggaggccgcgcctacagacacgctgttgaggagctgcccgaaaccatggagacactccttctgctgggcctcatgattctgcttaccgggggagccatgctgtttctcatctccggcaaggggattggaaagacgtctatcggcctgatctgtgtgattgtgagctccgggatgctgtggatggccgacgtccctctccagtggatcgctagcgccattgttcttgagttctttatgatggtgctgctgatccccgagccggagaaacaacggacccctcaggataaccagctcgcgtatgtggtcattggaatcctgacacttgccgctattgtggccgctaatgaaatgggcctgctcgagaccacaaagcgcgacctgggcatgtctaaagaacccggggttgtgtcccccaccagctacctggacgtcgatctccatcctgcctctgcgtggacgctttatgccgtggctacaaccgtcatcacaccgatgctgagacacaccatcgagaacagcaccgccaatgtgtccctggctgccattgctaaccaagccgttgtgctcatgggactggacaagggctggcccatctctaaaatggatcttggggtccctctgctcgcgctgggatgctacagccaggtgaaccccctgacactcacggccgctgttcttctgctggtgacccattacgccattatcggccctgggctccaggctaaggccacacgggaagcccagaagagaaccgcggctggaattatgaaaaatcccacagtcgacggcatcatgaccatcgatctggaccctgtgatttatgattccaagttcgagaaacaacttggccaggtgatgctgctcgttctgtgtgccgtccagctgctccttatgcgcacgtcttgggctctgtgcgaggccctgacactcgccaccgggccgatcaccacactgtgggaaggaagccccggcaagttttggaacaccacaattgctgtgtccatggccaatatcttccgggggagctaccttgcgggagccggcctggctttttctattatgaaatccgtggggacgggaagacgcggcaccggcagccagggggagacactcggagaaaagtggaagaaaaagctgaaccaactgtcccggaaagagttcgacctctataagaaatctggcatcaccgaagtcgatagaacagaggccaaggaggggcttaaacggggagaaaccacgcaccatgctgttagccgcggctccgccaagctgcagtggtttgtggagagaaatatggtgatccctgaagggcgggtcattgacctgggatgtggccgcggcgggtggtcttactattgcgcgggactcaagaaagtgaccgaggttagaggctacacaaaaggcgggcccgggcacgaagaacctgtgcccatgagcacctatgggtggaacatcgtcaaactgatgtccggaaaggatgtgttctaccttccgcctgagaaatgtgacacactgctctgcgatattggcgaaagctctccctcccccaccgttgaggaaagccggacaatccgcgtgctgaagatggtcgagccttggctgagaaataaccagttctgtattaaggtgctcaatccctacatgcctaccgtgatcgagcaccttgaacggctgcagcgcaaatatggcgggatgctggtcagaaacccgctctctagaaattccacgcatgagatgtactggattagcaacggaacaggcaatatcgtttctagcgtgaacatggtgtccagactgcttctgaatcgctttaccatgacccaccggagacccacaatcgaaaaggacgtcgacctcggggccggaacgcgccatgtgaacgctgagcctgaaacccccaacatggatgttattggcgagcggatcaaaagaattaaggaggaacactctagcacatggcactatgacgatgagaatccttacaaaacctgggcctatcatgggtcctacgaagtgaaggctacaggaagcgcctcctctatgatcaacggcgtcgtgaagctgctgaccaaaccctgggacgttgtgccgatggtcacacaaatggctatgaccgatacgacccctttcggccagcagcgcgtgtttaaggagaaagttgacacacggacccccagacctatgcccgggacacgcaaggtgatggaaattaccgccgagtggctctggcggacgctgggaagaaataaaaagcctcgcctttgcacacgggaggagttcaccaagaaagtcagaacaaacgcggccatgggcgctgtgtttaccgaggaaaatcaatgggatagcgcccgcgctgccgtcgaggacgaagagttctggaagctggtggatagagagcgggaactccacaaactggggaagtgtggatcctgcgtttataacatgatgggcaaacgcgagaagaaacttggggaatttggcaaggccaagggatctagagcgatctggtacatgtggctgggcgctcggtacctcgagttcgaggccctggggtttctgaatgaagaccattggttcagcagagagaactcctattctggagtggaaggcgaggggctccacaaactgggatacatccttcgggatattagcaagatccccggcggggccatgtatgctgacgacacggccggctgggatacccgcattacagaagacgatctgcataatgaggagaaaatcacccagcagatggacccggaacacagacagctcgctaacgccatttttaagctgacataccaaaataaagtcgtgaaggtgcagcggcctacccccaagggaacagttatggatatcatctcccgcaaagaccagagaggcagcggacaggtgggaacctatggccttaacacgttcacaaatatggaggcgcaactggtccggcagatggaaggggagggagtgctctctaaggccgatctggaaaacccccatctgctcgagaaaaagattacccagtggctggagaccaaaggcgttgaacgccttaagagaatggctatctccggggacgattgcgtggtcaagcctattgacgatcggtttgccaatgctctgctcgccctgaacgacatgggcaaagtgcgcaaggatatcccgcagtggcaacccagcaaaggatggcatgactggcagcaggtccctttctgttctcaccatttccacgagcttattatgaaggacggcagaaaactggtggttccctgccggcctcaggatgaactcatcgggcgcgcgagaatctcccaaggagccggctggagcctgaaggagacagcttgtctggggaaggcctacgctcagatgtggtctctcatgtattttcaccggcgcgacctgagacttgcctccaacgctatttgcagcgccgtgcccgtccattggatccctacctcccggacaacgtggagcattcacgcgcatcaccagtggatgaccacagaagatatgctgaccgtgtggaatagagtttggatcgaggacaacccctggatggaggataaaacaccggtgaccacgtgggaagacgtcccttacctcggaaagcgcgaggatcaatggtgtggctctctgattgggcttaccagccgggccacatgggctcagaatatcctgaccgccattcaacaggtgagatccctcatcggcgacgaagagttcctggattacatgccctctatgaaacgctttcggaaggaggaagagagcgaaggagccatctggtga

SEQ ID NO: 20516 - RNA, 9873 nt, synthetic construct
  misc_feature 1..9873: note = derived and/or modified CDS sequence (opt5) from DENV-3__FJ898463__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcacagaaggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccagctggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgctccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtctgggaagtggaggactatggctttggcgtgttcaccacgaatatctggctcaaactgcgcgaagtctacacacagctgtgtgaccaccggcttatgagcgccgctgttaaggatgagagagccgtgcacgccgacatggggtactggattgagtcccagaaaaacggatcttggaagctcgaaaaagctagcctgatcgaggtgaagacctgcacctggcctaagtcccatacactgtggtctaatggcgtcctcgaaagcgatatgattatccccaaatccctggccgggcctattagccagcacaaccatcgccccggatatcacacccaaacggcgggcccttggcaccttgggaagctggagctcgactttaattactgcgagggaacaaccgtggttatcacagaaaactgtggcacccggggcccctctctgagaacaaccacggtgtccgggaaactgatccatgagtggtgctgtcgcagctgcacccttccgcctctccggtatatgggagaagatggctgttggtacgggatggagattagacccatctctgaaaaggaggagaatatggtcaaatccctggtgagcgctggatctggcaaggttgacaacttcacaatgggggtgctgtgcctcgccattctgtttgaagaggtcatgcggggaaagttcggcaaaaagcacatgatcgccggcgtgttctttaccttcgttcttctgctcagcgggcagattacatggcgcgatatggctcataccctgatcatgattggatccaatgccagcgacagaatgggcatgggggtgacgtatctggcgcttatcgctacatttaaaatccagcccttcctggccctcggatttttcctgcggaagctcacctctagagaaaacctgcttctgggcgtcgggctcgccatggctacaaccctgcaactgcctgaggatattgaacagatggccaatggaatcgctcttggcctgatggccctcaaactgattacccagtttgagacataccagctctggacggcgctgatctcccttacctgtagcaacacaatgttcaccctgacagtggcctggcgcaccgctacgctcattctggccggcgtgtccctgcttccggtctgccaatctagctccatgcggaagacagactggctgcccatggctgttgccgccatgggggtgcctcccctccctctgtttatcttctctctcaaggataccctgaaaagacgcagctggccccttaatgagggagtgatggctgtcggcctggtgtccatcctggcgtctagcctcctgagaaacgacgttcctatggccgggccccttgtggctggaggcctgctcattgcctgttatgtcatcaccgggacatccgccgatctgaccgtggaaaaggctgccgacattacatgggaggaagaggcggaacagacgggagttagccacaacctcatgatcaccgtggacgatgacggcacaatgcggattaaagatgacgagaccgagaatatcctgacagtccttctgaagaccgctctgctcatcgtgtctggcgtctttccgtactccattcctgccacgctgcttgtgtggcatacctggcagaaacagacacaacgcagcggggttctgtgggatgtgccctctcctcccgaaacccagaaggccgagctcgaagagggagtctacagaatcaaacagcagggcattttcgggaagacacaagtgggagttggcgtgcagaaggagggggtctttcacaccatgtggcacgtgacacggggagctgtgctgacgtataacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaatttccagaccatgcctggaacattccagaccaccacaggcgaaatcggggccattgccctggattttaagcccggaacgtccggcagccccatcatcaaccgggagggcaaagtcgtggggctgtatggaaatggcgttgtgaccaagaacgggggatacgtctccggcattgctcaaacaaatgccgagcctgacgggccgacccccgaactcgaggaagagatgttcaaaaagcgcaacctgacaatcatggatcttcatcctggcagcggaaaaaccagaaagtatctgcccgctattgtgcgggaagccatcaagcgcagactccggacgctgattctcgcgcctacaagagttgtggccgctgagatggaggaagccctgaaaggccttcccatccgctaccagaccaccgctacaaagtctgagcacaccgggcgggaaatcgtcgacctgatgtgccatgccacatttaccatgagactgctcagccctgtgcgcgttccgaattataacctgattatcatggatgaggcccacttcacggaccccgcttccattgcggcccggggatacatctctacaagagtgggcatgggggaagctgccgccatttttatgaccgctacacctcccggaaccgccgatgcgttccctcagagcaatgctcccatccaggacgaggagcgcgacatcccggaacggtcctggaactctggcaatgagtggattacggattttgccgggaaaaccgtctggttcgtgcctagcatcaaggccggcaacgacattgctaactgtcttcgcaaaaatggaaagaaggtgatccaactgtccagaaaaacatttgataccgaataccagaagacaaaactcaacgactgggatttcgtcgttaccacagacatttctgagatgggcgccaattttaaggcggatcgggtgatcgaccccagacggtgcctgaaacccgtgattctgaccgatgggcctgagcgcgtcatcctcgccggacccatgcctgtgacggctgccagcgctgcccagagacggggccgcgttgggagaaactcccagaaggaaaatgaccaatatatcttcacaggacagccgcttaacaatgatgaggaccatgctcactggaccgaagccaagatgctgctggacaacattaatacccccgagggcatcattcctgccctcttcgaacccgagcgggagaaaagcgccgctatcgatggggaatacagactgaagggcgagtctcgcaaaacatttgtggaacttatgcggagaggagacctgcctgtctggctcgcccacaaggtggcttccgagggcattaaatataccgatcgcaagtggtgcttcgacgggcagcggaacaatcagatcctggaagagaacatggatgttgagatctggacaaaagaaggagagaagaagaaactgagaccccgctggctcgacgcccggacgtacagcgatccgcttgccctgaaggaatttaaagacttcgctgcgggcagaaagtctattgccctggatctcgtgaccgagatcgggcgcgtcccttcccatctggctcacagaacacggaatgcccttgacaacctggtgatgctccataccagcgaacacggaggccgcgcctatagacacgctgtcgaggagctgcccgaaacaatggagaccctgctccttctgggcctgatgattctcctgacagggggagccatgctttttctgatctccggcaaagggattggaaagacctctatcggcctcatctgtgtgattgcgagctccgggatgctgtggatggccgaaatccctctgcaatggattgctagcgccatcgttctcgagttctttatgatggtgcttctgattcccgagcctgaaaagcagcggacaccccaggataatcaactggcttacgtggtcatcggcattctcaccctggccgcgatcatcgccgctaacgagatgggccttctggaaacaaccaaacgcgacctcggcatgtctaaggagccgggggttgtgtcccctacgagctatctggatgtggacctgcatcccgcctctgcttggacactctacgccgtcgctaccacagtgattacccccatgcttagacacaccatcgaaaatagcacagccaacgtttccctggcggccattgctaaccaggccgtggtcctgatgggactcgacaaaggctggcctatctctaagatggatctgggggtgccgcttctggctctcggatgctacagccaggtcaatcccctgacgctgaccgccgccgtgctccttctgattacacattatgcgatcatcggccctgggctgcaggctaaagccacccgggaggctcaaaagagaacagccgccggaattatgaagaaccccaccgttgacggcatcatgacgattgatctcgaccctgtgatctacgattccaaattcgagaagcagctgggccaggtcatgcttctggtgctctgtgctgttcagctgctgctcatgcgcacatcttgggccctttgcgaagcgctgaccctggccaccgggcccattacaaccctctgggagggaagccctggcaaattttggaatacaacgatcgctgtgtccatggccaacatcttccgggggagctatctggctggagccggccttgcgttttctattatgaagtccgtcgggaccggaaaaagaggcacaggcagccaaggggaaaccctgggagagaagtggaagaaaaagctcaatcagctgtcccgcaaagagttcgacctgtacaagaaatctggcatcacagaggtggatcggaccgaggccaaggaagggctcaaaagaggagagacgacccaccatgctgtgagccggggctccgccaaacttcagtggtttgttgaacgcaacatggtcattccggaggggagagtgatcgacctgggatgtggccggggcgggtggtcttattactgcgctggactgaagaaagtgacagaagtccgcggctataccaaagggggacccggccacgaggagcctgttcccatgagcacatacgggtggaatattgtgaaactcatgtccggaaaggatgtgttctacctgcctcccgaaaaatgtgacacccttctgtgcgatatcggcgagagctctccgtcccctacagtcgaagagagcagaaccattcgggtgctcaagatggttgagccctggctgaagaacaatcagttctgtatcaaagtgctgaacccctatatgcctacggtcatcgaacacctcgagcgccttcaaagaaagcatggcgggatgctggtgcggaatcccctgtctcgcaactccacacacgaaatgtactggattagcaatggaaccggcaacatcgttgcctctgtgaatatggtcagcagactcctgcttaaccggtttaccatgacacatagacgccctacgattgagaaagacgtggatctgggggctggaacccggcacgtgaacgccgaaccggagacacccaatatggacgtcatcggcgagagaattaagcgcatcaaagaagaacacaactccacctggcattatgacgatgaaaatccttacaagacatgggcgtatcacgggtcttacgaggttaaggccaccggaagcgcttccagcatgatcaacggcgtggtgaaactcctgacaaagccctgggacgtcgtgcctatggttacccagatggccatgacggataccacacccttcggccagcaacgggtgtttaaagaaaaggtcgacaccagaacaccgcgctccatgcctgggacccggagagtgatgggaattacggctgagtggctgtggacaaccctcggccgcaataaaaagccccggctgtgcacaagagaggagttcaccaagaaagttcgcacgaacgccgccatgggggcggtgtttaccgaggaaaatcagtgggattctgctaaggccgccgtcgaggacgaagatttctggaaacttgtggaccgggagagagagctgcataagctcggaaaatgtggcagctgcgtttataacatgatggggaagcgcgagaagaagctgggcgagtttggaaaggctaaaggctccagagccatctggtacatgtggcttggggctcggtacctggagttcgaggccctcggatttctgaatgaggatcactggttctctcgcgaaaacagctattccggcgtggagggggaaggactgcataagctcggctacattctgagagacatctctaaaattcctgggggcgcgatgtatgccgatgacacagctggatgggacacccggatcacagaggatgaccttcacaatgaagagaagatcacccagcagatggatcccgagcacagacaactggccaacgctatttttaaactcacataccagaataaggtcgtgaaggtccagcggcctacccccacgggcacagtgatggacatcattagccgcaaagatcagagagggtccggacaagttggcacctatgggctgaacaccttcacaaatatggaagcccagcttatccggcagatggagggagaaggcgtgctgagcaaggcggacctcgagaacccgcatctgcctgagaagaagattacccagtggctggagacaaaaggggtcgagcgcctcaagagaatggccatctctggcgatgactgcgtggtgaagcccatcgatgaccggtttgctaacgccctgcttgctctgaatgatatgggaaaagttcgcaaggacattccccaatggcagccttccaaaggctggcacgattggcaacaggtgccgttctgtagccatcacttccacgaactcatcatgaaggacgggagaaaactggtcgtgccctgccggcctcaagacgagcttattggacgcgccagaatctctcagggcgctgggtggtccctgcgggaaacggcctgtctcggaaaggcgtacgcccagatgtggagcctgatgtattttcatcgcagagatctgcggctcgcttctaacgccatttgctccgccgttcccgtgcactgggtccctaccagccgcacaacctggtccatccatgctcaccatcaatggatgacaaccgaggacatgctgacggtgtggaatagagtctggattgaagataacccctggatggaggacaagacccctgtgacaacctgggagaatgttccctaccttggcaaacgggaagatcagtggtgtgggagcctgatcggcctcacatctagagccacctgggcgcagaacatcccgacggctattcagcaagtgcgcagcctgatcggaaatgaggagttccttgactacatgccttccatgaagcggtttagaaaagaggaggaatctgagggcgccatttggtga

SEQ ID NO: 20517 - RNA, 9873 nt, synthetic construct
  misc_feature 1..9873: note = derived and/or modified CDS sequence (opt5) from DENV-3__GQ868616__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcacagaaggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccagctggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgctccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtctgggaagtggaggactatggctttggcgtgttcaccacgaatatctggctcaaactgcgcgaagtctacacacagctgtgtgaccaccggcttatgagcgccgctgttaaggatgagagagccgtgcacgccgacatggggtactggattgagtcccagaaaaacggatcttggaagctcgaaaaagctagcctgatcgaggtgaagacctgcacctggcctaagtcccatacactgtggtctaatggcgtcctcgaaagcgatatgattatccccaaatccctggccgggcctattagccagcacaaccatcgccccggatatcacacccaaacggcgggcccttggcaccttgggaagctggagctcgactttaattactgcgagggaacaaccgtggttatcacagaaaactgtggcacccggggcccctctctgagaacaaccacggtgtccgggaaactgatccatgagtggtgctgtcgcagctgcacccttccgcctctccggtatatgggagaagatggctgttggtacgggatggagattagacccatctctgaaaaggaggagaatatggtcaaatccctggtgagcgctggatctggcaaggttgacaacttcacaatgggggtgctgtgcctcgccattctgtttgaagaggtcatgcggggaaagttcggcaaaaagcacatgatcgccggcgtgttctttaccttcgttcttctgctcagcgggcagattacatggcgcgatatggctcataccctgatcatgattggatccaatgccagcgacagaatgggcatgggggtgacgtatctggcgcttatcgctacatttaaaatccagcccttcctggccctcggatttttcctgcggaagctcacctctagagaaaacctgcttctgggcgtcgggctcgccatggctacaaccctgcaactgcctgaggatattgaacagatggccaatggaatcgctcttggcctgatggccctcaaactgattacccagtttgagacataccagctctggacggcgctgatctcccttacctgtagcaacacaatgttcaccctgacagtggcctggcgcaccgctacgctcattctggccggcgtgtccctgcttccggtctgccaatctagctccatgcggaagacagactggctgcccatggctgttgccgccatgggggtgcctcccctccctctgtttatcttctctctcaaggataccctgaaaagacgcagctggccccttaatgagggagtgatggctgtcggcctggtgtccatcctggcgtctagcctcctgagaaacgacgttcctatggccgggccccttgtggctggaggcctgctcattgcctgttatgtcatcaccgggacatccgccgatctgaccgtggaaaaggctgccgacattacatgggaggaagaggcggaacagacgggagttagccacaacctcatgatcaccgtggacgatgacggcacaatgcggattaaagatgacgagaccgagaatatcctgacagtccttctgaagaccgctctgctcatcgtgtctggcgtctttccgtactccattcctgccacgctgcttgtgtggcatacctggcagaaacagacacaacgcagcggggttctgtgggatgtgccctctcctcccgaaacccagaaggccgagctcgaagagggagtctacagaatcaaacagcagggcattttcgggaagacacaagtgggagttggcgtgcagaaggagggggtctttcacaccatgtggcacgtgacacggggagctgtgctgacgtataacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaatttccagaccatgcctggaacattccagaccaccacaggcgaaatcggggccattgccctggattttaagcccggaacgtccggcagccccatcatcaaccgggagggcaaagtcgtggggctgtatggaaatggcgttgtgaccaagaacgggggatacgtctccggcattgctcaaacaaatgccgagcctgacgggccgacccccgaactcgaggaagagatgttcaaaaagcgcaacctgacaatcatggatcttcatcctggcagcggaaaaaccagaaagtatctgcccgctattgtgcgggaagccatcaagcgcagactccggacgctgattctcgcgcctacaagagttgtggccgctgagatggaggaagccctgaaaggccttcccatccgctaccagaccaccgctacaaagtctgagcacaccgggcgggaaatcgtcgacctgatgtgccatgccacatttaccatgagactgctcagccctgtgcgcgttccgaattataacctgattatcatggatgaggcccacttcacggaccccgcttccattgcggcccggggatacatctctacaagagtgggcatgggggaagctgccgccatttttatgaccgctacacctcccggaaccgccgatgcgttccctcagagcaatgctcccatccaggacgaggagcgcgacatcccggaacggtcctggaactctggcaatgagtggattacggattttgccgggaaaaccgtctggttcgtgcctagcatcaaggccggcaacgacattgctaactgtcttcgcaaaaatggaaagaaggtgatccaactgtccagaaaaacatttgataccgaataccagaagacaaaactcaacgactgggatttcgtcgttaccacagacatttctgagatgggcgccaattttaaggcggatcgggtgatcgaccccagacggtgcctgaaacccgtgattctgaccgatgggcctgagcgcgtcatcctcgccggacccatgcctgtgacggctgccagcgctgcccagagacggggccgcgttgggagaaactcccagaaggaaaatgaccaatatatcttcacaggacagccgcttaacaatgatgaggaccatgctcactggaccgaagccaagatgctgctggacaacattaatacccccgagggcatcattcctgccctcttcgaacccgagcgggagaaaagcgccgctatcgatggggaatacagactgaagggcgagtctcgcaaaacatttgtggaacttatgcggagaggagacctgcctgtctggctcgcccacaaggtggcttccgagggcattaaatataccgatcgcaagtggtgcttcgacgggcagcggaacaatcagatcctggaagagaacatggatgttgagatctggacaaaagaaggagagaagaagaaactgagaccccgctggctcgacgcccggacgtacagcgatccgcttgccctgaaggaatttaaagacttcgctgcgggcagaaagtctattgccctggatctcgtgaccgagatcgggcgcgtcccttcccatctggctcacagaacacggaatgcccttgacaacctggtgatgctccataccagcgaacacggaggccgcgcctatagacacgctgtcgaggagctgcccgaaacaatggagaccctgctccttctgggcctgatgattctcctgacagggggagccatgctttttctgatctccggcaaagggattggaaagacctctatcggcctcatctgtgtgattgcgagctccgggatgctgtggatggccgaaatccctctgcaatggattgctagcgccatcgttctcgagttctttatgatggtgcttctgattcccgagcctgaaaagcagcggacaccccaggataatcaactggcttacgtggtcatcggcattctcaccctggccgcgatcatcgccgctaacgagatgggccttctggaaacaaccaaacgcgacctcggcatgtctaaggagccgggggttgtgtcccctacgagctatctggatgtggacctgcatcccgcctctgcttggacactctacgccgtcgctaccacagtgattacccccatgcttagacacaccatcgaaaatagcacagccaacgtttccctggcggccattgctaaccaggccgtggtcctgatgggactcgacaaaggctggcctatctctaagatggatctgggggtgccgcttctggctctcggatgctacagccaggtcaatcccctgacgctgaccgccgccgtgctccttctgattacacattatgcgatcatcggccctgggctgcaggctaaagccacccgggaggctcaaaagagaacagccgccggaattatgaagaaccccaccgttgacggcatcatgacgattgctctcgatcctgtgatctacgactccaaattcgagaagcagctgggccaggtcatgcttctggtgctctgtgccgttcagctgctgctcatgcgcacatcttgggcgctttgcgaagccctgaccctggctaccgggcccattacaaccctctgggagggaagccctggcaaattttggaatacaacgatcgccgtgtccatggctaacatcttccgggggagctatctggccggagcgggccttgccttttctattatgaagtccgtcgggaccggaaaaagaggcacaggcagccaaggggaaaccctgggagagaagtggaagaaaaagctcaatcagctgtcccgcaaagagttcgatctgtacaagaaatctggcatcacagaggtggaccggaccgaggctaaggaagggctcaaaagaggagagacgacccaccatgccgtgagccggggctccgctaaacttcagtggtttgttgaacgcaacatggtcattccggaggggagagtgatcgatctgggatgtggccggggcgggtggtcttattactgcgccggactgaagaaagtgacagaagtccgcggctataccaaagggggacccggccacgaggagcctgttcccatgagcacatacgggtggaatattgtgaaactcatgtccggaaaggacgtgttctacctgcctcccgaaaaatgtgatacccttctgtgcgacatcggcgagagctctccgtcccctacagtcgaagagagcagaaccattcgggtgctcaagatggttgagccctggctgaagaacaatcagttctgtatcaaagtgctgaacccctatatgcctacggtcatcgaacacctcgagcgccttcaaagaaagcatggcgggatgctggtgcggaatcccctgtctcgcaactccacacacgaaatgtactggattagcaatggaaccggcaacatcgttgcttctgtgaatatggtcagcagactcctgcttaaccggtttaccatgacacatagacgccctacgattgagaaagatgtggacctgggggccggaacccggcacgtgaacgcggaaccggagacacccaatatggatgtcatcggcgagagaattaagcgcatcaaagaagaacacaactccacctggcattatgacgacgaaaatccttacaagacatgggcctatcacgggtcttacgaggttaaggctaccggaagcgcctccagcatgatcaacggcgtggtgaaactcctgacaaagccctgggatgtcgtgcctatggttacccagatggctatgacggacaccacacccttcggccagcaacgggtgtttaaagaaaaggtcgataccagaacaccgcgctccatgcctgggacccggagagtgatgggaattacgcccgagtggctgtggcgccctctcggccggaataaaaagcccagactgtgccctcgcgaggagttcacaaagaaagttcggaccaacgcccccatgggggccgtgtttacagaggaaacccagtgggcgtctgctaaggccgccgtcgaggacgaagatttctggaaacttgtggacagagagcgcgagctgcataagctcggaaaatgtggcagctgcgtttataatatgatggggaagagagagaagaagctgggcgagtttggaaaggctaaaggctcccgggccatctggtacatgtggcttggggctcgctacctggagttcgaggccctcggatttctgaacgaggatcactggttctctagagaaaatagctattccggcgtggagggggaaggactgccgaagctcggctacattctgcgggacatctctaaaattcctgggggcgcgatgtatgccgatgacacggctggatgggataccagaatcacagaggacgaccttcataacgaagagaagatcacccagcagatggatcccgagcaccggcaactggccaatgctatttttaaactcacataccagaacaaggtcgtgaaggtccagcgccccacccctacaggcaccgtgatggacatcattagcagaaaagatcagcgggggtccggacaagttggcacgtatgggctgaatacattcaccaacatggaagcccagcttatccgccagatggagggagaaggcgtgctgagcaaggcggacctcgagaatccgcatctgcccgagaagaagattacccagtggctggagacaaaaggggtcgagagactcaagcggatggccatctctggcgatgactgcgtggtgaagcctatcgatgaccgctttgctaacgccctgcttgctctgaacgatatgggaaaagttagaaaggacattccccaatggcagccttccaaaggctggcatgattggcaacaggtgcccttctgtagccaccatttccacgaactcatcatgaaggacgggcggaaactggtcgtgccttgccgcccccaagatgagcttattggacgggcccggatctctcagggcgctgggtggtccctgcgcgaaaccgcctgtctcggaaaggcgtacgcccagatgtggagcctgatgtattttcacagacgggacctgcgcctcgcttctaatgccatttgctccgccgttccggtgcattgggtccctacaagcagaacgacctggtccatccacgctcatcaccaatggatgacaaccgaggacatgctgacagtgtggaaccgggtctggattgaagataatccctggatggaggacaagacccctgtgacgacctgggagaacgttccctaccttggcaaaagagaagatcagtggtgtgggagcctgatcggcctcacatctcgcgccacctgggcgcagaatatcccgacagctattcagcaagtgcggagcctgatcggaaacgaggagttccttgactacatgccttccatgaagagatttcgcaaagaggaggaatctgagggcgccatttggtga

SEQ ID NO: 20518 - RNA, 9873 nt, synthetic construct
  misc_feature 1..9873: note = derived and/or modified CDS sequence (opt5) from DENV-3__GQ199887__SS-prME
  source 1..9873: mol_type = other RNA
acctccctgtgcctcatgatgatcctgcccgctgctcttgccttccacctgacgtcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcatacaggggaccagcaccaggttggaaacgagacgcaaggcgtgaccgctgaaattacaccccaggcctccaccacagaggctatcctgcctgaatatggcaccctggggctcgagtgcagcccccgcacgggactggacttcaatgagatgattcttctgaccatgaaaaacaaggcctggatggtccatagacagtggtttttcgatctccctctgccctggacatctggcgccaccacagaaaccccgacgtggaatcggaaagagcttctggtgacatttaagaacgctcacgcgaaaaagcaagaagtcgtggttctcgggtcccaggagggagccatgcacaccgctctgacaggcgccaccgaaatccagaatagcgggggcacctctattttcgccggacatctgaagtgtcgcctcaaaatggacaagctggagcttaaaggcatgtcctacgctatgtgcacaaacacgtttgtgctgaagaaagaggtcagcgaaacccagcacgggacaatcctcgtgaaggttgagtacaagggagaagatgccccttgtaaaatccccttctccaccgaggacggccaagggaaggcgcataacggaagactgattacagctaatcctgtggtcaccaaaaaggaggaacccgtgaacatcgaggccgaaccccctttcggcgagtctaatattgtgatcgggattggcgataacgccctgaaaatcaattggtataagaagggaagctccatcggcaaaatgtttgaagctacggccagaggggctagacgcatggccattcttggagacacagcgtgggatttcggcagcgttgggggagtcctcaactctctgggcaagatggtgcaccagatctttgggtccgcctacaccgctctgttcagcggcgtgtcttgggtcatgaaaattggaatcggcgtgctcctgacctggattgggcttaatagcaagaacacatccatgtcttttagctgcatcgccattggaatcatcaccctgtatctcggcgctgttgtgcaggccgacatggggtgtgtcattaattggaaaggaaaggagctgaagtgcggctccgggatcttcgtgacaaacgaggttcatacgtggaccgaacagtacaaatttcaagcggatagcccgaagcggctggccacagctattgccggcgcttgggagaatggagtgtgtggcatcagatctaccacacgcatggaaaaccttctctggaaacagattgccaatgagctgaactatatcctgtgggaaaataacatcaagctcaccgtcgtggttggggacacgattggagtgctggagcagggcaaacggacccttacaccccagcctatggagctgaagtactcctggaaaacctgggggaaggccaagatcgtcacagctgaaattcaaaacagctctttcatcattgatggacccaatacccctgagtgcccctccgcgagcagagcctggaacgtgtgggaagtggaggactatggctttggcgtcttcacaaccaatatctggctcaaactgcgcgaagtttacacgcagctgtgtgaccaccggcttatgtccgctgccgtgaaggatgagagagccgtgcacgctgacatggggtactggatcgagtctcagaaaaacggaagctggaagctcgaaaaagcctcctttattgaggtcaagacatgcacctggccgaagtctcataccctgtggagcaatggcgtgctggaatccgatatgatcattcctaaaagcctcgcggggcccatctctcagcacaactatcgccctggataccatacacaaaccgctggcccctggcacctggggaaacttgagctggacttcaattattgcgagggaacgacagttgtgattaccgaaaactgtggcacacggggcccttccctcagaaccacaaccgtcagcgggaaactgatccacgagtggtgctgtcgctcttgcacgctgcccccgcttcggtacatgggagaagatggctgttggtatgggatggagatcagacctatttccgaaaaggaggagaatatggtgaaaagcctcgcctctgccggaagcggcaaggttgacaactttaccatgggggtgctgtgcctggctatcctcttcgaagaggtcatgcggggaaagttcggcaaaaagcatatgattgccggcgtgtttttcacatttgttctgcttctgtccgggcagatcacctggcgcgatatggcgcacacactcattatgatcggaagcaatgcttctgacagaatgggcatgggggtgacctacctggccctgattgccacgttcaaaatccagccctttcttgctctgggattctttctccggaagctgacatccagagaaaacctcctgcttggcgtcgggctggccatggctaccacactccaactgcccgaggatatcgaacagatggccaatggaattgcgctgggccttatggccctgaaactcatcacccagttcgagacctatcagctgtggacagctctcgtgagcctgacgtgttccaacaccatgtttacacttaccgtggcctggcgcacagctaccctgattctcgccggcgtctctctgctgcctgtttgccaaagctcctctatgcggaagacggactggcttccgatgacagtggccgctatgggggtgccccctctgcccctcttcatctttagcctgaaggataccctcaaaagacgctcctggcctctgaatgagggagtcatggcggtgggccttgtttctattctggccagctccctgctcagaaacgacgtgcccatggctgggcctctggtcgccggaggccttctgatcgcctgttacgtgatcaccgggacaagcgctgatctcaccgttgaaaaggccgcggacgtgacatgggaggaagaggctgaacagacgggagtctctcataacctgatgattaccgtggacgatgacggcacaatgcggatcaaagatgacgagaccgagaatattctcacagtcctgcttaagaccgccctgctgatcgtgtccggcattttcccctacagcatcccggccacgctcctggtttggcacacctggcagaaacagacacaacgctctggggtgctttgggatgtcccttctccccctgaaacccagaaggctgagctggaagagggagtgtatagaatcaaacagcagggcattctcgggaagacacaagttggagtgggcgtccagaaggagggggtgtttcataccatgtggcacgtgacacggggagccgttctgacgcacaacggcaaacgcctcgaacccaattgggcgagcgtcaagaaagacctgatcagctacggcgggggatggagactttccgctcagtggcaaaagggcgaggaagtccaggtgattgccgtcgagccggggaaaaaccctaagaatttccagaccatgcccggaacattccagaccaccacaggcgaaatcggggccattgctctggattttaagcctggaacgagcggctcccccatcattaaccgggagggcaaagtggttgggctgtatggaaatggcgtggtcaccaagaacgggggatacgtgagcggcatcgcccaaacaaatgctgagcccgacgggcctaccccggaactcgaggaagagatgttccgcaaaagaaacctgacaatcatggatcttcatcccggctctggaaagacccggaaatatctgcctgccattgttcgcgaagcgatcaagagacggctcagaacgctgattctcgcccccacacgcgtggtcgctgccgagatggaggaagctctgaagggccttcctatccggtaccagaccaccgccacaaaaagcgagcacaccgggagagaaattgtggacctgatgtgccatgccacatttaccatgcgcctgctctcccccgttcgggtgcctaattataacctgatcatcatggatgaggctcacttcacggacccggcgtctattgccgctagaggatacatcagcacacgcgtcggcatgggggaagccgccgctatttttatgaccgccacaccccctggaaccgcggatgctttcccccagtccaatgcccctatccaggacgaggagcgggacattcccgaaagatcttggaacagcggcaatgagtggatcacggattttgccgggaagaccgtgtggttcgtgccgtccatcaaagctggcaacgacattgccaactgtcttcgcaagaatggcaaaaaggtcatccaactgtctcggaagacatttgataccgaataccagaaaacaaagctcaacgactgggatttcgttgtgaccacagacattagcgagatgggagcgaattttaaagccgatagagtgatcgaccctcggcgctgcctgaagcccgtcattctgaccgatgggcccgagagagtgatcctcgctggacctatgcccgttacggccgcttccgccgctcagcggcgcggcagagtggggcggaaccctcagaaagaaaatgaccaatatattttcacaggacagccgcttaacaatgatgaggaccatgcccactggaccgaagcgaagatgctgctggacaacatcaatacccccgagggcatcattcctgccctcttcgaacccgagagagaaaagagcgctgccatcgatggggaataccgcctgaaaggcgagtctcggaagacatttgtcgaacttatgagacgcggagacctgcctgtgtggctcgctcacaaagttgcctccgagggcattaagtataccgatcggaaatggtgcttcgacgggcagagaaacaatcagatcctggaagagaacatggatgtggagatttggacaaaggaaggagagaaaaagaagctgcgcccccggtggctcgacgccagaacgtacagcgatccgcttgctctgaaagaatttaaggacttcgcggccggccgcaaatctatcgctctggatctcgtcaccgagatcgggagagtgccttcccatctggcccaccggacacgcaatgcccttgacaacctggtcatgctccataccagcgaacacggaggcagagcttatcggcacgccgtggaggagctgcccgaaacaatggagaccctgctccttctgggcctgatgattctcctgacagggggagttatgctttttctgatctccggcaaggggattggaaaaacctctatcggcctcatttgtgtgatcgcgagctccgggatgctgtggatggccgatgtgcctctgcaatggatcgctagcgccattgtcctcgagttctttatgatggttcttctgatccccgagcctgagaagcagcgcacaccccaggacaatcaactggcttacgtggtgattggaatcctcaccctggccgcgattatcgccgctaacgaaatgggccttctggagacaaccaagagagatctcggcatgtctaaagaaccgggggtcgtgtcccctacgagctatctggacgttgacctgcatcccgcctctgcttggacactctacgccgtggctaccacagtcattacccccatgcttcggcacaccatcgagaatagcacagccaacgtgtccctggcggccatcgctaaccaggccgtcgtgctgatgggactcgataagggctggcctatttctaaaatggacctgggggttccgcttctggctctcggatgctacagccaggtgaatcccctgacgctgaccgccgccgtcctccttctgatcacacattatgcgattatcggccctgggctgcaggctaaggccaccagagaagctcaaaaacgcacagccgccggaattatgaagaaccccaccgtggatggcatcatgacgatcgacctcgatcctgttatttacgactccaagttcgagaaacagctgggccaggtgatgcttctggtcctctgtgctgtgcagctgctgctcatgcggacatcttgggccctttgcgaggcgctgaccctggccaccgggcccatcacaaccctctgggaaggaagccctggcaagttttggaatacaacgattgctgtgtccatggccaacatcttcagagggagctatctggctggagccggccttgcgttttctattatgaaatccgttgggaccggaaagcgcggcacaggcagccaaggggagaccctgggagaaaaatggaagaagaaactcaatcagctgtcccggaaggagttcgatctgtacaaaaagtctggcatcacagaagtcgacagaaccgaggccaaagaggggctcaagcggggagaaacgacccaccatgctgtgagccgcggctccgccaaacttcagtggtttgtggagagaaacatggtcatcccggaagggcgggttattgatctgggatgtggccgcggcgggtggtcttattactgcgctggactgaagaaggtgacagaggtgagaggctataccaaagggggacccggccacgaagaacctgtccccatgagcacatacgggtggaatatcgtgaagctcatgtccggaaaagacgttttctacctgcctcccgagaagtgtgatacccttctgtgcgacattggcgaaagctctccgtcccctacagtggaggaaagccggaccatccgcgtcctcaaaatggtggagccctggctgaagaacaatcagttctgtattaaggttctgaacccctatatgcctacggtgatcgagcacctcgaaagacttcaacggaaacatggcgggatgctggtccgcaatcccctgtctagaaactccacacacgagatgtactggattagcaatggaaccggcaacatcgtgtctagcgtgaatatggtctcccggctcctgcttaacagatttaccatgacacatcgccggcctacgatcgaaagagatgttgacctgggggccggaacccgccacgtgaacgctgagccggaaattcccaatatggacgtgatcggcgagcggattaagagaatcaaagaggaacacaactctacatggcattatgatgacgagaatccttacaagacctgggcctatcacgggagctacgaagtcaaagcgacaggatccgccagctccatgattaacggcgtggttaagctcctgaccaagccctgggatgtggtccctatggtgacacagatggctatgaccgacacgacccccttcggccagcaacgcgtttttaaagagaaggtggatacacggaccccgagacctatgcccgggacacgcaaagtcatggaaatcaccgccgagtggctgtggcggacgctcggaagaaataagcgccctcggctgtgcacaagagaggagttcaccaaaaaggtgcgcacaaacgctgccatgggcgccgtttttaccgaggaaaatcagtgggactctgcgaaggctgccgtggaggatgaagagttctggaaacttgtcgacagagagcgggaactgcataagctcgggaaatgtggaagctgcgtgtataacatgatgggcaagcgcgagaaaaagctgggggaatttggcaaagccaagggatccagagctatctggtacatgtggcttggcgcccggtacctggagttcgaggctctcgggtttctgaatgaagatcactggttctctagagagaacagctattccggagtcgaaggcgaggggctgcataagctcggatacattctgcgggacatctctaaaattcccggcggggccatgtatgcggatgacacggccggctgggacacccgcatcacagaagatgaccttcacaatgaggagaagattacccagcagatggatcctgaacacagacaactggctaacgccatctttaaactcacataccagaataaggtggttaaagtgcagcggcccaccccgacaggaaccgtcatggacatcattagccgcaaggatcagagaggctccgggcaagtgggaacgtatggcctgaacacattcaccaatatggaggctcagcttgtgcggcagatggaaggggagggagttctgagcaaggccgacctcgaaaaccctcatctgctggagaaaaagatcacccagtggctcgagacaaaaggcgtggaacgcctgaagagaatggcgatttctggggatgactgcgtcgtgaaacccatcgatgaccggtttgccaacgcccttctggccctcaatgatatgggcaaggttcgcaaggacattccccaatggcagccttccaaaggatggcacgattggcaacaggtgccgttctgtagccatcacttccacgagctgatcatgaaggacggcagaaaacttgtcgtgccctgccggcctcaagacgaactgatcgggcgcgctagaatttctcagggagccggctggtccctccgggagaccgcttgtctggggaaggcctacgcgcagatgtggagcctgatgtattttcatcgcagagatctccggctggcctctaacgctatctgctccgccgtccccgtgcactgggttcctacaagcagaacgacctggtccattcatgcccaccatcaatggatgacaaccgaagacatgcttacagtgtggaatcgcgtctggatcgaggataacccctggatggaggacaaaacccctgtgacgacctgggaaaatgttccctacctgggaaagcgggaggatcagtggtgtggcagcctcattgggctgacatctagagctacctgggcccagaacatcccgacagcgattcagcaagtgcgcagccttatcggcaatgaagagttcctggactacatgccttccatgaagcggtttagaaaagaggaagagtctgaaggagctatctggtga

SEQ ID NO: 20519 - RNA, 9873 nt, synthetic construct
  misc_feature 1..9873: note = derived and/or modified CDS sequence (opt5) from DENV-3__GQ199888__SS-prME
  source 1..9873: mol_type = other RNA
acctccctgtgcctcatgatgatcctgcccgccgctcttgccttccacctgacctcccgggacggagagcctcggatgattgtggggaagaacgaacgcggaaaatctctcctgtttaagacggcgagcggcatcaatatgtgtacccttattgctatggatctgggggagatgtgcgacgataccgtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcatacaggggaccagcaccaggttggaaacgagacgcaaggcgtgaccgctgaaattacaccccaggcctccaccacagaggctatcctgcctgaatatggcaccctggggctcgagtgcagcccccgcacgggactggacttcaatgagatgattcttctgaccatgaaaaacaaggcctggatggtccatagacagtggtttttcgatctccctctgccctggacatctggcgccaccacagaaaccccgacgtggaatcggaaagagcttctggtgacatttaagaacgctcacgcgaaaaagcaagaagtcgtggttctcgggtcccaggagggagccatgcacaccgctctgacaggcgccaccgaaatccagaatagcgggggcacctctattttcgccggacatctgaagtgtcgcctcaaaatggacaagctggagcttaaaggcatgtcctacgctatgtgcacaaacacgtttgtgctgaagaaagaggtcagcgaaacccagcacgggacaatcctcgtgaaggttgagtacaagggagaagatgccccttgtaaaatccccttctccaccgaggacggccaagggaaggcgcataacggaagactgattacagctaatcctgtggtcaccaaaaaggaggaacccgtgaacatcgaggccgaaccccctttcggcgagtctaatattgtgatcgggacgggcgataacgccctgaaaattaattggtataagaagggaagctccatcggcaaaatgtttgaagctacagccagaggggctagacgcatggccatccttggagacaccgcgtgggatttcggcagcgttgggggagtcctcaactctctgggcaagatggtgcaccagatttttgggtccgcctacaccgctctgttcagcggcgtgtcttgggtcatgaaaatcggaattggcgtgctcctgacatggatcgggcttaatagcaagaacacctccatgtcttttagctgcattgccatcggaattatcacactgtatctcggcgctgttgtgcaggccgacatggggtgtgtcatcaattggaaaggaaaggagctgaagtgcggctccgggattttcgtgacgaacgaggttcatacctggacagaacagtacaaatttcaagcggatagcccgaagcggctggccaccgctatcgccggcgcttgggagaatggagtgtgtggcattagatctacaacccgcatggaaaaccttctctggaaacagatcgccaatgagctgaactatattctgtgggaaaataacatcaagctcacggtcgtggttggggacaccatcggagtgctggagcagggcaaacggacacttacaccccagcctatggagctgaagtactcctggaaaacatgggggaaggccaagattgtcaccgctgaaatccaaaacagctctttcattatcgatggacccaatacacctgagtgcccctccgcgagcagagcctggaacgtgtgggaagtggaggactatggctttggcgtcttcaccacgaatatttggctcaaactgcgcgaagtttacacacagctgtgtgaccaccggcttatgtccgctgccgtgaaggatgagagagccgtgcacgctgacatggggtactggatcgagtctcagaaaaacggaagctggaagctcgaaaaagcctcctttatcgaggtcaagacctgcacctggccgaagtctcatacactgtggagcaatggcgtgctggaatccgatatgattatccctaaaagcctcgcggggcccatttctcagcacaactatcgccctggataccatacccaaacggctggcccctggcacctggggaaacttgagctggacttcaattattgcgagggaacaaccgttgtgatcacagaaaactgtggcacccggggcccttccctcagaacaaccacggtcagcgggaaactgattcacgagtggtgctgtcgctcttgcaccctgcccccgcttcggtacatgggagaagatggctgttggtatgggatggagatcagacctatctccgaaaaggaggagaatatggtgaaaagcctcgcctctgccggaagcggcaaggttgacaactttacaatgggggtgctgtgcctggctattctcttcgaagaggtcatgcggggaaagttcggcaaaaagcatatgatcgccggcgtgtttttcacctttgttctgcttctgtccgggcagattacatggcgcgatatggcgcacaccctcatcatgattggaagcaatgcttctgacagaatgggcatgggggtgacgtacctggccctgatcgccacattcaaaattcagccctttcttgctctgggattctttctccggaagctgacctccagagaaaacctcctgcttggcgtcgggctggccatggctacaaccctccaactgcccgaggatatcgaacagatggccaatggaatcgcgctgggccttatggccctgaaactcattacccagttcgagacatatcagctgtggacggctctcgtgagcctgacctgttccaacacaatgtttacccttacagtggcctggcgcaccgctacgctgatcctcgccggcgtctctctgctgcctgtttgccaaagctcctctatgcggaagacagactggcttccgatgaccgtggccgctatgggggtgccccctctgcccctcttcatttttagcctgaaggataccctcaaaagacgctcctggcctctgaatgagggagtcatggcggtgggccttgtttctatcctggccagctccctgctcagaaacgacgtgcccatggctgggcctctggtcgccggaggccttctgattgcctgttacgtgatcacagggaccagcgctgatctcacagttgaaaaggccgcggacgtgacgtgggaggaagaggctgaacagaccggagtctctcataacctgatgatcacagtggacgatgacggcaccatgcggattaaagatgacgagacagagaatatcctcaccgtcctgcttaagacggccctgctgattgtgtccggcatcttcccctacagcattccggccaccctcctggtttggcacacatggcagaaacagacccaacgctctggggtgctttgggatgtcccttctccccctgaaacacagaaggctgagctggaagagggagtgtatagaatcaaacagcagggcatcctcgggaagacccaagttggagtgggcgtccagaaggagggggtgtttcatacaatgtggcacgtgacgcggggagccgttctgacccacaacggcaaacgcctcgaacccaattgggcgagcgtcaagaaagacctgattagctacggcgggggatggagactttccgctcagtggcaaaagggcgaggaagtccaggtgatcgccgtcgagccggggaaaaaccctaagaatttccagacaatgcccggaaccttccagaccacaacgggcgaaattggggccatcgctctggattttaagcctggaaccagcggctcccccattatcaaccgggagggcaaagtggttgggctgtatggaaatggcgtggtcacaaagaacgggggatacgtgagcggcattgcccaaaccaatgctgagcccgacgggcctacaccggaactcgaggaagagatgttccgcaaaagaaacctgaccatcatggatcttcatcccggctctggaaagacgcggaaatatctgcctgccatcgttcgcgaagcgattaagagacggctcagaacactgatcctcgcccccacccgcgtggtcgctgccgagatggaggaagctctgaagggccttcctattcggtaccagaccacagccaccaaaagcgagcacacagggagagaaatcgtggacctgatgtgccatgccacctttacgatgcgcctgctctcccccgttcgggtgcctaattataacctgattatcatggatgaggctcacttcacagacccggcgtctatcgccgctagaggatacattagcacccgcgtcggcatgggggaagccgccgctatctttatgacagccacaccccctggaacggcggatgctttcccccagtccaatgcccctattcaggacgaggagcgggacatccccgaaagatcttggaacagcggcaatgagtggattaccgattttgccgggaagacagtgtggttcgtgccgtccatcaaagctggcaacgacatcgccaactgtcttcgcaagaatggcaaaaaggtcattcaactgtctcggaagacctttgatacagaataccagaaaaccaagctcaacgactgggatttcgttgtgacaaccgacatcagcgagatgggagcgaattttaaagccgatagagtgattgaccctcggcgctgcctgaagcccgtcatcctgacggatgggcccgagagagtgattctcgctggacctatgcccgttacagccgcttccgccgctcagcggcgcggcagagtggggcggaaccctcagaaagaaaatgaccaatatatcttcaccggacagccgcttaacaatgatgaggaccatgcccactggaccgaagcgaagatgctgctggacaacattaatacacccgagggcatcatccctgccctcttcgaacccgagagagaaaagagcgctgccattgatggggaataccgcctgaaaggcgagtctcggaagacctttgtcgaacttatgagacgcggagacctgcctgtgtggctcgctcacaaagttgcctccgagggcatcaagtatacagatcggaaatggtgcttcgacgggcagagaaacaatcagattctggaagagaacatggatgtggagatctggacgaaggaaggagagaaaaagaagctgcgcccccggtggctcgacgccagaacctacagcgatccgcttgctctgaaagaatttaaggacttcgcggccggccgcaaatctattgctctggatctcgtcacagagatcgggagagtgccttcccatctggcccaccggacccgcaatgcccttgacaacctggtcatgctccatacaagcgaacacggaggcagagcttatcggcacgccgtggaggagctgcccgaaaccatggagacgctgctccttctgggcctgatgatcctcctgaccgggggagcgatgctttttctgatttccggcaaggggatcggaaaaacatctattggcctcatctgtgttattgccagctccgggatgctgtggatggctgatgtgcctctgcaatggatcgccagcgctatcgtgctcgagttctttatgatggtccttctgattcccgagcctgagaagcagcgcacaccccaggacaatcaactggcctacgttgtgatcggcattctcacactggcggccatcattgctgccaacgaaatgggccttctggagaccacgaagagagatctcggcatgtctaaagaaccgggggtggtctcccctacaagctatctggacgtggacctgcatcccgcttctgcctggaccctctacgctgttgccacaaccgtgatcacccccatgcttcggcacacaattgagaatagcacggcgaacgtctccctggccgctatcgccaaccaggctgtggtcctgatgggactcgataagggctggcctatctctaaaatggacctgggggtgccgcttctggccctcggatgctacagccaggttaatcccctgaccctgacagccgcggtgctccttctgattacccattatgctatcattggccctgggctgcaggccaaggctacaagagaagcccaaaaacgcaccgccgctggaatcatgaagaaccccacggtcgatggcattatgacaatcgacctcgatcctgtgatctacgactccaagttcgagaaacagctgggccaggttatgcttctggtgctctgtgccgtccagctgctgctcatgcggacctcttgggcgctttgcgaggccctgaccctggctacagggcccattaccacactctgggaaggaagccctggcaagttttggaatacgaccatcgccgtgtccatggctaacattttcagagggagctatctggccggagcgggccttgccttttctatcatgaaatccgtggggacaggaaagcgcggcaccggcagccaaggggagacactgggagaaaaatggaagaagaaactcaatcagctgtcccggaaggagttcgatctgtacaaaaagtctggcattaccgaagttgacagaacggaggctaaagaggggctcaagcggggagaaaccacacaccatgccgtcagccgcggctccgctaaacttcagtggtttgtggagagaaacatggtgatcccggaagggcgggtcatcgatctgggatgtggccgcggcgggtggtcttattactgcgccggactgaagaaggttaccgaggtgagaggctatacaaaagggggacccggccacgaagaacctgtgcccatgagcacctacgggtggaatattgtcaagctcatgtccggaaaagacgtgttctacctgcctcccgagaagtgtgatacacttctgtgcgacatcggcgaaagctctccgtcccctaccgttgaggaaagccggacgattcgcgtgctcaaaatggtcgagccctggctgaagaacaatcagttctgtatcaaggtgctgaacccctatatgcctacagttattgagcacctcgaaagacttcaacggaaacatggcgggatgctggtgcgcaatcccctgtctagaaactccacccacgagatgtactggatcagcaatggaaccggcaacattgtctctagcgtgaatatggtgtcccggctcctgcttaacagatttacaatgacgcatcgccggcctaccatcgaaagagatgtcgacctgggggctggaacacgccacgttaacgccgagccggaaatccccaatatggacgtgattggcgagcggatcaagagaattaaagaggaacacaactctacctggcattatgatgacgagaatccttacaagacatgggcgtatcacgggagctacgaagtgaaagccaccggatccgctagctccatgatcaacggcgtcgtgaagctcctgacaaagccctgggatgttgtgcctatggtcacccagatggccatgacggacaccacacccttcggccagcaacgcgtgtttaaagagaaggttgatacccggacaccgagacctatgcccgggacccgcaaagtgatggaaattacggctgagtggctgtggcggacactcggaagaaataagcgccctcggctgtgcaccagagaggagttcaccaagaaggtccgcaccaacgccgccatgggcgcggtgtttacggaggaaaatcagtgggactctgctaaggccgccgttgaggatgaagagttctggaaacttgtggacagagagcgggaactgcataagctcgggaaatgtggaagctgcgtctataacatgatgggcaagcgcgagaaaaagctgggggaatttggcaaagctaagggatccagagccatctggtacatgtggcttggcgctcggtacctggagttcgaggccctcgggtttctgaatgaagatcactggttctctagagagaacagctattccggagtggaaggcgaggggctgcataagctcggatacatcctgcgggacatttctaaaatccccggcggggcgatgtatgccgatgacaccgctggctgggacacacgcattaccgaagatgaccttcacaatgaggagaagatcacacagcagatggatcctgaacacagacaactggccaacgctatttttaaactcacctaccagaataaggtcgtgaaagttcagcggcccacaccgaccggaacggtgatggacatcatcagccgcaaggatcagagaggctccgggcaagtcggaacatatggcctgaacaccttcaccaatatggaggcccagcttgtgcggcagatggaaggggaggacgtgctgagcaaggcggatctcgaaaaccctcatctgctggagaaaaagattacacagtggctcgagaccaaaggagttgaacgcctgaagagaatggccatctctggcgacgattgcgtggtcaaacccattgacgatcggtttgctaacgcccttctggctctcaatgacatggggaaggtgcgcaaggatatcccccaatggcagccttccaaaggctggcacgactggcagcaggttccgttctgtagccatcacttccacgagctgattatgaaggacggaagaaaacttgtggtcccctgccggcctcaagatgaactgatcggccgcgccagaatctctcagggggctggatggtccctccgggagacagcctgtctgggcaaggcgtacgcccagatgtggagcctgatgtattttcatcgcagagacctccggctggcttctaacgccatttgctccgccgtgcccgtccactgggtgcctacgagcagaaccacatggtccatccatgctcaccatcaatggatgaccacagaagatatgcttaccgtttggaatcgcgtgtggattgaggacaacccctggatggaggataaaacgcctgtcaccacatgggaaaatgtgccctacctggggaagcgggaggaccagtggtgtggaagcctcatcggcctgacctctagagccacatgggcgcagaacattccgaccgctatccagcaagttcgcagccttattgggaatgaagagttcctggattacatgccttccatgaagcggtttagaaaagaggaagagtctgaaggcgccatctggtga

SEQ ID NO: 20520 - RNA, 9873 nt, synthetic construct
  misc_feature 1..9873: note = derived and/or modified CDS sequence (opt5) from DENV-3__GQ252674__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaagtctctcctgtttaagacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggaattggcaaccgggactttgtggaagggctcagcggagctacctgggtcgatgtggtgctggagcacggcgggtgcgtcaccacaatggccaagaataaacccacgctggacatcgagctccagaagaccgaagctacacagctggccacccttcgcaaactgtgtattgagggaaagatcacaaacattaccacggattccagatgccctacacagggcgaagcggttctcccggaggaacaggaccagaattatgtgtgtaaacacacctacgtggatcggggctgggggaacggatgcggcctgttcgggaagggaagccttgtgacatgcgccaagtttcaatgtctggagcccatcgagggcaaagtggttcagtatgaaaatctcaagtacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgccccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcgggggagtgctcaacagcctgggcaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgccggcgcttgggagaatggagtgtgtggcatcagaagcaccacacgcatggaaaaccttctctggaaacagatcgccaatgagctgaactatattctgtgggaaaataacatcaagctcaccgttgtggtcggggacacgattggagtgctggagcagggcaaacggacccttacacctcagcccatggagctgaagtactcttggaaaacctgggggaaggccaagatcgttacagctgaaacccaaaactccagcttcattatcgatggacctaatacacccgagtgcccgtctgcgtccagagcctggaacgtgtgggaagtcgaggactatggctttggcgtgttcaccacgaatatctggctcaaactgcgcgacgtgtacacacagctgtgtgatcaccggcttatgagcgctgccgtcaaggacgaaagagccgttcacgctgatatggggtactggattgagtcccagaaaaacggatcttggaagctcgagaaagccagcctgatcgaagtgaagacctgcacctggcctaagtcccatacactgtggtctaatggcgtgctcgagagcgacatgattatccccaaatccctggcggggcctattagccagcacaactatcgccccggataccatacccaaacggctggcccttggcaccttgggaagctggaactcgattttaattattgcgagggaacaaccgtcgtgatcacagagaactgtggcacccggggcccctctctgagaacaaccacggtttccgggaaactgatccacgaatggtgctgtcgcagctgcacccttccgcctctccggtacatgggagaggacggctgttggtatgggatggaaattagacccatctctgagaaggaagagaatatggtgaaatccctggtcagcgccggatctggcaaggtggataacttcacaatgggggttctgtgcctcgccattctgtttgaggaagtgatgcggggaaagttcggcaaaaagcatatgatcgctggcgtccttttcacctttgtgctgctcctgagcgggcagattacatggcgcgacatggcccacaccctgatcatgattggatccaatgcgagcgatagaatgggcatgggggttacgtaccttgctctgatcgccacattcaaaatccagccctttctcgccctgggattctttctccggaagctgacctctagagagaaccttctgctcggcgtggggctggctatggccacaaccctgcaacttcctgaagacattgagcagatggctaatggaatcgccctgggcctcatggcgctgaaactcattacccagttcgaaacatatcagctgtggacggcccttgtctccctgacctgtagcaacacaatcctcaccctgacagtggcttggcgcaccgccacgctgattcttgctggcgtgtccctgctcccggtctgccaatctagctccatgcggaagacagattggctgcccatgaccgttgccgccatgggggtgcctcccctccctctgtttatcttctctcttaaggacaccctgaaaagacgcagctggcccctgaatgagggagtgatggctgtcggcctcgtgtccatcctggcgtctagccttctgagaaacgatgttcctatggccgggcccctcgtggctggaggcctgctcattgcctgttacgtcatcacagggacctccgccgacctgacagtggagaacgctgccgacgttacgtgggaagaggaagcggagcagaccggagtgagccataatcttatgattacagtcgatgacgatggcaccatgcggatcaaggacgatgaaacagagaacattctgaccgtgctgctcaaaacggctctgcttatcgtctctggcatctttccgtactccattcctgccaccctgctcgtgtggcacacatggcagaagcagacccaacgcagcggggttctgtgggacgtgccctctcctcccgagacacagaaagccgaactcgaggaaggagtctatagaatcaagcagcagggcattttcgggaaaacccaagtgggagttggcgtgcagaaggagggggtctttcatacaatgtggcacgtgacgcggggagctgtgctgacccacaatggcaagcgccttgagccgaactgggcctccgttaaaaaggatctgatcagctacggcgggggatggagactgtctgcgcagtggcaacggggcgaagaggtccaggtgattgctgtggaacctgggaaaaatcccaagaacttccagacaatgcctggaacctttcagaccacaacgggcgagatcggggccattgccctcgacttcaaacccggaacctccggcagccccatcatcaatcgcgaaggcaaggtcgtggggctgtatggaaacggcgttgtgacaaagaatgggggatacgtctccggcattgctcaaaccaacgccgagcctgatgggccgacacccgagcttgaagaggaaatgttcaaaaagagaaatctgaccatcatggacctccatcctggcagcggaaaaacgcggaagtatctgcccgctattgtgcgcgaggccatcaaaagacggctcagaacactgattcttgcgcctacccgcgttgtggccgctgaaatggaggaggccctgaagggcctgcccatccggtaccagaccacagctaccaagtctgaacacacagggagagagatcgtcgatctcatgtgccatgccacctttacgatgcgcctgcttagccctgtgcgggttccgaactataatctgattatcatggacgaagcccacttcacagatcccgcttccattgcggccagaggatacatctctacccgcgtgggcatgggggaggctgccgccatttttatgacagctacccctcccggaacggccgacgcgttccctcagagcaacgctcccatccaggacgaagaacgggatatcccggagagatcctggaactctggcaacgaatggattaccgactttgccgggaaaacagtctggttcgtgcctagcatcaaggccggcaacgatattgctaattgtctccgcaaaaacggaaagaaagtgatccaactgtcccggaagacctttgacacagagtaccagaagaccaaactgaatgattgggacttcgtcgttacaaccgatatttctgaaatgggcgccaactttaaggcggacagagtgatcgatccccggcgctgcctcaaacccgtgattcttacggacgggcctgagagagtcatcctggccggacccatccctgtgacagctgccagcgctgcccagcggcgcggcagagttgggcggaatccgcagaaggagaacgatcaatatattttcaccggacagcccctgaataacgacgaagaccatgctcactggaccgaggccaaaatgctcctggataatatcaacacacctgaaggcattatccccgcgctttttgagcctgaaagagagaagtccgccgctattgacggggagtaccgcctgaagggcgaaagccggaaaaccttcgtggagctcatgagacgcggagatctgcccgtctggctggcccacaaggtggcttctgaaggcatcaaatatacagaccggaagtggtgcttcgatgggcagagaaataaccagatcctcgaggaaaatatggacgttgagatttggacgaaagagggagaaaagaagaaacttcgcccgcggtggctggatgccagaacctactccgaccctctggccctcaaagagtttaaagatttcgctgcgggccgcaagagcatcgccctggaccttgtgacagaaattgggagagtcccctctcatctggctcaccggacccgcaacgccctcgataatctggtgatgctgcatacatccgagcacggaggcagagcctatcggcacgctgtcgaagaactccctgagaccatggaaacgcttctgctgctcggcctgatgatccttctgaccgggggagccatgctctttctgattagcggcaaagggatcggaaagacatccatcggcctgatttgtgtgatcgcgtctagcgggatgctctggatggccgagattccccttcaatggatcgcttccgccattgttctggagttctttatgatggtgctgctcatccctgagcccgagaaacagcgcaccccgcaggacaaccaactggcttacgtggtcattggaatccttacactggccgcgatcattgccgctaatgaaatgggcctcctggagaccacgaagagagatctgggcatgagcaaggaacctggggttgtgtctcccacatcctatctcgacgtggaccttcatcccgccagcgcttggaccctgtacgccgtcgctacaaccgtgatcacccctatgctgcggcacacaattgagaactctacggccaacgttagcctcgcggccatcgctaatcaggccgtggtcctgatgggacttgataaaggctggccgatttccaagatggacctgggggtgcccctcctggctctgggatgctactctcaggtcaaccctctcacccttacagccgccgtgctgctgctcatcacccattatgcgatcattggccccgggctgcaggctaaagccacaagagaagctcaaaagcgcaccgccgccggaatcatgaaaaatcctacggttgatggcattatgacaatcgaccttgatcccgtgatttacgacagcaagttcgagaagcagctgggccaggtcatgctcctggtgctgtgtgctgttcagctccttctgatgcggacctcctgggccctgtgcgaggcgctcaccctggccacagggcctatcaccacactttgggaaggatctccgggcaaattttggaacacgaccatcgctgtgagcatggccaatattttcagagggtcctatctggctggagccggcctcgcgtttagcatcatgaagtctgtcgggacaggaaaacgcggcaccggctcccaaggggagacactgggagaaaagtggaaaaagaagctgaaccagctcagccggaaagagttcgatctttacaagaaatccggcattaccgaagtggacagaacggaggccaaggaggggctgaaacggggagaaatcacccaccatgctgtgtctcgcggcagcgccaagctgcagtggtttgttgagagaaatatggtcattcccgaagggcgggtgatcgatctcggatgtggccgcggcgggtggtcctattactgcgctggactgaaaaaggtgacagaggtcagaggctataccaaagggggacctggccacgaagaacccgttcctatgtctacatacgggtggaacattgtgaaacttatgagcggaaaggacgtgttctacctgcccccggagaaatgtgataccctcctgtgcgacatcggcgaatccagcccttctcccacagtcgaggaatcccggaccatccgcgtgctgaagatggttgagccctggctcaaaaataaccagttttgtattaaggtgcttaatccttatatgcccacggtcatcgagcacctggaaagactgcaacggaagcatggcgggatgctcgtgcgcaaccctctgagcagaaattctacacacgagatgtactggatttccaacggaaccggcaatatcgttagctctgtgaacatggtcagccggcttctgctcaacagattcaccatgacacatcgccggccgacgattgaaaaagatgtggacctgggggccggaaccagacacgtgaatgctgagcccgaaacacctaacatggacgtcatcggcgagcgcatcaagcggattaaagaggaacacaattccacctggcattatgatgacgagaacccctacaagacatgggcctatcacgggtcttacgaagttaaagcgaccggaagcgcctccagcatgatcaatggcgtggtgaagctgctcacaaagccttgggatgtcgtgcccatggttacccagatggctatgacggacaccacaccgttcggccagcaaagagtgtttaaagagaaggtcgatacccgcacacctcggtccatgcccgggaccagaaaagtgatgggaattacggccgaatggctgtggcgcacacttggccggaacaagagacctcgcctgtgcacccgggaggagttcaccaagaaggttagaaccaatgctgccatgggggccgtgtttacggaagagaaccagtgggactctgcgaaggctgccgtcgaagatgaggagttctggaaactcgtggaccgcgagagagagctgcataaacttggaaaatgtggcagctgcgtttataatatgatggggaagcgggagaagaagctgggcgagtttggaaaagccaagggctcccgcgctatctggtacatgtggctcggggccagatacctggagttcgaggctctgggatttctcaacgaggatcactggttctctcgggacaatagctattccggcgtggaaggggagggactgcataaacttggctacattctgagagatatctctaaaatccccgggggcgccatgtatgcggacgacaccgccggatgggatacacggattaccgaagacgatctccacaacgaggaaaagatcacacagcagatggaccctgagcaccgccaactggctaatgccatttttaaacttacctaccagaacaaggtcgtgaaagtccagagacccacaccgaccggcacggtgatggatatcattagccggaaggaccagcgcgggtccggacaagttggcacatatgggctgaataccttcaccaacatggaggtgcagctcgtcagacagatggaaggagagggcgtgctgagcaaggctgatctggaaaaccctcatctccccgagaaaaagatcacacagtggctggaaaccaaaggggtggagcggcttaagcgcatggccatctctggcgacgattgcgttgtgaaacccattgacgatagatttgcgaatgccctgctcgctctgaacgacatgggaaaggtccggaaggatatccctcaatggcagccgtccaaaggctggcacgactggcaacaggtgcccttctgtagccatcactttcacgagcttattatgaaggacgggcgcaaactggttgtgccttgcagaccccaagatgaactcatcggacgggcccgcatttctcagggcgctgggtggtccctgagagagacagcctgtctgggaaaggcttacgcccagatgtggagcctcatgtatttccatcggcgcgacctgagacttgcgtctaatgccatctgctccgctgtccctgtgcactgggtccccacgagccggaccacatggtccattcatgcccaccatcaatggatgaccacagaagatatgctgaccgtgtggaacagagtttggatcgaggacaatccttggatggaaaacaaaacgcccgtgaccacatgggagaatgtcccgtacctcggcaagcgcgaggatcagtggtgtgggagcctgatcggccttacctctcgggccacatgggctcagaacattcctaccgccatccagcaagtgagaagcctgattggaaatgaagagttcctcgactacatgccctccatgaagcgctttcggaaagaagaggagtctgaaggcgcgatctggtga

SEQ ID NO: 20521 - RNA, 9873 nt, synthetic construct
  misc_feature 1..9873: note = derived and/or modified CDS sequence (opt5) from DENV-3__GQ199889__SS-prME
  source 1..9873: mol_type = other RNA
accagcctgtgcctcatgatgatcctgcccgccgctcttgccttccacctgacctcccgggacggcgagcctcggatgattgtggggaagaatgaacgcggaaaatctctcctgtttaagacggcgtccggcatcaatatgtgtacccttattgctatggatctgggggagatgtgcgacgatacggtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaggtcgaaaaagttgagacatgggccctccgccaccccggcttcaccatcctggcgctttttctggcccattacatcgggacgtccctcacacagaaggtggtcattttcatcctgcttattctggtgaccccttctatggctatgagatgtgttggagtgggcaaccgggactttgtcgaagggctcagcggagccacatgggtggatgtggtcctggagcacggcgggtgcgttaccaccatggctaagaataaacccacactggacatcgagctccagaagacggaagccacccaactggcgacacttcgcaaactgtgtattgagggaaagatcaccaacattacaaccgattccagatgccctacgcagggcgaagccatcctcccggaggaacaggaccagaattatgtgtgtaaacacacatacgtggatcggggctgggggaacggatgcggcctgttcgggaagggaagccttgtgacatgcgctaagtttcaatgtctggagtctatcgagggcaaagtggttcagtatgaaaatctcaagtacaccgtgattatcacagtccataccggggaccagcaccaggtgggaaacgagacacaaggcgttacggccgaaattacaccccaggcttccacaaccgaggccatcctgcctgaatatggcacactggggctcgagtgcagcccccgcaccggactggacttcaatgagatgattcttctgacgatgaaaaacaaggcctggatggtgcatagacagtggtttttcgatctccctctgccctggacctctggcgctacaaccgaaacaccgacctggaatcggaaagagcttctggtcacgtttaagaacgcgcacgccaaaaagcaagaagtggtcgtgctcgggtcccaggagggagctatgcacacagccctgaccggcgccacagaaatccagaatagcgggggcacctctatcttcgctggacatctgaagtgtcgcctcaaaatggacaagctggagcttaaaggcatgtcctacgccatgtgcaccaacacatttgttctgaagaaagaggtgagcgaaacgcagcacgggaccattctcatcaaggtcgagtacaagggagaagatgcgccttgtaaaattcccttctccacagaggacggccaagggaaggctcataacggaagactgatcaccgccaatcctgtggttaccaagaaggaggaacccgtgaacattgaggccgaaccccctttcggcgagtctaatatcgtcatcgggattggcgataacgctctgaaaatcaattggtataagaagggaagctccattggcaaaatgtttgaagccaccgctagaggggccagacgcatggcgatccttggagacacggcctgggatttcggcagcgtcgggggagtgctcaactctctgggcaagatggttcaccagatttttgggtccgcttacacagccctgttcagcggcgtctcttgggtgatgaaaatcggaattggcgtgctcctgacctggatcgggcttaatagcaagaacacctccatgtcttttagctgcatcgctattggaatcattacactgtatctcggcgccgtcgtgcaggcggacaccgggtgtgttatcaattggaaaggaaaggagctgaagtgcggctccgggattttcgtgacaaacgaggtccatacgtggaccgaacagtacaaatttcaagccgatagcccgaagcggctggctacagccatcgctggcgcctgggagaatggagtgtgtggcatcagatctaccacacgcatggaaaaccttctctggaaacagattgccaatgagctgaactatatcctgtgggaaaataacattaagctcaccgttgtggtcggggacacgatcggagtgctggagcagggcaaacggacccttacaccccagcctatggagctgaagtactcctggaaaacctgggggaaggctaagattgttacagcggaaatccaaaacagctctttcatcattgatggacccaatacccctgagtgcccctccgccagcagagcttggaacgtgtgggaagtcgaggactatggctttggcgtgttcacaaccaatatctggctcaaactgcgcgaagtgtacacgcagctgtgtgaccaccggcttatgtccgccgccgtcaaggatgagagagctgttcacgccgacatggggtactggattgagtctcagaaaaacggaagctggaagctcgaaaaagcgtcctttatcgaggtgaagacatgcacctggccgaagtctcataccctgtggagcaatggcgtgctggaatccgatatgattatccctaaaagcctcgctgggcccatctctcagcacaactatcgccctggataccatacacaaaccgccggcccctggcacctggggaaacttgagctggacttcaattattgcgagggaacgacagtcgtgattaccgaaaactgtggcacacggggcccttccctcagaaccacaaccgttagcgggaaactgatccacgagtggtgctgtcgctcttgcacgctgcccccgcttcggtacatgggagaagatggctgttggtatgggatggagattagacctatctccgaaaaggaggagaatatggtgaaaagcctcgcctctgctggaagcggcaaggtcgacaactttaccatgggggtgctgtgcctggccattctcttcgaagaggttatgcggggaaagttcggcaaaaagcatatgatcgcgggcgtgtttttcacatttgtcctgcttctgtccgggcagattacctggcgcgatatggctcacacactcatcatgatcggaagcaatgcctctgacagaatgggcatgggggtgacctacctggccctgattgctacgttcaaaatccagccctttcttgccctgggattctttctccggaagctgacatccagagaaaacctcctgcttggcgttgggctggctatggccaccacactccaactgcccgaggatattgaacagatggcgaatggaatcgccctgggccttatggctctgaaactcattacccagttcgagacctatcagctgtggacagccctcatcagcctgacgtgttccaacaccatgtttacacttaccgtggcttggcgcacagccaccctgatcctcgccggcgtctctctgctgcctgtgtgccaaagctcctctatgcggaagacggactggcttccgatgacagtggctgcgatgggggtgccccctctgcccctcttcatttttagcctgaaggataccctcaaaagacgctcctggcctctgaatgagggagttatggccgtgggccttgtgtctatcctggctagctccctgctcagaaacgacgtccccatggccgggcctctggtggccggaggcatgcttattgcttgttacgttatcaccgggacaagcgccgatctgaccgtggaaaaggcggctgacgtcacatgggaggaagaggccgaacagacgggagtgtctcataacctcatgattaccgttgacgatgacggcacaatgcggatcaaagatgacgagaccgagaatatcctgacagtgctcctgaagaccgcccttctgattgtctccggcatcttcccctacagcattccggctacgctgctcgtgtggcacacctggcagaaacagacacaacgctctggggtcctgtgggatgtgccttctccccctgaaacccagaaggccgagcttgaagagggagtttatagaatcaaacagcagggcattctggggaagacacaagtgggagtcggcgtgcagaaggagggggtttttcataccatgtggcacgtgacacggggagcggtcctcacgcacaacggcaaacgcctggaacccaattgggctagcgtgaagaaagacctcatcagctacggcgggggatggagactgtccgcccagtggcaaaagggcgaggaagtgcaggttattgccgtcgagccggggaaaaaccctaagaatttccagaccatgcccggaacattccagaccaccacaggcgaaatcggggctatcgcccttgattttaagcctggaacgagcggctcccccattatcaaccgggagggcaaagtggtggggctgtatggaaatggcgtcgtgaccaagaacgggggatacgttagcggcattgctcaaacatctgccgagcccgacgggcctaccccggaactggaggaagagatgttccgcaaaagaaatctcacaatcatggatctgcatcccggcagcggaaagacccggaaatatcttcctgcgattgtgcgcgaagccatcaagagacggctgagaacgctcatcctggctcccacacgcgtcgtggccgctgagatggaggaagccctcaagggcctgcctattcggtaccagaccaccgccacaaaatccgagcacaccgggagagaaatcgttgaccttatgtgccatgctacatttaccatgcgcctgctgtctcccgtgcgggtccctaactataatctcattatcatggatgaggcgcacttcacggacccggccagcattgctgccagaggatacatctccacacgcgtgggcatgggggaagccgctgccatctttatgaccgcgacaccccctggaaccgctgatgccttcccccagtctaacgcccctattcaggacgaggagcgggacatccccgaaagaagctggaactccggcaacgagtggattacggattttgctgggaagaccgtttggttcgtgccgtctatcaaagccggcaatgacattgcgaactgtctgcgcaagaacggcaaaaaggtcatccaacttagccggaagacatttgataccgaataccagaaaacaaagctgaatgactgggatttcgtggtgaccacagacatttccgagatgggagccaactttaaagctgatagagtcatcgaccctcggcgctgcctcaagcccgttatcctgaccgatgggcccgagagagtgattctggccggacctatgcccgtgacggctgccagcgctgcccagcggcgcggcagagtcgggcggaatcctcagaaagaaaacgaccaatatatcttcacaggacagccgctcaataacgatgaggaccatgcgcactggaccgaagccaagatgcttctggacaatattaacacccccgagggcatcattcctgctctgttcgaacccgagagagagaagtctgccgctatcgatggggaataccgcctcaaaggcgagtcccggaagacatttgtggaactgatgagacgcggagaccttcctgtttggctggcccacaaagtggccagcgagggcatcaagtataccgatcggaaatggtgcttcgacgggcagagaaataaccagattctcgaagagaatatggatgtcgagatctggacaaaggaaggagagaaaaagaagctgcgcccccggtggctggacgctagaacgtactctgatccgctcgcgcttaaagaatttaaggacttcgccgctggccgcaaatccattgccctggatctggtgaccgagatcgggagagttcctagccatctcgcccaccggacacgcaacgctctggacaatcttgtgatgctgcatacctccgaacacggaggcagagcctatcggcacgcggtcgaggagctccccgaaacaatggagaccctgctgctccttggcctgatgattctgctcacagggggagccatgctgtttcttatctctggcaaggggatcggaaaaaccagcattggcctgatctgtgtgattgcttccagcgggatgctctggatggccgatgtccctctgcaatggatcgcttctgccattgtgctggagttctttatgatggttctccttatccccgagcctgagaagcagcgcacaccccaggacaaccaactggcgtacgtggtgattggaatcctgaccctcgccgctatcattgccgctaatgaaatgggcctgcttgagacaaccaagagagatctgggcatgtccaaagaaccgggggtcgttagccctacgtcttatctcgacgtggacctgcatcccgccagcgcttggacactgtacgccgtggcgaccacagtcatcacccccatgctccggcacaccattgagaactccacagccaatgtgtctcttgctgccatcgctaaccaggccgttgtgctgatgggactggataagggctggcctattagcaaaatggacctcggggtcccgctgcttgccctgggatgctactcccaggtgaaccccctcacgctgaccgcggctgtcctgctccttatcacacattatgccatcattggccctgggctgcaggctaaggccaccagagaagcccaaaaacgcacagctgccggaatcatgaagaatcccaccgtggatggcattatgacgatcgacctggatcctgttatttacgactctaagttcgagaaacagctcggccaggtgatgctgcttgtcctgtgtgcggtgcagctcctgctgatgcggacaagctgggccctctgcgaggctcttaccctggccaccgggcccatcacaaccctgtgggaaggatcccctggcaagttttggaacacaacgatcgctgttagcatggccaatattttcagagggtcttatctcgcgggagccggcctggctttttccatcatgaaaagcgtggggaccggaaagcgcggcacaggctcccaaggggagacccttggagaaaaatggaagaagaaactgaaccagctctctcggaaggagttcgatctgtacaaaaagagcggcattacagaagtcgacagaaccgaggccaaagaggggctgaagcggggagaaacgacccgccacgctgtgtccagaggctctgccaaactccagtggtttgtggagcggaatatggttatcccggaagggcgcgtcattgatcttggatgtggcagaggcgggtggagctattactgcgctggactgaagaaggtgacagaggtgcggggctataccaaagggggacccggccatgaagaacctgtccccatgtccacatacgggtggaacatcgttaagctgatgagcggaaaagacgtgttctacctccctcccgagaagtgtgataccctgctttgcgacattggcgaatcttccccgagccctacagtggaggaatctcgcaccatcagagtcctgaaaatggtggagccctggctcaagaataaccagttctgtatcaaggttctgaatccctatatgcctacggtgattgagcacctggaacggctccaacgcaaacacggcgggatgcttgtcagaaaccccctgtcccggaatagcacacatgagatgtactggatctctaacggaaccggcaatattgtgagctccgttaacatggtgtctagactgctcctgaatcgctttaccatgacacaccggagacctacgatcgaacgcgatgtcgaccttggggccggaacccggcatgtgaacgcggagccggaaattcccaacatggacgtgatcggcgagagaatcaagcgcattaaagaggaacacaatagcacatggcactatgatgacgagaacccttacaagacctgggcctatcatgggtcctacgaagtcaaagctacaggaagcgcctcctctatgatcaatggcgttgtgaagctgctcaccaagccctgggatgtggtccctatggtgacacagatggctatgaccgacacgacccccttcggccagcaacgggtttttaaagagaaggtggatacaagaaccccgcgccctatgcccgggacacggaaagtcatggaaattaccgccgagtggctgtggagaacgctgggacgcaacaagcggcctagactctgcacacgcgaggagttcaccaaaaaggtgagaacaaatgccgcgatgggcgctgtttttaccgaggaaaaccagtgggacagcgccaaggccgctgtggaggatgaagagttctggaaactggtcgaccgggagcgcgaacttcacaagctggggaaatgtggatcctgcgtgtataatatgatgggcaagagagagaaaaagctcggggaatttggcaaagccaagggatctcgggctatctggtacatgtggctgggcgccagataccttgagttcgaggcgctggggtttctcaacgaagatcattggttcagccgggaaaattcctattctggagttgaaggcgaggggctgcacaagctgggatacattctccgcgacatcagcaaaatccccggcggggccatgtatgctgatgacacggccggctgggacaccagaattacagaagatgacctgcataacgaggagaagatcacccagcagatggatcctgaacaccggcaacttgctaatgccatttttaaactgacataccagaacaaggtggtcaaagtgcagcgccccaccccgacaggaaccgtcatggacatcatttccagaaaggatcagcggggcagcgggcaagtgggaacgtatggcctcaatacattcaccaacatggaggcgcagctggttcgccagatggaaggggagggagtgctttctaaggccgacctggaaaatcctcacctcctggagaaaaagatcacccagtggctggagacaaaaggcgtcgaaagactcaagcggatggctatctccggggatgactgcgtggtgaaacccattgatgaccgctttgccaacgctctgcttgccctgaacgatatgggcaaggttagaaaggacatcccccaatggcagcctagcaaaggatggcatgattggcaacaggtgccgttctgttctcaccatttccacgagctcattatgaaggacggccggaaactggtcgtgccctgccgccctcaagacgaacttatcgggagagctcggatttcccagggagccggctggagcctgcgcgagaccgcgtgtctcgggaaggcctacgctcagatgtggtctctgatgtattttcacagacgggatctgagactcgcctccaatgccatctgcagcgctgttcccgtgcattgggtccctacatcccgcacgacctggagcattcacgcccatcaccaatggatgacaaccgaagacatgctgacagtgtggaaccgggtctggatcgaggataatccctggatggaggacaaaacccctgtgacgacctgggaaaacgttccctaccttggaaagagagaggatcagtggtgtggctctctgatcgggctcacaagccgcgcgacctgggctcagaatattccgacagccatccagcaagtgcggtccctgattggcaacgaagagttccttgactacatgccttctatgaagagatttcgcaaagaggaagagagcgaaggagccatctggtga

SEQ ID NO: 20522 - RNA, 9873 nt, synthetic construct
  misc_feature 1..9873: note = derived and/or modified CDS sequence (opt5) from DENV-3__FJ882571__SS-prME
  source 1..9873: mol_type = other RNA
accagcctgtgcctcatgatgatcctgcccgccgctcttgccttccacctgacgtcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgacgtctacacacagctgtgtgatcaccggcttatgagcgctgccgttaaggacgaaagagccgtgcacgctgatatggggtactggatcgagtcccagaaaaacggatcttggaagctcgagaaagccagcctgattgaagtgaagacctgcacctggcctaagtcccatacactgtggtctaatggcgtcctcgagagcgacatgatcattcccaaatccctggcggggcctatcagccagcacaactatcgccccggataccatacccaaacggctggcccttggcaccttgggaagctggaactcgattttaattattgcgagggaacaaccgtggttattacagagaactgtggcacccggggcccctctctgagaacaaccacggtgtccgggaaactgatccacgaatggtgctgtcgcagctgcacccttccgcctctccggtacatgggagaggacggctgttggtatgggatggaaatcagacccatttctgagaaggaagagaatatggtcaaatccctggtgagcgccggatctggcaaggttgataacttcacaatgggggtgctgtgcctcgccatcctgtttgaggaagtcatgcggggaaagttcggcaaaaagcatatgattgctggcgtgcttttcacctttgttctgctcctgagcgggcagatcacatggcgcgacatggcccacaccctgattatgatcggatccaatgcgagcgatagaatgggcatgggggtgacgtaccttgctctgattgccacattcaaaatccagccctttctcgccctgggattctttctccggaagctgacctctagagagaaccttctgctcggcgtcgggctggctatggccacaaccctgcaacttcctgaagacatcgagcagatggctaatggaattgccctgggcctcatggcgctgaaactcatcacccagttcgaaacatatcagctgtggacggcccttgtgtccctgacctgtagcaacacaattctcaccctgacagtggcttggcgcaccgccacgctgatccttgctggcgtctccctgctcccggtttgccaatctagctccatgcggaagacagattggctgcccatgaccgtggccgccatgggggtgcctcccctccctctgtttattttctctcttaaggacaccctgaaaagacgcagctggcccctgaatgagggagtcatggctgtgggcctcgtttccatcctggcgtctagccttctgagaaacgatgtgcctatggccgggcccctcgtcgctggaggcctgctcatcgcctgttacgtgattacagggacctccgccgacctgatcgttgagaaggctgccgacgtgacatgggaagaggaagcggagcagacgggagtcagccataaccttatgattaccgtggatgacgatggcacaatgcggatcaaagacgatgaaaccgagaatattctgacagtcctgctcaagaccgctctgcttatcgtgtctggcatctttccgtactccattcctgccacgctgctcgtttggcacacctggcagaaacagacacaacgcagcggggtgctgtgggacgtcccctctcctcccgagacccagaaggccgaactcgaggaaggagtgtatagaatcaaacagcagggcattctggggaagacacaagttggagtgggcgtccagaaggagggggtgttccataccatgtggcacgtgacacggggagctgttcttacgcacaacggcaaacgcctggagccgaattgggcctccgtcaagaaagatctgatcagctacggcgggggatggagactctctgcgcagtggcaaaagggcgaagaggtccaggtgattgctgtcgaacctgggaaaaaccccaagaattttcagaccatgcctggaacattccagaccaccacaggcgagatcggggccattgccctggactttaagcccggaacgtccggcagccccatcatcaaccgggaaggcaaagtggttgggctttatggaaatggcgtggtcaccaagaacgggggatacgtgtccggcattgctcaaacaaatgccgagcctgatgggccgacccccgagctggaagaggaaatgttcaaaaagcgcaacctcacaatcatggacctgcatcctggcagcggaaaaaccagaaagtatctccccgctattgttcgggaggccatcaagcgcagactgcggacgcttattctggcgcctacaagagtggtcgccgctgaaatggaggaggccctgaaaggcctccccatccgctaccagaccaccgctacaaagtctgaacacaccgggcgggagatcgtggatctgatgtgccatgccacattcaccatgagacttctgagccctgttcgcgtgccgaattataacctcattatcatggacgaagcccactttacggatcccgcttccattgcggcccggggatacatctctacaagagtcggcatgggggaggctgccgccattttcatgaccgctacacctcccggaaccgccgacgcgtttcctcagagcaatgctcccatccaggacgaggaacgcgatatcccggagcggtcctggaactctggcaatgaatggattacggacttcgccgggaaaaccgtgtggtttgtgcctagcatcaaggccggcaacgatattgctaactgtctgcgcaaaaatggaaagaaggtcatccaactgtccagaaaaacattcgacaccgagtaccagaagacaaaactcaacgattgggactttgttgtgaccacagatatttctgaaatgggcgccaatttcaaggcggaccgggtgatcgatcccagacggtgccttaaacccgtcattctgaccgacgggcctgagcgcgtgatcctggccggacccatgcctgttacggctgccagcgctgcccagagacggggccgcgtggggagaaacccgcagaaggagaatgatcaatatatctttacaggacagcccctcaacaatgacgaagaccatgctcactggaccgaggccaagatgctgcttgataacattaatacccctgaaggcatcattcccgcgctgttcgagcctgaacgggagaaatccgccgctatcgacggggagtacagactcaagggcgaaagccgcaaaacatttgtcgagctgatgcggagaggagatctgcccgtgtggctcgcccacaaggttgcttctgaaggcattaaatataccgaccgcaagtggtgcttcgatgggcagcggaacaatcagatccttgaggaaaacatggacgtggagatctggacaaaagagggagaaaagaagaaactgagaccgcgctggctggatgcccggacgtactccgaccctctcgccctgaaggagttcaaagattttgctgcgggcagaaagagcattgcccttgacctggtcaccgaaatcgggcgcgtgccctctcatctcgctcacagaacacggaatgccctggataacctggtcatgctccatacctccgagcacggaggccgcgcctatagacacgctgtggaagaacttcctgagacaatggaaaccctgctgctcctgggccttatgattctgctcacagggggagccatgctgttcctgatcagcggcaaagggattggaaagacctccatcggcctcatctgtgttattgcgtctagcgggatgctttggatggccgagatccccctgcaatggattgcttccgccatcgtgctggaatttttcatgatggtgctcctgattcctgagcccgagaagcagcggacaccgcaggacaatcaacttgcttacgtcgttatcggcattctcaccctcgccgcgatcatcgccgctaacgaaatgggactgctggagacaaccaaacgcgatctcggcatgagcaaggaacctggggtggtgtctcccacgtcctatcttgacgtcgacctgcatcccgccagcgcttggacactgtacgccgtggctaccacagttattacccctatgctcagacacaccatcgaaaattctacagccaacgtgagcctggcggccattgctaaccaggccgtcgtgcttatgggactggataaaggctggccgatctccaagatggacctcggggtccccctgctggctctcggatgctactctcaggtgaatcctcttacgctgaccgccgccgttctgctcctgattacacattatgcgatcatcggccccgggcttcaggctaaagccacccgggaagctcaaaagagaacagccgccggaattatgaagaaccctaccgtggatggcatcatgacgattgacctggatcccgtcatctacgacagcaaatttgagaagcagctcggccaggtgatgctgctggttctctgtgctgtgcagcttctgctgatgcgcacatcctgggccctctgcgaggcgctgacccttgccaccgggcctattacaaccctgtgggaaggatctccgggcaaattctggaatacaacgatcgctgtcagcatggccaacatctttcgggggtcctatctcgctggagccggcctggcgttcagcattatgaagtctgtggggaccggaaaaagaggcacaggctcccaaggggagaccctgggagaaaagtggaagaaaaagctcaatcagcttagccgcaaagagtttgatctgtacaagaaatccggcatcacagaagtggaccggaccgaggccaaggaggggctgaaaagaggagaaattacgcaccatgctgtttctcggggcagcgccaagctccagtggttcgtcgagcgcaacatggtgatccccgaagggagagtgattgatctgggatgtggccggggcgggtggtcctattactgcgctggacttaagaaagtcaccgaggttcgcggctatacaaaagggggacctggccacgaggagcccgtgcctatgtctacctacgggtggaatatcgtgaaactgatgagcggaaaggacgtcttttacctgcccccggagaaatgtgatacactgctgtgcgacattggcgaatccagcccttctcccaccgtggaggaatccagaacaatccgggttctcaagatggtggagccctggcttaagaacaatcagttctgtatcaaagtcctgaacccttatatgcccaccgtgattgagcacctggaacgcctccaaagaaagcatggcgggatgctggttcggaatcctcttagccgcaactctacgcacgagatgtactggatctccaatggaacaggcaacattgtgagctctgtcaatatggtgagcagactgctcctgaaccggtttaccatgacccatagacgcccgacaatcgaaaaagatgtggacctgggggccggaacgcggcacgtcaacgctgagcccgaaacccctaatatggacgttattggcgagagaatcaagcgcatcaaagaggaacacaactccacatggcattatgatgacgagaatccctacaagacctgggcctatcacgggtcttacgaagtgaaggcgacaggaagcgcctccagcatgattaacggcgtggtcaaactcctgaccaagccttgggatgtggttcccatggtgacacagatggctatgaccgacacgaccccgttcggccagcaacgggtcttcaaagagaaggtggatacaagaacccctcgccccatgcctgggacacggaaagttatgggaatcaccgccgaatggctttggagaacgctgggccgcaataagcggcccagactctgcacacgcgaggagtttaccaagaaagtgcggacaaacgctgccatgggggccgtcttcaccgaagagaatcagtgggactccgcgaaggctgccgtggaagatgaggaattttggaaactggttgacagagagcgcgagcttcataagctgggaaaatgtggctcttgcgtgtataacatgatggggaagagagagaagaagctcggcgagttcggaaaggccaaaggcagccgggctatttggtacatgtggctgggggcccgctacctggaatttgaggctctcggattcctgaatgaggatcactggttttccagagacaactcttatagcggcgtcgaaggggagggacttcataagctgggctacatcctccgggatatttccaaaatccctgggggcgccatgtatgcggacgacacggccggatgggataccagaatcacagaagacgatctgcacaatgaggaaaagattacccagcagatggaccccgagcaccggcaacttgctaacgccatcttcaaactgacataccagaataaggtggtcaaggtgcagcgcccgacccctacaggcaccgttatggatattatctctagaaaagaccagcgggggagcggacaagtgggcacgtatgggctcaacacatttaccaatatggaggtccagctggtgcgccagatggaaggagagggcgtgctgtccaaggctgatctcgaaaacccccatctgcccgagaaaaagattacccagtggcttgaaacaaaaggggttgagagactgaagcggatggccatcagcggcgacgattgcgtggtcaagcctatcgacgatcgcttcgcgaacgccctcctggctcttaatgacatgggaaaagtgagaaaggatattccgcaatggcagccctctaaaggcatgcacgactggcagcaggttcctttttgttcccatcacttccacgagctgatcatgaaggacgggcggaaactcgtggtcccctgccgccctcaagatgaactgattggacgggcccggatcagccagggcgctgggtggtctctgcgcgagaccgcctgtctcggaaaggcttacgcccagatgtggtccctgatgtattttcatagacgggaccttcgcctggcgagcaacgccatttgctctgctgtgcccgtccactgggtgcctacatccagaacgacctggagcatccatgcccaccatcaatggatgacaaccgaagatatgctcgccgtttggaatcgggtgtggattgaggacaacccctggatggaagataagacaccggtcaccacgtgggaggacgtgccttacctgggcaaaagagaggatcagtggtgtgggtcccttatcggcctgaccagccgcgctacatgggcccagaatatcctcaccgcgattcagcaagttcggtctctgatcggaaacgaagagttcctggactacatgcccagcatgaagagattccgcaaagaagaggagtccgaaggcgctatttggtga

SEQ ID NO: 20523 - RNA, 9873 nt, synthetic construct
  misc_feature 1..9873: note = derived and/or modified CDS sequence (opt5) from DENV-3__FJ882572__SS-prME
  source 1..9873: mol_type = other RNA
accagcctgtgcctcatgatgatcctgcccgccgctcttgccttccacctgacctcccgggacggcgagcctcggatgattgtggggaagaatgaacgcggaaaatctctcctgtttaagacggcgtccggcatcaatatgtgtacccttattgctatggatctgggggagatgtgcgacgataccgtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagtctattgagggcaaagttgtgcagtatgaaaatctcaagtacacagtcatcatcaccgtgcatacaggggaccagcaccaggttggaaacgagacgcaaggcgtgaccgctgaaattacaccccaggcctccaccacagaggctatcctgcctgaatatggcaccctggggctcgagtgcagcccccgcacgggactggacttcaatgagatgattcttctgaccatgaaaaacaaggcctggatggtccatagacagtggtttttcgatctccctctgccctggacatctggcgccaccacagaaaccccgacgtggaatcggaaagagcttctggtgacatttaagaacgctcacgcgaaaaagcaagaagtcgtggttctcgggtcccaggagggagccatgcacaccgctctgacaggcgccaccgaaatccagaatagcgggggcacctctattttcgccggacatctgaagtgtcgcctcaaaatggacaagctggagcttaaaggcatgtcctacgctatgtgcacaaacacgtttgtgctgaagaaagaggtcagcgaaacccagcacgggacaatcctcatcaaggtggagtacaagggagaagatgccccttgtaaaattcccttctccaccgaggacggccaagggaaggcgcataacggaagactgatcacagctaatcctgttgtgaccaaaaaggaggaacccgtcaacattgaggccgaaccccctttcggcgagtctaatatcgtgattgggatcggcgataacgccctgaaaatcaattggtataagaagggaagctccattggcaaaatgtttgaagctacggccagaggggctagacgcatggccatccttggagacacagcgtgggatttcggcagcgtcgggggagttctcaactctctgggcaagatggtccaccagatttttgggtccgcctacaccgctctgttcagcggcgtgtcttgggtgatgaaaatcggaattggcgtcctcctgacctggatcgggcttaatagcaagaacacatccatgtcttttagctgcattgccatcggaatcattaccctgtatctcggcgctgtggttcaggccgacacagggtgtgtgatcaattggaaaggaaaggagctgaagtgcggctccgggattttcgtcacgaacgaggtgcatacctggacagaacagtacaaatttcaagcggatagcccgaagcggctggccaccgctatcgccggcgcttgggagaatggagtttgtggcattagatctacaacccgcatggaaaaccttctctggaaacagatcgccaatgagctgaactatatcctgtgggaaaataacattaagctcacggtggtcgtgggggacaccatcggagttctggagcagggcaaacggacacttacaccccagcctatggagctgaagtactcctggaaaacatgggggaaggccaagattgtgaccgctgaaatccaaaacagctctttcattatcgatggacccaatacacctgagtgcccctccgcgagcagagcctggaacgtctgggaagtggaggactatggctttggcgtgttcaccacgaatatctggctcaaactgcgcgaagtctacacacagctgtgtgaccaccggcttatgtccgctgccgttaaggatgagagagccgtgcacgctgacatggggtactggattgagtctcagaaaaacggaagctggaagctcgaaaaagcctcctttatcgaggtgaagacctgcacctggccgaagtctcatacactgtggagcaatggcgtcctggaatccgatatgattatccctaaaagcctcgcggggcccatttctcagcacaactatcgccctggataccatacccaaacggctggcccctggcacctggggaaacttgagctggacttcaattattgcgagggaacaaccgtggttatcacagaaaactgtggcacccggggcccttccctcagaacaaccacggtgagcgggaaactgatccacgagtggtgctgtcgctcttgcaccctgcccccgcttcggtacatgggagaagatggctgttggtatgggatggagattagacctatctccgaaaaggaggagaatatggtcaaaagcctcgcctctgccggaagcggcaaggtggacaactttacaatgggggttctgtgcctggctattctcttcgaagaggtgatgcggggaaagttcggcaaaaagcatatgatcgccggcgtctttttcacctttgtgctgcttctgtccgggcagattacatggcgcgatatggcgcacaccctcatcatgattggaagcaatgcttctgacagaatgggcatgggggttacgtacctggccctgatcgccacattcaaaatccagccctttcttgctctgggattctttctccggaagctgacctccagagaaaacctcctgcttggcgtggggctggccatggctacaaccctccaactgcccgaggatattgaacagatggccaatggaatcgcgctgggccttatggccctgaaactcattacccagttcgagacatatcagctgtggacggctctcatcagcctgacctgttccaacacaatgtttacccttacagtcgcctggcgcaccgctacgctgattctcgccggcgtgtctctgctgcctgtgtgccaaagctcctctatgcggaagacagactggcttccgatgaccgtcgccgctatgggggttccccctctgcccctcttcatctttagcctgaaggataccctcaaaagacgctcctggcctctgaatgagggagtgatggcggtgggccttgtctctatcctggccagctccctgctcagaaacgacgtgcccatggctgggcctctggttgccggaggcatgcttattgcctgttacgtgatcacagggaccagcgctgatctgacagtcgaaaaggccgcggacgtgacgtgggaggaagaggctgaacagaccggagtttctcataacctcatgattacagtggacgatgacggcaccatgcggatcaaagatgacgagacagagaatattctgaccgtcctcctgaagacggcccttctgatcgtgtccggcatcttcccctacagcattccggccaccctgctcgtctggcacacatggcagaaacagacccaacgctctggggtgctgtgggatgttccttctccccctgaaacacagaaggctgagcttgaagagggagtgtatagaatcaaacagcagggcattctggggaagacccaagtcggagtgggcgttcagaaggagggggtgtttcatacaatgtggcacgtcacgcggggagccgtgctcacccacaacggcaaacgcctggaacccaattgggcgagcgtgaagaaagacctcatcagctacggcgggggatggagactgtccgctcagtggcaaaagggcgaggaagttcaggtcattgccgtggagccggggaaaaaccctaagaatttccagacaatgcccggaaccttccagaccacaacgggcgaaatcggggccattgctcttgattttaagcctggaaccagcggctcccccatcatcaaccgggagggcaaagtggtcgggctgtatggaaatggcgtggttacaaagaacgggggatacgtgagcggcattgcccaaacctctgctgagcccgacgggcctacaccggaactggaggaagagatgttccgcaaaagaaatctcaccatcatggatctgcatcccggcagcggaaagacgcggaaatatcttcctgccattgtccgcgaagcgatcaagagacggctgagaacactcattctggcccccacccgcgtggttgctgccgagatggaggaagctctcaagggcctgcctatccggtaccagaccacagccaccaaatccgagcacacagggagagaaatcgtggaccttatgtgccatgccacctttacgatgcgcctgctgtctcccgtccgggtgcctaactataatctcattatcatggatgaggctcacttcacagacccggcgagcattgccgctagaggatacatctccacccgcgttggcatgggggaagccgccgctatttttatgacagccacaccccctggaacggcggatgctttcccccagtctaacgcccctatccaggacgaggagcgggacatccccgaaagaagctggaactccggcaacgagtggattaccgattttgccgggaagacagtgtggttcgtcccgtctatcaaagctggcaatgacattgccaactgtctgcgcaagaacggcaaaaaggtgatccaacttagccggaagacctttgatacagaataccagaaaaccaagctgaatgactgggatttcgtggtcacaaccgacatttccgagatgggagcgaactttaaagccgatagagttatcgaccctcggcgctgcctcaagcccgtgattctgacggatgggcccgagagagtgatcctggctggacctatgcccgtcacagccgctagcgccgctcagcggcgcggcagagtggggcggaatcctcagaaagaaaacgaccaatatatcttcaccggacagccgctcaataacgatgaggaccatgcccactggaccgaagcgaagatgcttctggacaatattaacacacccgagggcatcattcctgccctgttcgaacccgagagagagaagtctgctgccatcgatggggaataccgcctcaaaggcgagtcccggaagacctttgttgaactgatgagacgcggagaccttcctgtgtggctggctcacaaagtcgccagcgagggcattaagtatacagatcggaaatggtgcttcgacgggcagagaaataaccagatcctcgaagagaatatggatgtggagatctggacgaaggaaggagagaaaaagaagctgcgcccccggtggctggacgccagaacctactctgatccgctcgctcttaaagaatttaaggacttcgcggccggccgcaaatccattgctctggatctggttacagagatcgggagagtgcctagccatctcgcccaccggacccgcaacgccctggacaatcttgtcatgctgcatacatccgaacacggaggcagagcttatcggcacgccgtggaggagctccccgaaaccatggagacgctgctgctccttggcctgatgattctgctcaccgggggagcgatgctgtttcttatctctggcaaggggattggaaaaacaagcatcggcctgatctgtgtcattgcctccagcgggatgctctggatggctgatgtgcctctgcaatggatcgcctctgctattgttctggagttctttatgatggtgctccttatccccgagcctgagaagcagcgcacaccccaggacaaccaactggcctacgtggtcattggaatcctgacactcgcggccattatcgctgccaatgaaatgggcctgcttgagaccacgaagagagatctgggcatgtccaaagaaccgggggttgtgagccctacatcttatctcgacgtggacctgcatcccgctagcgcctggaccctgtacgctgtcgccacaaccgtgatcacccccatgctccggcacacaattgagaactccacggcgaatgtttctcttgccgctatcgccaaccaggctgtggtcctgatgggactggataagggctggcctattagcaaaatggacctcggggtgccgctgcttgccctgggatgctactcccaggtcaaccccctcaccctgacagccgcggtgctgctccttatcacccattatgctattatcggccctgggctgcaggccaaggctacaagagaagcccaaaaacgcaccgccgctggaatcatgaagaatcccacggttgatggcattatgacaatcgacctggatcctgtgatttacgactctaagttcgagaaacagctcggccaggtcatgctgcttgtgctgtgtgccgttcagctcctgctgatgcggaccagctgggcgctctgcgaggcccttaccctggctacagggcccatcaccacactgtgggaaggatcccctggcaagttttggaacacgaccattgccgtgagcatggctaatatcttcagagggtcttatctcgccggagcgggcctggccttttccatcatgaaaagcgtcgggacaggaaagcgcggcaccggctcccaaggggagacacttggagaaaaatggaagaagaaactgaaccagctctctcggaaggagttcgatctgtacaaaaagagcggcattaccgaagtggacagaacggaggctaaagaggggctgaagcggggagaaaccacacaccatgccgtgtcccgcggctctgctaaactccagtggtttgttgagagaaatatggtcatcccggaagggcgggtgattgatcttggatgtggccgcggcgggtggagctattactgcgccggactgaagaaggtgaccgaggtcagaggctatacaaaagggggacccggccacgaagaacctgttcccatgtccacctacgggtggaacatcgtgaagctgatgagcggaaaagacgtgttctacctccctcccgagaagtgtgatacactgctttgcgacattggcgaatcttccccgagccctaccgtcgaggaatctcggacgatccgcgtgctgaaaatggttgagccctggctcaagaataaccagttctgtattaaggtgctgaatccctatatgcctacagtcatcgagcacctggaaagactccaacggaaacatggcgggatgcttgtgcgcaaccccctgtccagaaatagcacccacgagatgtactggatctctaacggaaccggcaatattgttagctccgtgaacatggtctctcggctgctcctgaatagatttacaatgacgcatcgccggcctaccatcgaaagagatgtggaccttggggctggaacacgccacgtgaacgccgagccggaaattcccaacatggacgtcatcggcgagcggattaagagaatcaaagaggaacacaatagcacctggcattatgatgacgagaacccttacaagacatgggcgtatcacgggtcctacgaagttaaagccaccggaagcgcttcctctatgatcaatggcgtggtgaagctgctcacaaagccctgggatgtcgtgcctatggttacccagatggccatgacggacaccacacccttcggccagcaacgcgtgtttaaagagaaggtcgatacccggacaccgagacctatgcccgggacccgcaaagtgatggaaattacggctgagtggctgtggcggacactgggaagaaacaagcgccctcggctctgcaccagagaggagttcaccaagaaggttcgcaccaatgccgccatgggcgcggtgtttacggaggaaaaccagtgggacagcgctaaggccgccgtcgaggatgaagagttctggaaactggtggacagagagcgggaacttcataagctggggaaatgtggatcctgcgtttataatatgatgggcaagcgcgagaaaaagctcggggaatttggcaaagctaagggatctagagccatctggtacatgtggctgggcgctcggtaccttgagttcgaggccctggggtttctcaacgaagatcactggttcagcagagaaaattcctattctggagtggaaggcgaggggctgcataagctgggatacattctccgggacatcagcaaaattcccggcggggcgatgtatgccgatgacaccgctggctgggacacacgcatcaccgaagatgacctgcacaacgaggagaagatcacacagcagatggatcctgaacacagacaacttgccaatgctatttttaaactgacctaccagaacaaggtcgtgaaagtccagcggcccacaccgaccggaacggtgatggacatcatttcccgcaaggatcagagaggcagcgggcaagttggaacatatggcctcaataccttcaccaacatggaggcccagctggtgcggcagatggaaggggagggagtcctttctaaggcggacctggaaaatcctcatctcctggagaaaaagatcacacagtggctggagaccaaaggcgtggaacgcctcaagagaatggccatttccggggatgactgcgtggttaaacccatcgatgaccggtttgctaacgccctgcttgctctgaacgatatgggcaaggtgcgcaaggacatcccccaatggcagcctagcaaaggatggcacgattggcagcaggtcccgttctgttctcatcacttccacgagctcattatgaaggacggcagaaaactggtggttccctgccggcctcaagacgaacttatcgggcgcgccagaatttcccagggagctggctggagcctgcgggagacagcctgtctcgggaaggcgtacgcccagatgtggtctctgatgtattttcatcgcagagatctgcggctcgcttccaatgccatctgcagcgccgtgcccgtccactgggtgcctacgtccagaaccacatggagcattcatgctcaccatcaatggatgaccacagaagacatgctgaccgtctggaaccgcgtgtggatcgaggataatccctggatggaggacaaaacgcctgttaccacatgggaaaacgtgccctaccttggaaagcgggaggatcagtggtgtggctctctgattgggctcaccagcagagccacatgggcgcagaatatcccgaccgctatccagcaagtccgctccctgattggcaacgaagagttccttgactacatgccttctatgaagcggtttagaaaagaggaagagagcgaaggagccatctggtga

SEQ ID NO: 20524 - RNA, 9873 nt, synthetic construct
  misc_feature 1..9873: note = derived and/or modified CDS sequence (opt5) from DENV-3__FJ882573__SS-prME
  source 1..9873: mol_type = other RNA
accagcctgtgcctcatgatgatcctgcccgccgctcttgccttccacctgacctcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgttgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtgattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtgggccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaatagcgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgaccaagaaggaggaacccgtcaacattgaggccgaacctccgttcggcgagtccaatatcgtgattgggatcggcgataacgctctgaaaatcaattggtataagaagggatctagcattggcaaaatgtttgaagccaccgctagaggggccagacgcatggcgatccttggagacacggcctgggatttcggctccgtcgggggagttctcaacagcctgggcaagatggtccaccagatttttgggtctgcttacacagccctgttctccggcgtgagctgggtgatgaaaatcggaattggcgtcctcctgacctggatcgggcttaattctaagaacacccccatgagcttttcctgcattgctatcggaatcattacactgtatctcggcgccgtggttcaggcggacatggggtgtgtgatcaattggaaaggaaaggagctgaagtgcggctctgggattttcgtcaccaacgaggtgcatacatggacggaacagtacaaatttcaagccgatagccctaagcggctggctaccgccatcgctggcgcctgggagaatggagtttgtggcattagatccacaacccgcatggaaaaccttctctggaaacagatcgccaatgagctgaactatatcctgtgggaaaataacattaagctcacagtggtcgtgggggacaccacgggagttctggagcagggcaaacggacccttacaccccagcctatggagctgaagtacagctggaaaacctgggggaaggctaagatcgtgacagcggaaacccaaaactcttccttcattatcgatggacccaatacaccggagtgccctagcgcctctagagcttggaacgtctgggaagtggaggactatggctttggcgtgttcaccacgaatatttggctcaaactgcgcgaagtctacacacagctgtgtgaccaccggcttatgtccgccgccgttaaggatgagagagctgtgcacgccgacatggggtactggatcgagagccagaaaaacggatcctggaagctcgaaaaagcgtctctgatcgaggtgaagacctgcacctggcccaagagccatacactgtggtccaatggcgtcctcgaatctgatatgattatccctaaaagcctggctgggcccatttcccagcacaactatcgccctggataccatacccaaacggccggcccctggcaccttgggaagctggagctcgactttaattattgcgagggaacaaccgtggttatcacagaaaactgtggcacccggggcccgagcctgagaacaaccacggtgtctgggaaactgattcacgagtggtgctgtcgctcctgcacccttcctcccctccggtacatgggagaagatggctgttggtatgggatggagatcagacccatcagcgaaaaggaggagaatatggtcaaatctctggtgtccgccggaagcggcaaggttgacaacttcacaatgggggtgctgtgcctcgctattctgtttgaagaggtcatgcggggaaagttcggcaaaaagcatatgatcgccggcgtgttctttaccttcgttcttctgctctctgggcagattacatggcgcgatatggcgcacaccctgatcatgattggaagcaatgcttccgacagaatgggcatgggggtgacgtacctggcccttatcgccacatttaaaattcagcctttcctggctctcggatttttcctgcggaagctcaccagcagagaaaacctgcttctgggcgtcgggctcgccatggctacaaccctgcaactgccggaggatatcgaacagatggccaatggaatcgcgcttggcctgatggccctcaaactgattacccagtttgagacatatcagctctggacggctctggtgtctcttacctgttccaacacaatcttcaccctgacagtggcctggcgcaccgctacgctcattctggccggcgtcagcctgcttcccgtttgccaatcctctagcatgcggaagacagactggctgcctatgaccgtggccgctatgggggtgccccctctccccctgtttatcttctccctcaaggataccctgaaaagacgctcttggcctcttaatgagggagtcatggcggtgggcctggttagcattctggcctcctctctcctgagaaacgacgtgcccatggctgggccgcttgtcgccggaggcctgctcatcgcctgttacgtgatcacagggaccagcgctgatctgacagttgaaaaggccgcggacgtgacgtgggaggaagaggctgaacagaccggagtctcccataacctcatgattacagtggacgatgacggcaccatgcggatcaaagatgacgagacagagaatattctgaccgtccttctgaagacggccctgctcatcgtgagcggcatttttccttactctatccccgccaccctgcttgtttggcacacatggcagaaacagacccaacgctccggggtgctgtgggatgtcccttctcccccggaaacacagaaggctgagctcgaagagggagtgtatagaatcaaacagcagggcattctggggaagacccaagttggagtgggcgtccagaaggagggggtgttccatacaatgtggcacgtgacgcggggagccgttctcacccacaacggcaaacgcctggaacctaattgggcgtccgtcaagaaagaccttatctcctacggcgggggatggagactgagcgctcagtggcaaaagggcgaggaagtccaggtgattgccgtcgagcccgggaaaaaccctaagaattttcagacaatgcccggaaccttccagaccacaacgggcgaaatcggggccattgctctggatttcaagcccggaacctctggctcccctatcattaaccgggagggcaaagtggttgggctctatggaaatggcgtggtcacaaagaacgggggatacgtgagcggcatcgcccaaaccaatgctgagccggacgggcccacacctgaactggaggaagagatgtttaaaaagcgcaaccttaccatcatggatctgcatcccggctccggaaaaacgagaaagtatctccctgccattgttcgggaagcgatcaagcgcagactgcggacactcattctggcccccaccagagtggtcgctgccgagatggaggaagctcttaaaggcctgcctatccgctaccagaccacagccaccaagagcgagcacacagggcgggaaattgtggacctgatgtgccatgccaccttcacgatgagactcctgtctccggttcgcgtgcccaattataaccttatcatcatggatgaggctcactttacagaccctgcgagcattgccgctcggggatacatctccaccagagtcggcatgggggaagccgccgctattttcatgacagccacaccccctggaacggcggatgcttttccccagtctaatgccccgatccaggacgaggagcgcgacattcctgaacggagctggaactccggcaatgagtggatcaccgatttcgccgggaaaacagtgtggtttgtgccctctatcaaggctggcaacgacattgccaactgtctgcgcaaaaatggaaagaaggtcatccaactcagcagaaaaaccttcgatacagaataccagaagaccaaactgaacgactgggattttgttgtgacaaccgacatttccgagatgggcgcgaatttcaaggccgatcgggtgatcgaccccagacggtgcctgaaacctgtcattctcacggatgggcccgagcgcgtgatccttgctggacctatgccggttacagccgcttctgccgctcagagacggggccgcgtggggagaaacccccagaaggaaaatgaccaatatatttttaccggacagcctctgaacaatgatgaggaccatgcccactggaccgaagcgaagatgctgctcgacaacatcaatacacccgagggcatcattcctgccctgttcgaacccgagcgggagaaaagcgctgccatcgatggggaatacagacttaagggcgagtcccgcaaaaccttcgtcgaactgatgcggagaggagacctcccggtgtggctggctcacaaggttgccagcgagggcattaaatatacagatcgcaagtggtgctttgacgggcagcggaacaatcagatcctggaagagaacatggatgtggagatttggacgaaagaaggagagaagaagaaactcagacctcgctggcttgacgcccggacctactctgatcccctggctctgaaggagttcaaagactttgcggccggcagaaagtccatcgctctcgatctggtcacagagatcgggcgcgtgcctagccatcttgcccacagaacccggaatgccctggacaacctcgtcatgctgcatacatctgaacacggaggccgcgcttatagacacgccgtggaggagctgcccgaaaccatggagacgctccttctgctgggcctcatgattctgcttaccgggggagcgatgctgttcctcatctccggcaaagggattggaaagacaagcatcggcctgatttgtgttatcgcctcctctgggatgctgtggatggctgaagtgcctctccaatggatcgccagcgctattgtgcttgagtttttcatgatggtcctgctgatccccgagccggaaaagcagcggacccctcaggataatcaactcgcctacgttgtgattggaatcctgacacttgcggccatgattgctgccaacgagatgggcctgctcgaaaccacgaaacgcgacctgggcatgtccaaggagcccggggtggtcagccccacatcttatctggatgtggacctccatcctgcttccgcctggaccctttacgctgttgccacaaccgtgatcaccccgatgctgagacacacaattgaaaatagcacggcgaacgtctctctggccgctatcgccaaccaggctgtggtcctcatgggactggacaaaggctggcccatcagcaagatggatcttggggtgcctctgctcgccctgggatgctactcccaggttaatcccctgaccctcacagccgcggtgcttctgctgattacccattatgctatcattggccctgggctccaggccaaagctacacgggaggcccaaaagagaaccgccgctggaatcatgaagaaccccacggtcgacggcattatgacaatcgatctggaccctgtgatctacgattctaaatttgagaagcagcttggccaggttatgctgctcgtgctgtgtgccgtccagctgctccttatgcgcaccagctgggcgctgtgcgaagccctgaccctcgctacagggccgattaccacactgtgggagggatcccccggcaaattctggaatacgaccatcgccgtgtctatggctaacatttttcgggggagctatcttgccggagcgggcctggccttctccatcatgaaaagcgtggggacaggaaaaagaggcaccggctctcaaggggaaacactcggagagaagtggaagaaaaagctgaatcagctgtcccgcaaagaatttgacctctacaagaaaagcggcattaccgaggttgatcggacggaggctaaggaagggcttaaaagaggagagatcacccaccatgccgtctcccggggctctgctaagctgcagtggttcgtggaacgcaacatggtggtccctgaggggagagttatcgacctgggatgtggccggggcgggtggagctattactgcgccggactcaagaaagtgacagaagtgcgcggctataccaaagggggacccggccacgaggagcctgtccccatgtccacatacgggtggaatattgtgaaactgatgtctggaaaggatgtcttttaccttccgcctgaaaaatgtgacaccctgctctgcgatatcggcgagagctcccccagccccacagtggaagagtctagaaccattcgggtcctgaagatggtggagccttggctgaagaacaatcagttctgtatcaaagttctcaacccctatatgcctacggtgattgaacaccttgagcgcctgcaaagaaagcatggcgggatgctggtccggaatccgctctcccgcaacagcacacacgaaatgtactggatctctaatggaaccggcaacattgtgtccagcgtgaatatggtctctagactgcttctgaaccggttcaccatgacacatagacgccccacgatcgagaaagacgttgatctcggggctggaacccggcacgtgaacgccgaacctgagacacccaatatggacgtgatcggcgagagagtcaagcgcattaaagaagaacacaacagcacctggcattatgacgatgaaaatccttacaagacatgggcgtatcacgggtcctacgaggtgaaggccaccggatctgctagctccatgatcaacggcgttgtgaaactgctgacaaagccctgggacgtcgtgccgatggttacccagatggccatgacggataccacaccttttggccagcaacgggtgttcaaagaaaaggtcgacaccagaacaccccgccctatgcccgggacccggaaagtgatggagattacggctgagtggctctggagaacactgggacgcaataagcggcctagactttgcacccgcgaagagtttacaaagaaagttcggaccaacgccgccatgggcgcggtgttcacggaagagaatcagtgggatagcgctaaggccgccgtcgaagacgaggagttttggaaactggtggatagagaacgcgagctccataagctggggaaatgtggatcctgcgtctataacatgatgggcaagagagagaagaaacttggggagttcggcaaggctaaaggatctcgggccatctggtacatgtggctgggcgctcgctacctcgagtttgaagccctggggttcctgaatgaggaccactggtttagcagagaaaactcctattctggagtggagggcgaagggctccataagctgggatacattcttcgggatatcagcaaaatccccggcggggcgatgtatgccgacgataccgctggctgggacacaagaattaccgaggacgatctgcacaatgaggaaaagatcattcagcagatggacccggagcaccggcaactcgccaacgctatcttcaaactgacataccagaataaggttgtgaaggtccagcgccctacccccacaggaaccgtgatggatattatctccagaaaagaccagcggggctctgggcaagtgggaacgtatggccttaacacatttaccaatatggaagcccagctggttcgccagatggagggggaaggagtgctcaccaaggcggatctggagaacccccatctgctcgagaaaaagatcacacagtggctggaagccaaaggcgtcgagagacttaagcggatggctattagcggggacgattgcgtggttaagcctatcgacgatcgcttcgccaacgctctgctcgccctgaatgacatgggcaaagtgagaaaggatattccgcaatggcagccctccaaaggatggcacgactggcagcaggtccctttttgtagccatcacttccacgaacttatcatgaaggatggccggaaactggtggtcccctgccgccctcaagacgagctcattgggagagctcggatctctcagggagccggctggtccctgcgcgaaaccgcgtgtctggggaaggcctacgctcagatgtggagcctcatgtatttccatagacgggacctgcgccttgcctctaacgccatctgctccgctgtgcccgttcactgggtgcctacaagcagaacgacctggtctattcatgcccaccatcaatggatgacaaccgaggatatgctgacagtctggaatcgggtgtggatcgaggaaaacccctggatggaggacaagaccccggttacgacctgggaaaatgtgccttacctcggaaaaagagaggatcagtggtgtggctccctgattgggcttacaagccgcgcgacctgggctcagaacatccccacagccattcagcaagtccggtccctgatcggcaatgaggaatttctcgactacatgcctagcatgaagagattccgcaaagaggaagagtctgaaggagccatttggtga

SEQ ID NO: 20525 - RNA, 9873 nt, synthetic construct
  misc_feature 1..9873: note = derived and/or modified CDS sequence (opt5) from DENV-3__FJ898440__SS-prME
  source 1..9873: mol_type = other RNA
accagcctgtgcctcatgatgatcctgcccgcggctcttgccttccacctgacctcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctatcaccgaggctattctgcccgaatatggcacactggggctcgagtgctcccctcgcaccggactggacttcaatgagatggtccttctgacgatgaaaaacaaggcctggatggtgcatagacagtggtttttcgatctccccctgccgtggaccagcggcgccacaaccgaaacacctatctggaatcggaaagagcttctggtcacctttaagaacgctcacgcgaaaaagcaagaagtggttgtgctcgggtctcaggagggagccatgcacacggctctgacaggcgccaccgaaattcaaaattccgggggcacaagcatcttcgccggacatctgaagtgtcgcctcaaaatggacaagctggagcttaaaggcatgtcttacgctatgtgcaccaacacctttgtcctgaagaaagaggtgtccgaaacacagcacgggacgatcctcattaaggttgagtacaagggagaagatgccccctgtaaaatccctttcagcaccgaggacggccaagggaaggcgcataacggaagactgattacagctaatcccgtggtcaccaaaaaggaggaacccgtgaacatcgaggccgaacctccgttcggcgagtccaatattgtgatcgggatcggcgataacgccctgaaaattaattggtataagaagggatctagcatcggcaaaatgtttgaagctacagccagaggggctagacgcatggccattcttggagacaccgcgtgggatttcggctccgttgggggagtcctcaacagcctgggcaagatggtgcaccagatctttgggtctgcctacacggctctgttctccggcgtgagctgggtcatgaaaattggaatcggcgtgctcctgacatggattgggcttaattctaagaacaccagcatgtccttttcttgcatcgccatcggaattatcaccctgtatctcggcgctgttgtgcaggccgacacagggtgtgtcattaattggaaaggaaaggagctgaagtgcggcagcgggatcttcgtgaccaacgaggttcatacatggacggaacagtacaaatttcaagcggattcccccaagcggctggccaccgctattgccggcgcttgggagaatggagtgtgtggcatcagaagcacaacccgcatggaaaaccttctctggaaacagatcgccaatgagctgaactatattctgtgggaaaataacatcaagctcacagtcgtggttggggacattatcggagtgctggagcagggcaaacggacccttacgcctcagcccatggagctgaagtactcttggaaaacctgggggaaggccaagattgtcacagctgaaacccaaaactccagcttcatcatcgatggacctaatacacccgagtgcccgtctgcgtccagagcctggaacgtgtgggaagtggaggactatggctttggcgtcttcaccacaaatatttggctcaaactgcgcgaagtttacacccagctgtgtgaccaccggcttatgagcgctgccgtgaaggatgagagagccgtgcacgctgacatggggtactggatcgagtcccagaaaaacggatcttggaagctcgaaaaagccagcctgattgaggtcaagacgtgcacatggcctaagtcccataccctgtggtctaatggcgtgctcgaaagcgatatgatcattcccaaatccctggcggggcctatcagccagcacaactatcgccccggataccatacccaaacagctggcccttggcaccttgggaagctggagctcgactttaattattgcgagggaaccacggttgtgatcacagaaaactgtggcacccggggcccctctctgagaacaaccacagtctccgggaaactgattcacgagtggtgctgtcgcagctgcacccttccgcctctccggtacatgggagaagatggctgttggtatgggatggagatcagacccatttctgaaaaggaggagaatatggtgaaatccctggttagcgccggatctggcaaggtggacaacttcacgatgggggtcctgtgcctcgccatcctgtttgaagaggtgatgcggggaaagttcggcaaaaagcatatgattgctggcgttttctttaccttcgtgcttctgctcagcgggcagatcacatggcgcgatatggcccacaccctgattatgatcggatccaatgcgagcgacagaatgggcatgggggtcacatacctggctcttatcgccacctttaaaattcagcccttcctggccctcggatttttcctgcggaagctcacgtctagagaaaacctgcttctgggcgtggggctcgctatggccacaaccctgcaactgcctgaggatatcgaacagatggctaatggaattgcccttggcctgatggcgctcaaactgatcacacagtttgagacctatcagctctggaccgccctgatttcccttacatgtagcaacacgatcttcaccctgacagtggcttggcgcaccgccacactcatcctggctggcgtctccctgcttccggtttgccaatctagctccatgcggaagaccgactggctgcccatgacggtggccgccatgggggtgcagcctctccccctgtttattttctctctcaaggatacactgaaaagacgcagctggcctcttaatgagggagtcatggctgtgggcctggtttccatcctggcgtctagcctcctgagaaacgacgtgcccatggccgggcctcttgtcgctggaggcctgctcattgcctgttacgtgatcaccgggacctccgccgatctgacagttgaaaaggctgccgacgtgacctgggaggaagaggcggaacagacaggagtcagccataacctcatgattacggtggacgatgacggcaccatgcggatcaaagatgacgagacagagaatatcctgaccgtccttctgaagacagctctgctcattgtgtctggcatctttccctactccattccggccaccctgcttgtttggcacacgtggcagaaacaaacccagcgcagcggggtgctgtgggatgtcccttctccccctgaaacacagaaggccgagctcgaagagggagtgtatagaatcaaacagcaaggcattttcgggaagacccaggttggagtgggcgtccagaaggagggggtgtttcatacaatgtggcacgtgacccggggagctgttctgacatacaacggcaaacgcctcgaacccaattgggcctccgtcaagaaagacctgatcagctatggcgggggatggagactttctgcgcaatggcagaagggcgaggaagtccaggtgattgctgtcgagccggggaaaaaccctaagaatttccagacgatgcccggaaccttccaaacaaccaccggcgaaatcggggccatcgccctggattttaagcctggaacatccggcagccccattatcaaccgggagggcaaagtggttgggctgtacggaaatggcgtggtcacgaagaacgggggatatgtgtccggcattgctcagaccaatgccgagcccgacgggcctacaccggaactcgaggaagagatgttcaaaaagcgcaacctgaccatcatggatcttcaccccggcagcggaaaaacaagaaagtacctgcctgctattgttcgggaagccatcaagcgcagactccggaccctgatcctcgcgcccacgagagtggtcgccgctgagatggaggaagccctgaaaggccttcctattcgctatcagacaaccgctaccaagtctgagcatacagggcgggaaatcgtggacctgatgtgccacgccacctttacaatgagactgctcagccccgttcgcgtgcctaattacaacctgattatcatggatgaggcccatttcaccgacccggcttccattgcggcccggggatacatctctacgagagtcggcatgggggaagctgccgccatctttatgacagctacaccccctggaacagccgatgcgttcccccagagcaatgctcctattcaagacgaggagcgcgacatccccgaacggtcctggaactctggcaatgagtggattaccgattttgccgggaaaacggtgtggttcgtgccgagcatcaaggccggcaacgacattgctaactgtcttcgcaaaaatggaaagaaggtcatccagctgtccagaaaaacctttgatacagaatatcagaagaccaaactcaacgactgggatttcgttgtgacaaccgacatttctgagatgggcgccaattttaaggcggatcgggtgatcgaccctagacggtgcctgaaacccgtcatcctgacagatgggcccgagcgcgtgattctcgccggacctatgcccgttaccgctgccagcgctgcccagagacggggccgcgtggggagaaaccctcaaaaggaaaatgaccagtacatcttcacgggacagccgcttaacaatgatgaggaccacgctcattggacagaagccaagatgctgctggacaacattaatacccccgagggcatcattcctgccctcttcgaacccgagcgggagaaatccgccgctatcgatggggaatatagactgaagggcgagagccgcaaaacctttgtcgaacttatgcggagaggagacctgcctgtgtggctcgcccacaaggttgcttctgagggcatcaaatacacagatcgcaagtggtgcttcgacgggcagcggaacaatcaaattctggaagagaacatggatgtggagatctggaccaaagaaggagagaagaagaaactgagaccccgctggctcgacgcccggacatattccgatccgcttgccctgaaggaatttaaagacttcgctgcgggcagaaagagcattgccctggatctcgtcacggagatcgggcgcgtgccttctcacctggctcatagaacccggaatgcccttgacaacctggtcatgctccacacatccgaacatggaggccgcgcctacagacacgctgtggaggagctgcccgaaaccatggagacactgctccttctgggcctgatgattctcctgaccgggggagccatgctttttctgatcagcggcaaagggatcggaaagacgtccattggcctcatctgtgttattgcgtctagcgggatgctgtggatggccgaaatccctctgcagtggattgcttccgccatcgtgctcgagttctttatgatggtgcttctgattcccgagcctgaaaagcagcggacaccccaggataatcagctggcttatgtcgttatcggaatcctcacactggccgcgattatcgccgctaacgagatgggccttctggaaaccaccaagaaggacctcggcatgagcaaagagccgggggtggtgtctcctacctcctacctggatgtcgacctgcaccccgccagcgcttggacgctctacgccgtggctacaaccgttattacacccatgcttcgccataccatcgaaaattctaccgccaacgtgagcctggcggccattgctaaccaggccgtcgtgctgatgggactcgacaagggctggcctatctccaaaatggatctgggggtcccgcttctggctctcggatgctattctcaggtgaatcccctgacactgacggccgccgttctccttctgatcacccactacgcgattatcggccctgggctgcaagctaaggccacaagagaggctcagaagcggaccgccgccggaattatgaaaaaccccacagtggacggcatcatgaccattgatctcgaccctgtcatctatgatagcaagttcgagaaacagctgggccaggtgatgcttctggttctctgtgctgtgcaactgctgctcatgagaacgtcctgggccctttgcgaagcgctgacactggccaccgggcccatcaccacactctgggagggatctcctggcaagttttggaataccacaattgctgtcagcatggccaacatcttccgcgggtcctacctggctggagccggccttgcgtttagcattatgaaatctgtggggacgggaaagcggggcaccggctcccagggggaaacactgggagagaagtggaaaaagaaactcaatcagctgagcagaaaggagttcgacctgtataaaaagtccggcatcaccgaggtggatcgcacagaggccaaagaagggctcaagcggggagagattacccatcacgctgtttctagaggcagcgccaaacttcagtggtttgtcgaacggaacatggtgatcccggaggggcgcgtgattgacctgggatgtggcagaggcgggtggtcctactattgcgctggactgaaaaaggtcacggaagttcggggctacaccaaagggggacccggccatgaggagcctgtgcccatgtctacatacgggtggaatatcgtgaagctcatgagcggaaaagatgtcttctatctgcctcccgaaaagtgtgacacccttctgtgcgatatcggcgagtccagcccgtctcctacagtggaagagtcccgcaccattagagttctcaagatggtggagccctggctgaaaaacaatcaattctgtatcaaggtcctgaacccctacatgcctacagtgattgaacacctcgagcggcttcagcgcaaacacggcgggatgctggttagaaatcccctgagccggaactctacccatgaaatgtattggatctccaatggaacgggcaacattgtggccagcgtcaatatggtgtctcgcctcctgcttaacagatttacaatgacccaccggagacctaccatcgagaaggacgtggatctgggggctggaacacgccatgtcaacgccgaaccggagacgcccaatatggacgttatcggcgagcggattaaaagaatcaaggaagaacacaacagcacctggcactacgacgatgaaaatccttataagacatgggcgtaccatgggtcctatgaggtgaaagccaccggatctgctagctccatgattaacggcgtggtcaagctcctgacaaaaccctgggacgtggttcctatggtgacccagatggccatgacagataccacgcccttcggccaacagcgcgtctttaaggaaaaagtggacacccggacaccgagaagcatgcctgggacccgccgggttatgggaatcacagctgagtggctgtggagaaccctcggccgcaataagaagccccggctgtgcacgagagaggagttcaccaagaaggtgcgcaccaacgccgccatgggggcggtctttacagaggaaaatcagtgggattccgctaaagccgccgtggaggacgaagatttctggaaacttgttgaccgggagagagagctgcacaaactcggaaagtgtggctcttgcgtgtacaacatgatggggaaacgcgaaaagaagctgggcgagtttggaaaagctaagggcagcagagccatttggtacatgtggcttggggctcggtatctggagttcgaggccctcggatttctgaatgaggatcattggttctcccgcgaaaactcttacagcggcgtcgagggggaaggactgcacaaactcggctatatcctgagagacatctccaagattcctgggggcgcgatgtacgccgatgacaccgctggatgggacacgcggatcaccgaggatgaccttcataatgaagagaaaattacacagcaaatgaaccccgagcacagacagctggccaatgctatctttaagctcacctatcagaacaaggtggtcaaagtgcagcggcctacacccaccggcacagttatggatattatctctcgcaaggaccaaagagggagcggacaggtgggcacctacgggctgaatacgttcacaaacatggaagcccagcttatccggcagatggagggagaaggcgtcctgtccaaagcggatctcgagaacccgcatctgcctgaaaagaaaattacccaatggctggagaccaagggggtggagcgcctcaagagaatggccatcagcggcgacgattgcgtggttaaacccattgacgatcggtttgctaatgccctgcttgctctgaacgacatgggaaaggtgcgcaaagatatcccccagtggcagccttctaagggctggcatgactggcagcaagtcccgttctgttcccaccatttccacgaactcattatgaaagatgggagaaagctggtggttccctgccggcctcaggacgagcttatcggacgcgccagaattagccagggcgctgggtggtctctgcgggaaacagcctgtctcggaaaggcgtatgcccaaatgtggtccctgatgtactttcaccgcagagacctgcggctcgctagcaatgccatctgctctgccgtgcccgtccattgggtgcctacctcccgcacaacgtggagcatccacgctcatcaccagtggatgaccacagaggatatgctgaccgtctggaacagagtgtggattgaagacaatccctggatggaggataaaacacctgttaccacgtgggagaacgtgccctaccttggcaagcgggaagaccagtggtgtgggtccctgatcggcctcaccagcagagccacatgggcgcagaatattccgaccgctatccaacaggtccgctctctgattggaaacgaggagttccttgattatatgcctagcatgaaacggtttagaaaggaggaggaatccgagggcgccatctggtga

SEQ ID NO: 20526 - RNA, 9873 nt, synthetic construct
  misc_feature 1..9873: note = derived and/or modified CDS sequence (opt5) from DENV-3__FJ898441__SS-prME
  source 1..9873: mol_type = other RNA
accagcctgtgcctcatgatgatcctgcccgcggctcttgccttccacctgacctcccgggacggcgagcctcggatgattgtggggaagaacgaacgcggaaagtctctcctgtttaagacggcgagcggcatcaatatgtgtacccttattgctatggatctgggggagatgtgcgacgataccgtgacctacaagtgtccgcacatcaccgaagttgagcccgaagacattgattgctggtgtaacctcacctccacatgggtgacctatggaacgtgcaatcaggccggcgagcaccggcgggacaagcgctctgtggccctggctcctcatgtggggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaaatggttcagtatgaaaatctcaagtacacagtgatcatcaccgtccatacaggggaccagcaccaggtgggaaacgagacgcaaggcgttaccgctgaaattacacctcaggcctctatcaccgaggctattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgccacaaccgaaacacctacctggaatcggaaagagcttctggtcacgtttaagaacgctcacgcgaaaaagcaagaagtggtcgtgctcgggtctcaggagggagccatgcacacagctctgaccggcgccacagaaattcagaatagcgggggcaccaccatcttcgccggacatctgaagtgtcgcctcaaaatggacaagctggagcttaaaggcatgagctacgctatgtgcacaaacacgtttgttctgaagaaagaggtgtctgaaacccagcacgggacaatcctcattaaggtcgagtacaagggagaagatgccccctgtaaaatccctttctccaccgaggacggccaagggaaggcgcataacggaagactgattacagctaatcccgtggttaccaaaaaggaggaacccgtgaacatcgaggccgaacctccgttcggcgagagcaatattgtcatcgggatcggcgataacgccctgaaaattaattggtataagaagggatcctctatcggcaaaatgtttgaagctacggccagaggggctagacgcatggccattcttggagacacagcgtgggatttcggcagcgtcgggggagtgctcaactccctgggcaagatggttcaccaggtctttgggagcgcctacaccgctctgttctctggcgtgtcctgggtgatgaaaatcggaattggcgtcctcctgacctggatcgggcttaatagcaagaacacatctatgagcttttcctgcattgccatcggaatcattaccctgtatctcggcgctgtggttcaggccgacacagggtgtgtgatcaattggaaaggaaaggagctgaagtgcggctctgggattttcgtcacgaacgaggtgcatacctggacagaacagtacaaatttcaagcggatagccccaagcggctggccaccgctatcgccggcgcttgggagaatggagtttgtggcattagatccacaacccgcatggaaaaccttctctggaaacagatcgccaatgagctgaactatatcctgtgggaaaataacattaagctcacggtggtcgtgggggacatcattggagttctggagcagggcaaacggacccttacacctcagcccatggagctgaagtacagctggaaaacctgggggaaggccaagatcgtgacagctgaaacccaaaactcttccttcattatcgatggacctaatacacccgagtgcccgagcgcgtctagagcctggaacgtctgggaagtggaggactatggctttggcgtgttcaccacgaatatctggctcaaactgcgcgaagtctacacacagctgtgtgaccaccggcttatgtccgctgccgttaaggatgagagagccgtgcacgctgacatggggtactggattgagagccagaaaaacggatcctggaagctcgaaaaagcctctctgatcgaggtgaagacctgcacctggcctaagagccatacactgtggtccaatggcgtcctcgaatctgatatgattatccccaaaagcctggcggggcctatttcccagcacaactatcgccccggataccatacccaaacggctggcccttggcaccttgggaagctggagctcgactttaattattgcgagggaacaaccgtggttatcacagaaaactgtggcacccggggccccagcctgagaacaaccacggtgtctgggaaactgatccacgagtggtgctgtcgctcctgcacccttccgcctctccggtacatgggagaagatggctgttggtatgggatggagattagacccatcagcgaaaaggaggagaatatggtcaaatctctggtgtccgccggaagcggcaaggttgacaacttcacaatgggggtgctgtgcctcgccattctgtttgaagaggtcatgcggggaaagttcggcaaaaagcatatgatcgtgggcgttttctttaccttcgtgcttctgctctctgggcagattacatggcgcgatatggctcacaccctgatcatgattggaagcaatgcctccgacagaatgggcatgggggtcacgtacctggcgcttatcgctacatttaaaatccagcccttcctggccctcggatttttcctgcggaagctcaccagcagagaaaacctgcttctgggcgtggggctcgccatggctacaaccctgcaactgcctgccgatattgagcagatggctaatggaatcgcccttggcctgatggcgctcaaactgattacccagtttgaaacatatcagctctggacggccctgatctctcttacctgttccaacacaattttcaccctgacagtggcttggcgcaccgccacgctcatcctggctggcgtcagcctgcttccggtttgccaatcctctagcatgcggaagacagactggctgcccatgaccgtggccgccatgggggtgcagcctctccccctgtttatcttctccctcaaggataccctgaaaagacgctcttggcctcttaatgagggagtcatggctgtgggcctggttagcattctggcgtcctctctcctgagaaacgacgtgcccatggccgggcctcttgtcgctggaggcctgctcatcgcctgttacgtgattacagggaccagcgccgatctgacagttgagaaggctgccgacgtgacgtgggaagaggaagcggagcagaccggagtctcccataacctcatgatcacagtggacgatgacggcaccatgcggattaaagatgacgaaacagagaatatcctgaccgtccttctgaagacggctctgctcatcgtgagcggcatttttccctactctatcccggccaccctgcttgtttggcacacatggcagaaacaaacccagcgctccggggtgctgtgggatgtcccttctccccctgagacacagaaggccgaactcgaggaaggagtgtatagaattaaacagcaaggcatcttcgggaagacccaggttggagtgggcgtccagaaggagggggtgtttcatacaatgtggcacgtgacgcggggagctgttctgacctacaacggcaaacgcctcgagcccaattgggcctccgtcaagaaagacctgatttcctatggcgggggatggagacttagcgcgcaatggcagaagggcgaagaggtccaggtgatcgctgtcgaaccggggaaaaaccctaagaatttccagacaatgcccggaaccttccaaaccacaacgggcgagattggggccatcgccctggattttaagcctggaacctctggctcccccatcattaaccgggaaggcaaagtggttgggctgtacggaaatggcgtggtcacaaagaacgggggatatgtgagcggcatcgctcagaccaatgccgagcccgacgggcctacaccggagctcgaagaggaaatgttcaaaaagcgcaacctgaccattatggatcttcaccccggctccggaaaaacgagaaagtacctgcctgctatcgttcgggaggccattaagcgcagactccggacactgatcctcgcgcccaccagagtggtcgccgctgaaatggaggaggccctgaaaggccttcctatccgctatcagaccacagctaccaagagcgaacatacagggcgggagattgtggacctgatgtgccacgccacctttacgatgagactgctctctcccgttcgcgtgcctaattacaacctgatcattatggatgaagcccatttcacagacccggctagcatcgcggcccggggatacatttccaccagagtcggcatgggggaggctgccgccatctttatgacagctacaccccctggaacggccgatgcgttcccccagtctaatgctcctatccaagacgaggaacgcgacattcccgagcggagctggaactccggcaatgaatggatcaccgattttgccgggaaaacagtgtggttcgtgccgtctattaaggccggcaacgacatcgctaactgtcttcgcaaaaatggaaagaaggtcattcagctgagcagaaaaacctttgatacagagtatcagaagaccaaactcaacgactgggatttcgttgtgacaaccgacatctccgaaatgggcgccaattttaaggcggatcgggtgattgaccctagacggtgcctgaaacccgtcatcctgacggatgggcccgagcgcgtgatcctcgccggacctatgcccgttacagctgcctctgctgcccagagacggggccgcgtggggagaaaccctcaaaaggagaatgaccagtacattttcaccggacagccgcttaacaatgatgaagaccacgctcattggaccgaggccaagatgctgctggacaacatcaatacacccgaaggcattatccctgccctcttcgagcccgaacgggagaaaagcgccgctattgatggggagtatagactgaagggcgaatcccgcaaaacctttgtcgagcttatgcggagaggagacctgcctgtgtggctcgcccacaaggttgctagcgaaggcatcaaatacacagatcgcaagtggtgcttcgacgggcagcggaacaatcaaatcctggaggaaaacatggatgtggagatttggacgaaagagggagaaaagaagaaactgagaccccgctggctcgacgcccggacctattctgatccgcttgccctgaaggagtttaaagacttcgctgcgggcagaaagtccatcgccctggatctcgtcacagaaattgggcgcgtgcctagccacctggctcatagaacccggaatgcccttgacaacctggtcatgctccacacatctgagcatggaggccgcgcctacagacacgctgtggaggaactgcccgagaccatggaaacgctgctccttctgggcctgatgatcctcctgaccgggggagccatgctttttctgatttccggcaaagggatcggaaagacaagcatcggcctcatttgtgttatcgcgtcctctgggatgctgtggatggccgagattcctctgcagtggatcgctagcgccattgtgctcgagttctttatgatggtgcttctgatccccgagcctgagaagcagcggacaccccaagataatcagctggcttatgtcgttattggaatcctcacactggccgcgatcattgccgctaacgaaatgggccttctggagaccacgaaaaaggacctcggcatgtccaaagaaccgggggtggtgagctctacatcctacctggatgtcgacctgcaccctgccagcgcttggaccctctacgccgtggctacaaccgttatcacccccatgcttcgccatacaattgaaaattctacggccaacgtgagcctggcggccatcgctaaccaggccgtcgtgctgatgggactcgacaagggctggcccatttccaaaatggatctgggggtccctcttctggctctcggatgctattctcaggtgaatccgctgaccctgacagccgccgttctccttctgatcacccactacgcgatcattggccccgggctgcaagctaaggccacaagagaagctcagaagcggaccgccgccggaatcatgaaaaaccctacggtggacggcattatgacaatcgatctcgaccccgtcatttatgatagcaagttcgagaaacagctgggccaggtgatgcttctggttctctgtgctgtgcaactgctgctcatgagaacctcctgggccctttgcgaggcgctgaccctggccacagggcctatcaccacactctgggaaggatctcccggcaagttttggaatacgaccatcgctgtcagcatggccaacattttccgcgggtcctacctggctggagccggccttgcgtttagcatcatgaaatctgtggggacaggaaagcggggcaccggctcccagggggagacactgggagaaaagtggaaaaagaaactcaatcagctgagcagaaaggagttcgacctgtataaaaagtccggcattaccgaagtggatcgcacggaggccaaagaggggctcaagcggggagaaatcacccatcacgctgtttctagaggcagcgccaaacttcagtggtttgtcgagcggaacatggtgattcctgaagggcgcgtgatcgacctgggatgtggcagaggcgggtggtcctactattgcgctggactgaaaaaggtcacagaggttcggggctacaccaaagggggaccgggccatgaggaacccgtgcctatgtctacatacgggtggaatattgtgaagctcatgaccggaaaagatgtcttctatctgccccctgagaagtgtgacacacttctgtgcgatatcggcgaaagctcccccagcccgaccgtggaggaatctcgcacgatcagagttctcaagatggtggagccttggctgaaaaacaatcaattctgtattaaggtcctgaacccctacatgcccacagtgatcgagcacctcgaacggcttcagcgcaaacacggcgggatgctggttagaaatcctctgtcccggaacagcacccatgagatgtattggatttctaatggaaccggcaacatcgtggcctccgtcaatatggtgagccgcctcctgcttaacagatttacaatgacgcaccggagacccaccattgaacgcgacgtggatctgggggctggaacacggcatgtcaacgccgagcctgaaaccccgaatatggacgttatcggcgagagaatcaagcgcattaaagaggaacacaactctacatggcactacgacgatgagaatccctataagacctgggcgtaccatgggagctatgaagtgaaggccacaggatccgcttctagcatgatcaacggcgtggtcaaactcctgaccaagccttgggacgtggttcccatggtgacgcagatggccatgaccgatacaacccctttcggccaacagcgggtctttaaagagaaggtggacacaagaacaccccgctccatgccggggacgcggaaagttatgggaattacagctgaatggctgtggagaaccctcggccgcaataagaagcctcggctgtgcacaagagaggagttcaccaaaaaggtgcgcacgaacgccgccatgggggcggtctttaccgaagagaatcagtgggatagcgctaaagccgccgtggaagacgaggatttctggaaacttgttgaccgggaaagagagctgcacaaactcggaaagtgtggctcctgcgtgtacaacatgatggggaaacgcgagaagaagctgggcgaatttggaaaagctaagggctctagagccatctggtacatgtggcttggggctcggtatctggagttcgaagccctcggatttctgaatgaggatcattggttcagccgcgagaactcctactctggcgtcgaaggggagggactgcacaaactcggctatattctgagagacatcagcacaatccccgggggcgcgatgtacgccgatgacaccgctggatgggacacacggattaccgaagatgaccttcataatgaggaaaagatcacacagcaaatggatcctgagcacagacagctggccaacgctatttttaaactcacctatcagaataaggtggtcaaggtgcagcggcccacgcctacaggcaccgttatggacatcatttcccgcaaagatcaaagagggtctggacaggtgggcacctacgggctgaacacattcaccaatatggaggcccagcttatccggcagatggaaggagagggcgtcctgagcaaggcggacctcgaaaacccccatctgccggagaaaaagatcacacaatggctggaaacgaaaggggtggagcgcctcaagagaatggccatttccggcgatgactgcgtggttaagcctatcgatgaccggtttgctaacgccctgcttgctctgaatgatatgggaaaagtgcgcaaggacattccccagtggcagcccagcaaaggctggcatgattggcagcaagtccctttctgttctcaccatttccacgagctcatcatgaaggacgggagaaaactggtggttccgtgccggccccaggacgaacttattggacgcgccagaatctcccagggcgctgggtggagcctgcgggagaccgcctgtctcggaaaggcgtatgcccaaatgtggtctctgatgtactttcaccgcagagatctgcggctcgcttccaacgccatttgcagcgccgtgcctgtccattgggtgcccacatctcgcaccacatggtccatccacgctcatcaccagtggatgaccacggaagacatgctgaccgtctggaatagagtgtggatcgaggataacccttggatggaagacaagacacccgttaccacatgggagaatgtgccttaccttggcaaacgggaggatcagtggtgtgggagcctgattggcctcacctccagagccacgtgggcgcagaacatccccacagctattcaacaggtccgcagcctgatcggaaatgaagagttccttgactatatgccgtctatgaagcggtttagaaaagaagaggagagcgaaggcgccatttggtga

SEQ ID NO: 20527 - RNA, 9873 nt, synthetic construct
  misc_feature 1..9873: note = derived and/or modified CDS sequence (opt5) from DENV-3__FJ898442__SS-prME
  source 1..9873: mol_type = other RNA
accagcctgtgcctcatgatgatcctgcccgccgctcttgccttccacctgacctcccgggacggcgaacctcggatgattgtggggaagaacgaacgcggaaaatctctcctgtttaagacggcgagcggcatcaatatgtgtacccttattgctatggatctgggggaaatgtgcgacgataccgtgacctacaaatgtccgcacatcaccgaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaaatggttcagtatgaaaatctcaagtacacagtgatcatcaccgtccatacaggggaccagcaccaggtgggaaacgagacgcaaggcgttaccgctgaaattacacctcaggcctctatcaccgaggctattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgccacaaccgaaacacctacctggaatcggaaagagcttctggtcacgtttaagaacgctcacgcgaaaaagcaagaagtggtcgtgctcgggtctcaggagggagccatgcacacagctctgaccggcgccacagaaattcagaatagcgggggcaccaccatcttcgccggacatctgaagtgtcgcctcaaaatggacaagctggagcttaaaggcatgagctacgctatgtgcacaaacacgtttgttctgaagaaagaggtgtctgaaacccagcacgggacaatcctcattaaggtcgagtacaagggagaagatgccccctgtaaaatccctttctccaccgaggacggccaagggaaggcgcataacggaagactgattacagctaatcccgtggttaccaaaaaggaggaacccgtgaacatcgaggccgaacctccgttcggcgagagcaatattgtcatcgggatcggcgataacgccctgaaaattaattggtataagaagggatcctctatcggcaaaatgtttgaagctacggccagaggggctagacgcatggccattcttggagacacagcgtgggatttcggcagcgtcgggggagtgctcaactccctgggcaagatggttcaccaggtctttgggagcgcctacaccgctctgttctctggcgtgtcctgggtgatgaaaatcggaattggcgtcctcctgacctggatcgggcttaatagcaagaacacatctatgagcttttcctgcattgccatcggaatcattaccctgtatctcggcgctgtggttcaggccgacacagggtgtgtgatcaattggaaaggaaaggagctgaagtgcggctctgggattttcgtcacgaacgaggtgcatacctggacagaacagtacaaatttcaagcggatagccccaagcggctggccaccgctatcgccggcgcttgggagaatggagtttgtggcattagatccacaacccgcatggaaaaccttctctggaaacagatcgccaatgagctgaactatatcctgtgggaaaataacattaagctcacggtggtcgtgggggacatcattggagttctggagcagggcaaacggacccttacacctcagcccatggagctgaagtacagctggaaaacctgggggaaggccaagatcgtgacagctgaaacccaaaactcttccttcattatcgatggacctaatacacccgagtgcccgagcgcgtctagagcctggaacgtctgggaagtggaggactatggctttggcgtgttcaccacgaatatctggctcaaactgcgcgaagtctacacacagctgtgtgaccaccggcttatgtccgctgccgttaaggatgagagagccgtgcacgctgacatggggtactggattgagagccagaaaaacggatcctggaagctcgaaaaagcctctctgatcgaggtgaagacctgcacctggcctaagagccatacactgtggtccaatggcgtcctcgaatctgatatgattatcccccgcagcctggcggggcctatttcccagcacaactatcggcccggataccatacccaaacggctggcccttggcaccttgggaaactggagctcgactttaattattgcgagggaacaaccgtggttatcacagaaaactgtggcaccagaggccccagcctgcgcacaaccacggtgtctgggaagctgatccacgagtggtgctgtcggtcctgcacccttccgcctctcagatacatgggagaagatggctgttggtatgggatggagattcggcccatcagcgaaaaagaggagaatatggtcaagtctctggtgtccgccggaagcggcaaagttgacaacttcacaatgggggtgctgtgcctcgccattctgtttgaagaggtcatgcgcggaaagttcggcaagaaacatatgatcgctggcgtgttctttaccttcgttcttctgctctctgggcagattacatggagagatatggcccacaccctgatcatgattggaagcaatgcgtccgaccggatgggcatgggggtgacgtacctggctcttatcgccacatttaagatccagcccttcctggccctcggatttttcctgagaaaactcaccagccgcgaaaacctgcttctgggcgtcgggctcgctatggccacaaccctgcaactgcctgctgatattgagcagatggccaatggaatcgcgcttggcctgatggccctcaagctgattacccagtttgaaacatatcagctctggacggctctgatctctcttacctgttccaacacaattttcaccctgacagtggcctggcggaccgctacgctcatcctggccggcgtgagcctgcttccggtctgccaatcctctagcatgagaaaaacagactggctgcccatgaccgttgccgctatgggggtgcagcctctccccctgtttatcttctccctcaaggataccctgaagcgcagatcttggcctcttaatgagggagtgatggcggtcggcctggtgagcattctggcctcctctctcctgcggaacgacgttcccatggctgggcctcttgtggccggaggcctgctcatcgcctgttacgtcattacagggaccagcgctgatctgacagtggagaaagccgcggacgttacgtgggaagaggaagctgagcagaccggagtgtcccataacctcatgatcacagtcgacgatgacggcaccatgcgcattaaggatgacgaaacagagaatatcctgaccgtgcttctgaaaacggccctgctcatcgtcagcggcatttttccctactctatcccggccaccctgcttgtgtggcacacatggcagaagcaaacccagagatccggggttctgtgggatgtgccttctccccctgagacacagaaagctgaactcgaggaaggagtctatcggattaagcagcaaggcatcttcgggaaaacccaggtgggagttggcgtgcagaaggagggggtctttcatacaatgtggcacgtgacgcgcggagccgtgctgacctacaacggcaagagactcgagcccaattgggcgtccgttaaaaaggacctgatttcctatggcgggggatggcggcttagcgctcaatggcagaaaggcgaagaggtccaggtgatcgccgtggaaccggggaagaaccctaaaaatttccagacaatgcccggaaccttccaaaccacaacgggcgagattggggccatcgctctggattttaagcctggaacctctggctcccccatcattaaccgcgaaggcaaggtcgtggggctgtacggaaatggcgttgtgaccaagaacgggggatatgtcagcggcatcgcccagaccaatgctgagcccgacgggcctacaccggagctcgaagaggaaatgttcaagaaaagaaacctgaccattatggatcttcaccccggctccggaaagacgcggaaatacctgcctgccatcgtgcgcgaggcgattaagagacggctcagaacactgatcctcgcccccacccgcgttgtggctgccgaaatggaggaggctctgaagggccttcctatccggtatcagaccacagccaccaaaagcgaacatacagggagagagattgtcgacctgatgtgccacgccacctttacgatgcgcctgctctctcccgtgcgggttcctaattacaacctgatcattatggatgaagctcatttcacagacccggcgagcatcgccgctagaggatacatttccacccgcgtgggcatgggggaggccgccgctatctttatgacagccacaccccctggaacggcggatgctttcccccagtctaatgcccctatccaagacgaggaacgggacattcccgagagaagctggaactccggcaatgaatggatcaccgattttgccgggaagacagtctggttcgtgccgtctattaaagctggcaacgacatcgccaactgtcttcgcaagaatggcaaaaaggtgattcagctgagccggaagacctttgatacagagtatcagaaaaccaagctcaacgactgggatttcgtcgttacaaccgacatctccgaaatgggagcgaattttaaagccgatagagtgattgaccctcggcgctgcctgaagcccgtgatcctgacggatgggcccgagagagtcatcctcgctggacctatgcccgtgacagccgcttctgccgctcagcggcgcggcagagttgggcggaaccctcaaaaagagaatgaccagtacattttcaccggacagccgcttaacaatgatgaagaccacgcccattggaccgaggcgaagatgctgctggacaacatcaatacacccgaaggcattatccctgccctcttcgagcccgaaagagaaaagagcgctgccattgatggggagtatcgcctgaaaggcgaatcccggaagacctttgtggagcttatgagacgcggagacctgcctgtctggctcgctcacaaagtggccagcgaaggcatcaagtacacagatcggaaatggtgcttcgacgggcagagaaacaatcaaatcctggaggaaaacatggatgttgagatttggacgaaggagggagagaagaagaagctgcgcccccggtggctcgacgccagaacctattctgatccgcttgctctgaaagagtttaaggacttcgcggccggccgcaaatccatcgctctggatctcgtgacagaaattgggagagtccctagccacctggcccatcggacccgcaatgcccttgacaacctggtgatgctccacacatctgagcatggaggcagagcttaccggcacgccgtcgaagaactgcccgagaccatggaaacgctgctccttctgggcctgatgatcctcctgaccgggggagcgatgctttttctgatttccggcaaggggatcggaaaaacaagcatcggcctcatttgtgtgatcgcctcctctgggatgctgtggatggctgagattcctctgcagtggatcgccagcgctattgttctcgagttctttatgatggtgcttctgatccccgagcctgagaagcagcgcacaccccaagataatcagctggcctatgtggtcattggaatcctcacactggcggccatcattgctgccaacgaaatgggccttctggagaccacgaagaaagacctcggcatgtccaaggaaccgggggttgtgagctctacatcctacctggatgtggacctgcaccctgctagcgcctggaccctctacgctgtcgccacaaccgtgatcacccccatgcttagacatacaattgaaaattctacggcgaacgttagcctggccgctatcgccaaccaggctgtggtcctgatgggactcgacaaaggctggcccatttccaagatggatctgggggtgcctcttctggccctcggatgctattctcaggtcaatccgctgaccctgacagccgcggtgctccttctgatcacccactacgctatcattggccccgggctgcaagccaaagctacacgggaagcccagaagagaaccgccgctggaatcatgaagaaccctacggttgacggcattatgacaatcgatctcgaccccgtgatttatgatagcaaattcgagaagcagctgggccaggtcatgcttctggtgctctgtgccgttcaactgctgctcatgcgcacctcctgggcgctttgcgaggccctgaccctggctacagggcctatcaccacactctgggaaggatctcccggcaaattttggaatacgaccatcgccgtgagcatggctaacattttccgggggtcctacctggccggagcgggccttgcctttagcatcatgaagtctgtcgggacaggaaaaagaggcaccggctcccagggggagacactgggagaaaagtggaagaaaaagctcaatcagctgagccgcaaagagttcgacctgtataagaaatccggcattaccgaagtggatcggacggaggctaaggaggggctcaaaagaggagaaatcacccatcacgccgtgtctcggggcagcgctaaacttcagtggtttgttgagcgcaacatggtcattcctgaagggagagtgatcgacctgggatgtggccggggcgggtggtcctactattgcgccggactgaagaaagtgacagaggtccgcggctacaccaaagggggaccgggccatgaagaacccgttcctatgtctacatacgggtggaatattgtgaaactcatgaccggaaaggatgtgttctatctgccccctgagaaatgtgacacacttctgtgcgatatcggcgaaagctcccccagcccgaccgtcgaggaatctagaacgatccgggtgctcaagatggttgagccttggctgaagaacaatcaattctgtattaaagtgctgaacccctacatgcccacagtcatcgagcacctcgaacgccttcagagaaagcacggcgggatgctggtgcggaatcctctgtcccgcaacagcacccatgagatgtattggatttctaatggaaccggcaacatcgttgcttccgtgaatatggtcagcagactcctgcttaaccggtttacaatgacgcacagacgccccaccattgaacgggacgtggatctgggggccggaacaagacatgtgaacgcggagcctgaaaccccgaatatggacgtcatcggcgagcgcatcaaacggattaaggaggaacacaactctacatggcactacgacgatgagaatccctataaaacctgggcctaccatgggagctatgaagttaaggctacaggatccgcctctagcatgatcaacggcgtggtgaagctcctgaccaaaccttgggacgtcgtgcccatggttacgcagatggctatgaccgatacaacccctttcggccaacagagagtgtttaaggagaaagtcgacacacgcacaccccggtccatgccggggacgagaaaggtgatgggaattacagccgaatggctgtggcgcaccctcggccggaataaaaagcctagactgtgcacacgcgaggagttcaccaagaaagttcggacgaacgccgcgatgggggctgtgtttaccgaagagaatcagtgggatagcgccaaggccgctgtcgaagacgaggagttctggaaacttgtggatagagagcgcgagctgcacaagctcggaaaatgtggctcctgcgtttacaacatgatggggaagagagagaaaaagctgggcgagtttggaaaggccaaaggctctcgggctatctggtacatgtggcttggggcccgctatctggagttcgaggcgctcggatttctgaatgaggaccattggttcagcagagaaaactcctactctggcgtggagggggaaggactgcacaagctcggctatattctgcgggatatcagcacaatccccgggggcgccatgtacgctgacgataccgccggatgggacacaagaattaccgaggacgatcttcataatgaagagaaaatcacacagcaaatggaccctgagcaccggcagctggctaacgccatttttaagctcacctatcagaataaagtcgtgaaggtccagcgccccacgcctacaggcaccgtgatggatatcatttccagaaaggaccaacgggggtctggacaggttggcacctacgggctgaacacattcaccaatatggaagcgcagcttatccgccagatggagggagaaggcgtgctgagcaaagccgatctcgagaacccccatctgccggaaaagaaaatcacacaatggctggagacgaagggggtcgagagactcaaacggatggctatttccggcgacgattgcgtggtgaagcctatcgacgatcgctttgccaacgctctgcttgccctgaatgacatgggaaaggttagaaaagatattccccagtggcagcccagcaagggctggcatgactggcagcaagtgcctttctgttctcaccatttccacgaactcatcatgaaagatgggcggaagctggtcgtgccgtgccgcccccaggacgagcttattggacgggctcggatctcccagggcgccgggtggagcctgcgcgaaaccgcgtgtctcggaaaagcctatgctcaaatgtggtctctgatgtactttcacagacgggacctgcgcctcgcctccaacgccatttgcagcgctgttcctgtgcattgggtccccacatctagaaccacatggtccatccacgcccatcaccagtggatgaccacggagaatatgctgaccgtgtggaaccgggtctggatcgaagataatccttggatggaggacaagacacccgtgaccacatgggagaacgttccttaccttggcaagagagaagatcagtggtgtgggagcctgattggcctcacctcccgcgcgacgtgggctcagaatatccccacagccattcaacaggtgcggagcctgatcggaaacgaggagttccttgactatatgccgtctatgaaaagatttcgcaaggaggaggaaagcgagggcgccatttggtga

SEQ ID NO: 20528 - RNA, 9873 nt, synthetic construct
  misc_feature 1..9873: note = derived and/or modified CDS sequence (opt5) from DENV-3__FJ882575__SS-prME
  source 1..9873: mol_type = other RNA
accagcctgtgcctcatgatgatcctgcccgccacacttgctttccacctgacgtcccgggacggagagcctcggatgattgtggggaagaacgaacgcggaaagtctctcctgtttaagaccgccagcggcatcaatatgtgtacacttattgcgatggatctgggggagatgtgcgacgataccgtgacatacaagtgtccgcatatcaccgaagttgagcccgaagacattgattgctggtgtaacctcacatccacctgggtgacgtatggaacctgcaatcaggctggcgagcacagacgggacaagcgctctgtggccctggcccctcatgtcgggatgggactggatacaagaacccagacatggatgagcgctgagggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccagctggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgctccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggcattctcaacagcctgggcaagatggttcaccagatctttgggtctgcgtacaccgccctgttctccggcgtcagctgggtgatgaaaattggaatcggcgtgctcctgacatggattgggcttaattctaagaacaccagcatgtccttttcttgcatcgctatcggaattatcacactgtatctcggcgccgtcgtgcaggctgacatggggtgtgttattaattggaaaggaaaggagctgaagtgcggcagcgggatcttcgtgacgaacgaggtccatacctggacagaacagtacaaatttcaagccgattcccccaagcggctggcgaccgccattgctggcgcctgggagaatggagtgtgtggcatcagaagcacaacccgcatggaaaaccttctctggaaacagatcgctaatgagctgaactatattctgtgggaaaataacatcaagctcacggttgtggtcggggacaccattggagtgctggagcagggcaaacggacacttacccctcagcccatggagctgaagtactcttggaaaacatgggggaaggccaagatcgttaccgccgaaacacaaaactccagcttcattatcgatggacctaatacccccgagtgcccgtctgcttccagagcgtggaacgtgtgggaagtcgaggactatggctttggcgtgttcacgacaaatatctggctcaaactgcgcgaagtgtacacccagctgtgtgaccaccggcttatgagcgccgctgtcaaggatgagagagccgttcacgccgacatggggtactggattgagtcccagaaaaacggatcttggaagctcgaaaaagctagcctgatcgaggtgaagacctgcacatggcctaagtcccataccctgtggtctaatggcgtgctcgaaagcgatatgattatccccaaatccctggccgggcctattagccagcacaactatcgccccggataccatacgcaaacagcgggcccttggcaccttgggaagctggagctcgactttaattattgcgagggaaccacagtcgtgatcaccgaaaactgtggcacacggggcccctctctgagaaccacgaccgtttccgggaaactgatccacgagtggtgctgtcgcagctgcacacttccgcctctccggtacatgggagaagatggctgttggtatgggatggagattagacccatctctgaaaaggaggagaatatggtgaaatccctggtcagcgctggatctggcaaggtggacaacttcaccatgggggttctgtgcctcgccattctgtttgaagaggtgatgcggggaaagttcggcaaaaagcatatgatcgccggcgtcttctttacattcgtgcttctgctcagcgggcagattacctggcgcgatatggctcacacgctgatcatgattggatccaatgccagcgacagaatgggcatgggggttacatacctggcgcttatcgctacctttaaaatccagcccttcctggccctcggatttttcctgcggaagctcacatctagagaaaacctgcttctgggcgtggggctcgccatggctaccaccctgcaactgcctgaggatattgaacagatggccaatggaatcgctcttggcctgatggccctcaaactgattacacagtttgagacgtatcagctctggaccgcgctgatctcccttacatgtagcaacaccattttcacactgaccgtcgcctggcgcacggctacactcatcctggccggcgtgtccctgcttccggtgtgccaatctagctccatgcggaagaccgactggctgcccatgaccgtcgctgccatgggggttcctcccctccctctgtttatcttctctctcaaggatacactgaaaagacgcagctggccccttaatgagggagtgatggccgtgggcctggtctccattctggcttctagcctcctgagaaacgacgtgcctatggcggggccccttgttgccggaggcctgctcatcgcttgttacgtgattaccgggacatccgccgatctgacggtcgaaaaggccgctgacgtgacctgggaggaagaggccgaacagacaggagttagccataacctcatgatcaccgtggacgatgacggcacaatgcggattaaagatgacgagaccgagaatatcctgacggtccttctgaagaccgcgctgctcatcgtgtctggcatttttccgtactccatccctgctacactgcttgtctggcacacctggcagaaacagacacaacgcagcggggtgctgtgggatgttccctctcctcccgaaacccagaaggccgagctcgaagagggagtgtatagaattaaacagcagggcatcctggggaagacacaagtcggagtgggcgttcagaaggagggggtgttccatacgatgtggcacgtcacccggggagccgtgctcacacacaacggcaaacgcctggaaccgaattgggcttccgtgaagaaagaccttattagctacggcgggggatggagactgtctgcccagtggcaaaagggcgaggaagttcaggtcatcgcggtggagcctgggaaaaaccccaagaattttcagaccatgcctggaaccttccagacaacgaccggcgaaattggggctatcgccctggatttcaagcccggaacatccggcagccccatcattaaccgggagggcaaagtggtcgggctctatggaaatggcgtggttaccaagaacgggggatacgtgtccggcatcgcccaaacaaatgctgagcctgacgggccgacccccgaactggaggaagagatgtttaaaaagcgcaaccttacgattatggatctgcatcctggcagcggaaaaacaagaaagtatctccccgccatcgtccgggaagctattaagcgcagactgcggaccctcatcctggcccctaccagagtggttgcggccgagatggaggaagctcttaaaggcctgcccatccgctaccagacaaccgccacaaagtctgagcacaccgggcgggaaattgtggacctgatgtgccatgctacgttcacaatgagactcctgagccctgtccgcgtgccgaattataaccttatcattatggatgaggcccactttaccgaccccgcctccatcgctgcgcggggatacatttctacaagagttggcatgggggaagccgctgccatcttcatgaccgccacgcctcccggaaccgctgatgcctttcctcagagcaatgcgcccatccaggacgaggagcgcgacattccggaacggtcctggaactctggcaatgagtggatcacagatttcgctgggaaaaccgtgtggtttgtccctagcattaaggccggcaacgacatcgccaactgtctgcgcaaaaatggaaagaaggtgattcaactctccagaaaaacattcgataccgaataccagaagacaaaactgaacgactgggattttgtggtcaccacggacatctctgagatgggcgctaatttcaaggccgatcgggttattgaccccagacggtgcctgaaacccgtgatcctcacagatgggcctgagcgcgtgatccttgcgggacccatgcctgtcaccgccgctagcgccgctcagagacggggccgcgtggggagaaacccgcagaaggaaaatgaccaatatatttttaccggacagcccctgaacaatgatgaggaccatgcccactggacagaagctaagatgctgctcgacaacatcaatacccctgagggcattatccccgccctgttcgaacctgagcgggagaaatccgcggccattgatggggaatacagacttaagggcgagagccgcaaaacattcgttgaactgatgcggagaggagacctccccgtgtggctggctcacaaggtcgcctctgagggcatcaaatatacggatcgcaagtggtgctttgacgggcagcggaacaatcagatcctggaagagaacatggatgtggagatttggaccaaagaaggagagaagaagaaactcagaccgcgctggcttgacgctcggacatactccgatcctctggccctgaaggagttcaaagactttgccgctggcagaaagagcatcgcgctcgatctggttaccgagattgggcgcgtgccctctcatcttgcccacagaacacggaatgctctggacaacctcgtcatgctgcatacctccgaacacggaggccgcgcctatagacacgccgtggaggagctgcctgaaacgatggagaccctccttctgctgggcctcatgatcctgcttacagggggagctatgctgttcctcattagcggcaaagggatcggaaagacctccatcggcctgatttgtgtcatcgcctctagcgggatgctgtggatggcggaaattcccctccaatggatcgcctccgctattgtgcttgagtttttcatgatggttctgctgatccctgagcccgaaaagcagcggacaccgcaggataatcaactcgcctacgtggtgattggaatcctgacccttgctgccatcattgcggccaacgagatgggcctgctcgaaacgacaaaacgcgacctgggcatgagcaaggagcctggggtcgtttctcccacctcctatctggatgtggacctccatcccgctagcgcctggacactttacgctgtggccaccaccgtcatcacacctatgctgagacacacgattgaaaattctaccgctaacgtgagcctggccgcgatcgccaaccaggctgttgtgctcatgggactggacaaaggctggccgatttccaagatggatcttggggtccccctgctcgccctgggatgctactctcaggtgaatcctctgacactcaccgctgccgtccttctgctgatcacacattatgccatcattggccccgggctccaggcgaaagctacccgggaggcccaaaagagaacggctgccggaatcatgaagaaccctacagtggacggcattatgaccatcgatctggaccccgttatttacgatagcaaatttgagaagcagcttggccaggtgatgctgctcgtcctgtgtgccgtgcagctgctccttatgcgcacctcctgggctctgtgcgaagccctgacactcgcgaccgggcctatcacaacgctgtgggagggatctccgggcaaattctggaataccacaatcgccgttagcatggctaacatttttcgggggtcctatcttgccggagctggcctggccttcagcatcatgaagtctgtggggaccggaaaaagaggcacaggctcccaaggggaaaccctcggagagaagtggaagaaaaagctgaatcagctgagccgcaaagaatttgacctctacaagaaatccggcattacggaggtcgatcggaccgaggcgaaggaagggcttaaaagaggagagatcacacaccatgccgtgtctcggggcagcgctaagctgcagtggttcgtggaacgcaacatggttattcccgaggggagagtcatcgacctgggatgtggccggggcgggtggtcctattactgcgccggactcaagaaagtgaccgaagtgcgcggctatacaaaagggggacctggccacgaggagcccgtccctatgtctacctacgggtggaatattgttaaactgatgagcggaaaggatgtgttttaccttcccccggaaaaatgtgacacactgctctgcgatatcggcgagtccagcccttctcccaccgtggaagagtccagaacgatccgggtcctgaagatggtggagccctggctgaagaacaatcagttctgtattaaagttctcaacccttatatgcccacagtgatcgaacaccttgagcgcctgcaaagaaagcatggcgggatgctggtccggaatcctctcagccgcaactctacccacgaaatgtactggatttccaatggaaccggcaacatcgtgagctctgttaatatggtgagcagactgcttctgaaccggttcacaatgacgcatagacgcccgaccattgagaaagacgtcgatctcggggctggaacacggcacgtggacgccgaacccgagacccctaacatggacgtgatcggcgagagaatcaagcgcattaaagaagaacacaattccacatggcattatgatgacgaaaacccctacaagacctgggcttatcacgggtcttacgaggtcaaggccacaggaagcgcgtccagcatgatcaatggcgttgtgaaactgctgaccaagccttgggatgtggtccccatggtgacgcagatggccatgaccgacacaaccccgtttggccagcaacgggttttcaaagaaaaggtggatacaagaacccctcgccccatgcctgggacgcggaaagtcatgggaattacagctgagtggctctggagaaccctgggccgcaacaagcggcccagactttgcacacgcgaggaatttaccaagaaagtgcggacgaatgccgctatgggggccgttttcaccgaggaaaaccagtgggactccgccaaggcggctgtggaggatgaagagttttggaaactggtcgacagagagcgcgaactccataagctgggaaaatgtggctcttgcgtgtataatatgatggggaagagagagaagaaacttggcgagttcggaaaagccaaaggcagccgggccatctggtacatgtggctgggggctcgctacctcgagtttgaggccctgggattcctgaacgaagatcactggttttccagagaaaattcttatagcggcgttgaaggggagggactccataagctgggctacattcttcgggacatctccaaaatccctgggggcgctatgtatgccgatgacacagcgggatgggacaccagaattacagaagatgacctgcacaacgaggagaagatcacccagcagatggatcccgaacaccggcaactcgccaatgctattttcaaactgacataccagaacaaggtggtcaaggtgcagcgcccgacccctacgggcacagtcatggacatcatttctagaaaagatcagcgggggagcggacaagtgggcacctatgggcttaatacctttacaaacatggaggcccagctggttcgccagatggaaggagagggcgtgctctccaaggctgacctggaaaatccccatctgcccgagaaaaagatcacccagtggctcgagacaaaaggggtcgaaagactgaagcggatggccatcagcggcgatgactgcgtggtgaagcctattgatgaccgcttcgcgaacgcccttctggctctcaacgatatgggaaaagttagaaaggacatcccgcaatggcagccctctaaaggctggcacgattggcaacaggtgcctttttgttcccatcacttccacgagctgattatgaaggacgggcggaaacttgtcgtgccctgccgccctcaagacgaactgatcggacgggcccggattagccagggcgctgggtggtctctccgcgagacggcctgtctgggaaaggcttacgcccagatgtggtccctgatgtatttccatagacgggatctccgcctggcgagcaatgccatctgctctgctgttcccgtgcactgggtccctacctccagaacaacctggagcattcatgcccaccatcaatggatgacaaccgaagacatgcttacggtgtggaaccgggtctggatcgaggataatccctggatggaggacaagaccccggtgacaacctgggaaaacgttccttacctgggcaaaagagaggatcagtggtgtgggtccctcatcggcctgacaagccgcgccacctgggctcagaatattcccacggccatccagcaagtgcggtctcttattggaaacgaagagtttctggactacatgcctagcatgaagagattccgcaaagaggaagagtccgaaggcgcgatctggtga

SEQ ID NO: 20529 - RNA, 9873 nt, synthetic construct
  misc_feature 1..9873: note = derived and/or modified CDS sequence (opt5) from DENV-3__GQ199886__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatggggcttaattctaagaacacaagcatgtccttttcttgcatcgctattggaatcatcaccctgtatctcggcgccgttgtgcaggctgacatggggtgtgtcattaattggaaaggaaaggagctgaagtgcggcagcgggatcttcgtgacaaacgaggttcatacgtggaccgaacagtacaaatttcaagccgattcccccaagcggctggcgacagccattgctggcgcctgggagaatggagtgtgtggcatcagaagcaccacacgcatggaaaaccttctctggaaacagattgctaatgagctgaactatatcctgtgggaaaataacatcaagctcaccgtcgtggttggggacacgattggagtgctggagcagggcaaacggacccttacacctcagcccatggagctgaagtactcttggaaaacctgggggaaggccaagatcgtcacagccgaaacccaaaactccagcttcattatcgatggacctaatacacccgagtgcccgtctgcttccagagcgtggaacgtgtgggaagtggaggactatggctttggcgtcttcaccacgaatatttggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgatcgaggtcaagacctgcacctggcctaagtcccatacactgtggtctaatggcgtgctcgaaagcgatatgattatccccaaatccctggccgggcctattagccagcacaactatcgccccggataccatacccaaacggcgggcccttggcaccttgggaagctggagctcgactttaattattgcgagggaacaaccgttgtgatcacagaaaactgtggcacccggggcccctctctgagaacaaccacggtctccgggaaactgattcacgagtggtgctgtcgcagctgcacccttccgcctctccggtacatgggagaagatggctgttggtatgggatggagatcagacccatctctgaaaaggaggagaatatggtgaaatccctggttagcgctggatctggcaaggtggacaacttcacaatgggggtcctgtgcctcgccattctgtttgaagaggtgatgcggggaaagttcggcaaaaagcatatgatcgccggcgttttctttaccttcgtgcttctgctcagcgggcagattacatggcgcgatatggctcacaccctgatcatgattggatccaatgccagcgacagaatgggcatgggggtcacgtacctggcgcttatcgctacatttaaaattcagcccttcctggccctcggatttttcctgcggaagctcacctctagagaaaacctgcttctgggcgtggggctcgccatggctacaaccctgcaactgcctgaggatatcgaacagatggccaatggaatcgctcttggcctgatggccctcaaactgattacccagtttgagacatatcagctctggacggcgctgatctcccttacctgtagcaacacaattttcaccctgacagtggcctggcgcaccgctacgctcatcctggccggcgtctccctgcttccggtttgccaatctagctccatgcggaagacagactggctgcccatgaccgtggctgccatgggggtgcctcccctccctctgtttattttctctctcaaggataccctgaaaagacgcagctggccccttaatgagggagtcatggccgtgggcctggtttccatcctggcttctagcctcctgagaaacgacgtgcctatggcggggccccttgtcgccggaggcctgctcatcgcttgttacgtgattacagggacctccgccgatctgacagttgaaaaggccgctgacgtgacgtgggaggaagaggccgaacagaccggagtcagccataacctcatgatcacagtggacgatgacggcaccatgcggattaaagatgacgagacagagaatatcctgaccgtccttctgaagacggcgctgctcattgtgtctggcatctttccgtactccatccctgctaccctgcttgtttggcacacatggcagaaacagacccaacgcagcggggtgctgtgggatgtcccctctcctcccgaaacacagaaggccgagctcgaagagggagtgtatagaattaaacagcagggcatcttcgggaagacccaagttggagtgggcgtccagaaggagggggtgtttcatacaatgtggcacgtgacgcggggagccgttctgacctacaacggcaaacgcctcgaaccgaattgggcttccgtcaagaaagacctgattagctatggcgggggatggagactttctgcccagtggcaaaagggcgaggaagtgcaggtgatcgcggtcgagcctgggaaaaaccccaagaatttccagacaatgcctggaaccttccagaccacaacgggcgaaattggggctatcgccctggattttaagcccggaacctccggcagccccattatcaaccgggagggcaaagtggttgggctgtacggaaatggcgtggtcacaaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacgagaaagtacctgcccgccatcgttcgggaagctattaagcgcagactccggacactgatcctcgcccctaccagagtggtcgcggccgagatggaggaagctctgaaaggccttcccattcgctatcagaccacagccaccaagtctgagcatacagggcgggaaatcgtggacctgatgtgccacgctacctttacgatgagactgctcagccctgttcgcgtgccgaattacaacctgatcattatggatgaggcccatttcacagaccccgcctccatcgctgcgcggggatacatttctaccagagtcggcatgggggaagccgctgccatctttatgacagccacccctcccggaacggctgatgccttccctcagagcaatgcgcccattcaggacgaggagaaagacatcccggaacgctcctggaactctggcaatgagtggatcaccgattttgctgggaagacagtgtggttcgtgcctagcattaaagccggcaacgacatcgccaactgtcttcggaagaatggaaagaaagtcattcaactgtccagaaagacctttgatacagaatatcagaaaaccaagctcaacgactgggatttcgttgtgacaaccgacatctctgagatgggcgctaattttaaagccgatcgcgtgattgacccccggagatgcctgaagcccgtcatcctgacggatgggcctgagcgggtgattctcgcgggacccatgcctgttacagccgctagcgccgctcagcgcagaggccgggtggggcgcaacccgcagaaggaaaatgaccaatacatcttcaccggacagccccttaacaatgatgaggaccacgcccattggaccgaagctaaaatgctgctggacaacatcaatacacctgagggcattatccccgccctcttcgaacctgagagagagaagtccgcggccattgatggggaatatcggctgaaaggcgagagcagaaagacctttgtcgaacttatgcgccggggagacctgcccgtgtggctcgctcacaaagttgcctctgagggcatcaagtacacagatagaaaatggtgcttcgacgggcagcgcaacaatcagattctggaagagaacatggatgtggagatctggacgaaggaaggagagaagaaaaagctgcggccgagatggctcgacgctcgcacctattccgatcctcttgccctgaaagaatttaaggacttcgccgctggccggaaaagcatcgcgctggatctcgtcacagagattgggagagtgccctctcacctggcccatcgcaccagaaatgctcttgacaacctggtcatgctccacacatccgaacatggaggccgggcctaccgccacgccgtggaggagctgcctgaaaccatggagacgctgctccttctgggcctgatgatcctcctgaccgggggagctatgctttttctgattagcggcaaggggatcggaaagacatccattggcctcatctgtgttatcgcctctagcgggatgctgtggatggcggaaattcccctgcaatggatcgcctccgctattgtgctcgagttctttatgatggtgcttctgatccctgagcccgaaaaacagagaaccccgcaggataatcaactggcctatgtcgttattggaatcctcacactggctgccattatcgcggccaacgagatgggccttctggaaaccacgaagcgggacctcggcatgagcaaagagcctggggtggtgtctcccacatcctacctggatgtcgacctgcaccccgctagcgcctggaccctctacgctgtggccacaaccgttatcacccctatgcttcgccatacaattgaaaattctacggctaacgtgagcctggccgcgatcgccaaccaggctgtcgtgctgatgggactcgacaagggctggccgatttccaaaatggatctgggggtcccccttctggccctcggatgctattctcaggtgaatcctctgaccctgacagctgccgttctccttctgatcacccactacgccattatcggccccgggctgcaggcgaaggctacaagagaggcccaaaagcggaccgctgccggaatcatgaaaaaccctacggtggacggcattatgacaatcgatctcgaccccgtcatttatgatagcaagttcgagaaacagctgggccaggtgatgcttctggttctctgtgccgtgcagctgctgctcatgagaacctcctgggctctttgcgaagccctgaccctggcgacagggcctatcaccacactctgggagggatctccgggcaagttttggaatacgaccattgccgtcagcatggctaacatcttccgcgggtcctacctggccggagctggccttgcctttagcatcatgaaatctgtggggacaggaaagcggggcaccggctcccaaggggaaacactgggagagaagtggaaaaagaaactcaatcagctgagcagaaaggaattcgacctgtataaaaagtccggcattaccgaggtggatcgcacggaggcgaaagaagggctcaagcggggagagatcacccatcacgccgtttctagaggcagcgctaagcttcagtggtttgtcgaacggaacatggtgattcccgaggggcgcgtgatcgacctgggatgtggcagaggcgggtggtcctactattgcgccggactgaaaaaggtcacagaagttcggggctacaccaaagggggacctggccatgaggagcccgtgcctatgtctacatacgggtggaatattgtgaagctcatgagcggaaaagatgtcttctatctgcccccggaaaagtgtgacacccttctgtgcgatatcggcgagtccagcccttctcccacagtggaagagtcccgcaccattagagttctcaagatggtggagccctggctgaaaaacaatcagttctgtatcaaggtcctgaacccttacatgcccacggtgatcgaacacctcgagcggcttcaacgcaaacacggcgggatgctggttagaaatcctctgagccggaactctacacatgaaatgtattggatttccaatggaaccggcaacatcgtggctagcgtcaatatggtgtctcgcctcctgcttaacagatttaccatgacacaccggagaccgacgattgagaaggacgtggatctgggggccggaacccgccatgtcaacgctgaacccgagacacctaatatggacgttatcggcgagcggattaaaagaatcaaggaagagcacaacagcacctggcactacgacgatgaaaatccctataagacatgggcctaccatgggtcctatgaggtgaaagcgaccggatctgccagctccatgatcaacggcgtggtcaagctcctgacaaaaccttgggacgtggttcccatggtgacccagatggctatgacggataccacaccgttcggccagcaacgcgtctttaaggaaaaagtggacacccggacacctagaagcatgcccgggacccgccgggttatgggaattacggccgagtggctgtggagaacactcggccgcaataagaagcctcggctgtgcaccagagaggaattcacaaaaaaggtgcgcaccaacgctgccatgggggccgtctttacggaggaaaatcagtgggattccgcgaaagctgccgtggaggacgaagatttctggaagcttgttgaccgggagagagagctgcacaaactcggaaagtgtggctcttgcgtgtacaacatgatggggaaacgcgaaaagaagctgggcgagtttggaaaagccaagggcagcagagctatctggtacatgtggcttggggcccggtatctggaattcgaggctctcggatttctgaatgaggatcattggttctcccgcgaaaactcttacagcggcgtcgagggggaaggactgcacaaactcggctatattctgagagacatctccaagattcccgggggcgccatgtacgcggatgacaccgccggatgggacacacggatcaccgaggatgaccttcataatgaagagaaaatcacacagcagatggatcctgagcacagacaactggctaacgccatttttaagctcacctatcagaataaggtggtcaaagtgcagcggcccacaccgaccggcacggttatggacatcatttctcgcaaggatcagagagggagcggacaagtgggcacatacgggctgaacaccttcaccaatatggaagctcagcttatccggcagatggagggagaaggcgtcctgtccaaagccgacctcgagaaccctcacctgcccgaaaagaaaattacacagtggctggagaccaagggggtggagcgcctcaagagaatggcgatcagcggcgatgactgcgtggttaaacccatcgatgaccggtttgccaacgctctgcttgccctgaatgatatgggaaaggtgcgcaaagacattcctcaatggcagccgtctaagggctggcatgattggcagcaggtccccttctgttcccaccatttccacgaactcatcatgaaagacgggagaaagctggtggttccttgccggccccaagacgagcttattggacgcgctagaatcagccagggcgccgggtggtctctgcgggaaacagcttgtctcggaaaggcctatgcgcagatgtggtccctgatgtactttcaccgcagagatctgcggctcgccagcaacgctatttgctctgccgtgcctgtccattgggtgcccacgtcccgcaccacatggagcatccacgcccatcaccaatggatgaccacagaggacatgctgaccgtctggaatagagtgtggattgaagataacccttggatggaggacaaaacgcccgttaccacatgggagaatgtgccgtaccttggcaagcgggaagatcagtggtgtgggtccctgatcggcctcaccagcagagctacatgggcccagaacatccctaccgcgattcagcaagtccgctctctgatcggaaatgaggaattccttgactatatgcccagcatgaaacggtttagaaaggaggaggaatccgagggcgctatttggtga

SEQ ID NO: 20530 - RNA, 9873 nt, synthetic construct
  misc_feature 1..9873: note = derived and/or modified CDS sequence (opt5) from DENV-3__FJ882576__SS-prME
  source 1..9873: mol_type = other RNA
acaagcctgtgcctcatgatgatcctgcccgccgctcttgccttccacctgacatcccgggacggcgagcctcggatgattgtggggaagaacgagcgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatggctatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgaccaacgaggttcatacatggacggaacagtacaaatttcaagcggattcccccaagcggctggccaccgctatcgccggcgcttgggagaatggagtgtgtggcattagaagcacaacccgcatggaaaaccttctctggaaacagatcgccaatgagctgaactatatcctgtgggaaaataacattaagctcacagtcgtggttggggacatcattggagtgctggagcagggcaaacggacccttacgcctcagcccatggagctgaagtactcttggaaaacctgggggaaggccaagatcgtcacagctgaaacccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggagctcgactttaattattgcgagggaaccacggttgtgatcacagaaaactgtggcacccggggcccctctctgagaacaaccacagtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgccggatctggcaaggtggacaacttcacgatgggggtcctgtgcctcgccattctgtttgaagaggtgatgcggggaaagttcggcaaaaagcatatgatcgctggcgttttctttaccttcgtgcttctgctcagcgggcagattacatggcgcgatatggcccacaccctgatcatgattggatccaatgcgagcgacagaatgggcatgggggtcacatacctggctcttatcgccacctttaaaatccagcccttcctggccctcggatttttcctgcggaagctcacgtctagagaaaacctgcttctgggcgtggggctcgctatggccacaaccctgcaactgcctgaggatattgaacagatggctaatggaatcgcccttggcctgatggcgctcaaactgattacacagtttgagacctatcagctctggaccgccctgatctcccttacatgtagcaacacgattttcaccctgacagtggcttggcgcaccgccacactcatcctggctggcgtctccctgcttccggtttgccaatctagctccatgcggaagaccgactggctgcccatgacggtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttacgtgattaccgggacctccgccgatctgacagttgaaaaggctgccgacgtgacctgggaggaagaggcggaacagacaggagtcagccataacctcatgatcacggtggacgatgacggcaccatgcggattaaagatgacgagacagagaatatcctgaccgtccttctgaagacagctctgctcatcgtgtctggcatttttccgtactccatccctgccaccctgcttgtttggcacacgtggcagaaacagacccaacgcagcggggtgctgtgggatgtcccctctcctcccgaaacacagaaggccgagctcgaagagggagtgtatagaattaaacagcagggcatcttcgggaagacccaagttggagtgggcgtccagaaggagggggtgtttcatacaatgtggcacgtgacccggggagctgttctggcctacaacggcaaacgcctcgaaccgaattgggcgtccgtcaagaaagacctgattagctatggcgggggatggagactttctgctcagtggcaaaagggcgaggaagtccaggtgatcgccgtcgagcctgggaaaaaccccaagaatttccagacaatgcctggaacgttccagaccacaaccggcgaaattggggccatcgctctggattttaagcccggaacctccggcagccccatcattaaccgggagggcaaagtggttgggctgtacggaaatggcgtggtcacaaagaacgggggatatgtgtccggcatcgcccaaacgaatgctgagcctgacgggccgacccccgaactcgaggaagagatgttcaaaaagcgcaacctgacaattatggatcttcaccctggcagcggaaaaaccagaaagtacctgcccgccatcgttcgggaagcgattaagcgcagactccggacactgatcctcgcccctaccagagtggtcgctgccgagatggaggaagctctgaaaggccttcccatccgctatcagacgacagccaccaagtctgagcataccgggcgggaaattgtggacctgatgtgccacgccacatttaccatgagactgctcagccctgttcgcgtgccgaattacaacctgatcattatggatgaggctcatttcacagaccccgcgtccatcgccgctcggggatacatttctaccagagtcggcatgggggaagccgccgctatctttatgacggccacacctcccggaaccgcggatgctttccctcagagcaatgcccccatccaggacgaggagcgcgacattccggaacggtcctggaactctggcaatgagtggatcacagattttgccgggaaaaccgtgtggttcgtgcctagcattaaggctggcaacgacatcgccaactgtcttcgcaaaaatggaaagaaggtcattcaactgtccagaaaaacgtttgataccgaatatcagaagacaaaactcaacgactgggatttcgttgtgaccacagacatctctgagatgggcgcgaattttaaggccgatcgggtgattgaccccagacggtgcctgaaacccgtcatcctgaccgatgggcctgagcgcgtgatcctcgctggacccatgcctgttacagccgctagcgccgctcagagacggggccgcgtggggagaaacccgcagaaggaaaatgaccaatacattttcaccggacagccccttaacaatgatgaggaccacgcccattggacggaagcgaagatgctgctggacaacatcaatacacctgagggcattatccccgccctcttcgaacctgagcgggagaaatccgctgccattgatggggaatatagactgaagggcgagagccgcaaaacctttgtcgaacttatgcggagaggagacctgcccgtgtggctcgctcacaaggttgcctctgagggcatcaaatacaccgatcgcaagtggtgcttcgacggggaacggaacaatcagatcctggaggagaacatggatgtggaaatttggacaaaagagggagaaaagaagaaactgagaccgcgctggctcgacgcccggacctattccgatcctcttgctctgaaggagtttaaagacttcgcggccggcagaaagagcatcgctctggatctcgtcacagaaattgggcgcgtgccctctcacctggcccatagaacgcggaatgcccttgacaacctggtcatgctccacacctccgagcatggaggccgcgcttacagacacgccgtggaggaactgcctgagacaatggaaaccctgctccttctgggcctgatgatcctcctgacagggggagcgatgctttttctgattagcggcaaagggatcggaaagacctccatcggcctcatttgtgttatcgcctctagcgggatgctgtggatggctgagattcccctgcagtggatcgcctccgctattgtgctcgagttctttatgatggtgcttctgatccctgaacccgagaagcaacggacgccgcaggataatcagctggcctatgtcgttattggaatcctcaccctggcggccatcattgctgccaacgaaatgggccttctggagacaaccaaacgcgacctcggcatgagcaaggaacctggggtggtgtctcccacatcctacctggatgtcgacctgcaccccgctagcgcctggaccctctacgctgtggccacgacagttatcacccctatgcttagacatacaattgaaaattctaccgcgaacgtgagcctggccgctatcgccaaccaagctgtcgtgctgatgggactcgacaaaggctggccgatttccaagatggatctgggggtcccccttctggccctcggatgctattctcaggtgaatcctctgaccctgacagccgcggttctccttctgatcacgcactacgctatcattggccccgggctgcaggccaaagctacccgggaggcccagaagagaacagccgctggaatcatgaagaaccctaccgtggacggcattatgacaatcgatctcgaccccgtcatttatgatagcaaattcgaaaagcaactgggccaggtgatgcttctggttctctgtgccgtgcagctgctgctcatgcgcacctcctgggcgctttgcgaggccctgacgctggctacagggcctatcaccaccctctgggaaggatctccgggcaaattttggaatacaaccatcgccgtcagcatggctaacattttccgggggtcctacctggccggagcgggccttgcctttagcatcatgaagtctgtggggacaggaaaaagaggcacgggctcccagggggagaccctgggagaaaagtggaagaaaaagctcaatcaactgagccgcaaagagttcgacctgtataagaaatccggcattacagaggtggatcggaccgaagctaaggaggggctcaaaagaggagaaatcacacatcacgccgtttctcggggcagcgctaaacttcagtggtttgtcgagcgcaacatggtgattcccgaagggagagtgatcgacctgggatgtggccggggcgggtggtcctactattgcgccggactgaagaaagtcaccgaggttcgcggctacacgaaagggggacctggccatgaggaacccgtgcctatgtctacctacgggtggaatattgtgaaactcatgagcggaaaggatgtcttctatctgcccccggagaaatgtgacacacttctgtgcgatatcggcgaatccagcccttctcccaccgtggaggagtccagaacaatccgggttctcaagatggtggaaccctggctgaagaacaatcagttctgtattaaagtcctgaacccttacatgcccaccgtgatcgagcacctcgaacgccttcagagaaagcacggcgggatgctggttcggaatcctctgagccgcaactctacacatgagatgtattggatttccaatggaaccggcaacatcgtgagctctgtcaatatggtgagcagactcctgcttaaccggtttacgatgacacacagacgcccgaccattgaaaaagacgtggatctgggggctggaacccggcatgtcaacgccgagcccgagacacctaatatggacgttatcggcgaaagaatcaagcgcattaaagaggaacacaactccacgtggcactacgacgatgagaatccctataagacctgggcgtaccatgggtcttatgaagtgaaggccacaggaagcgcttccagcatgatcaacggcgtggtcaaactcctgaccaagccttgggacgtggttcccatggtgacacaaatggccatgaccgatacaaccccgttcggccagcagcgggtctttaaagagaaggtggacacgagaacccctcgctccatgcccgggacacggagagttatgggaattaccgctgagtggctgtggcgcacactcggccggaataaaaagcctagactgtgcacccgcgaagagttcacgaagaaagtgcggacaaacgccgccatgggggcggtctttaccgaagagaatcaatgggattctgctaaggccgccgtggaagacgaggatttctggaaacttgttgacagagagcgcgaactgcacaagctcggaaaatgtggcagctgcgtgtacaacatgatggggaagagagagaaaaagctgggcgaatttggaaaggctaaaggctcccgggccatctggtacatgtggcttggggctcgctatctggagttcgaggccctcggatttctgaatgaagatcattggttctctagagagaacagctactccggcgtcgaaggggagggactgcacaagctcggctatattctgcgggacatctctaaaatccccgggggcgcgatgtacgccgatgacacagctggatgggacaccagaattacggaagatgaccttcataatgaggagaagatcacccagcagatggatcctgaacaccggcagctggccaacgctatttttaaactcacatatcaaaataaggtggtcaaggtgcagcgccccaccccgacaggcaccgttatggacatcattagcagaaaagatcagcgggggtccggacaggtgggcacatacgggctgaacaccttcacgaatatggaggcccaacttatccgccagatggaaggagagggcgtcctgagcaaggcggacctcgaaaaccctcatctgcccgagaaaaagatcacacagtggctggagaccaaaggggtggaaagactcaagcggatggccatttctggcgatgactgcgtggttaagcccatcgatgaccgctttgctaacgccctgcttgctctgaatgatatgggaaaagtgagaaaggacattcctcagtggcaaccgtccaaaggctggcatgattggcagcaggtccccttctgtagccaccatttccacgagctcatcatgaaggacgggcggaaactggtggttccttgccgcccccaggacgaacttattggacgggcccggatctctcaaggcgctgggtggtccctgcgcgagaccgcctgtctcggaaaggcgtatgcccagatgtggagcctgatgtactttcacagacgggatctgcgcctcgcttctaacgccatttgctccgccgtgcctgtccattgggtgcccacaagcagaaccacatggtccatccacgctcatcaccagtggatgacgaccgaagacatgctgacagtctggaatcgggtgtggatcgaggataacccttggatggaggacaagacccccgttacaacctgggaaaatgtgccgtaccttggcaaaagagaggatcaatggtgtgggagcctgattggcctcacgtctcgcgccacctgggcgcagaacatccctacagctattcagcaggtccggagcctgatcggaaatgaagagttccttgactatatgccctccatgaagagatttcgcaaagaggaagagtctgaaggcgccatttggtga

SEQ ID NO: 20531 - RNA, 9873 nt, synthetic construct
  misc_feature 1..9873: note = derived and/or modified CDS sequence (opt5) from DENV-3__FJ850052__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggaaaaaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacaaagagcgcgacatcccggagcggagctggaactccgggaatgaatggattacggattttgctggcaagaccgtctggttcgtgccttctatcaaagccggaaacgacattgccaactgtcttagaaagaatggcaagaaagtgatccaactgagccgcaagacatttgataccgagtaccagaaaacaaagctcaacgactgggatttcgtcgttaccacagacatttccgaaatgggggctaattttaaagccgatcgggtgatcgaccccagacggtgcctgaagcccgtgatcctgaccgatggacctgagcgcgtcattctcgcgggccccatgcctgtgacggccgcttctgccgctcagagacgggggcgcgttggaagaaacccgcagaaggagaatgaccaatatatcttcacaggccagccccttaacaatgatgaagaccatgcccactggaccgaggctaaaatgctgctggacaacattaatacccctgaagggatcattcccgccctcttcgagcctgaacgggagaagagcgcggccatcgatggcgagtacagactgaaaggagaatcccgcaagacatttgtggagcttatgcggagaggcgacctgcccgtctggctcgctcacaaagtggccagcgaagggatcaagtataccgatcgcaaatggtgcttcgacggacagcggaacaatcagattctggaggaaaacatggatgttgagatctggacaaaggagggcgaaaagaaaaagctgagaccgcgctggctcgacgctcggacgtactctgatcctcttgccctgaaagagtttaaggaattcgccgctgggagaaaatccattgcgctggacctcgtgaccgagatcggacgcgtccccagccatctggcccacagaacacggaatgctcttgataacctggtgatgctccatacctctgaacacggcggccgcgcctatagacacgccgtcgaggagctgcctgaaacaatggagaccctgctccttctggggctgatgattctcctgacgggaggcgctatgctttttctgatctccgggaagggaatcggcaagaccagcattgggctcatctgtgtgattgcctcctctggaatgctgtggatggcggaaatccccctgcaatggattgccagcgctatcgttctcgagttctttatgatggtgcttctgattcctgagcccgaaaaacagcggacaccgcaggacaatcaactggcctacgtggtcatcggcatcctcaccctggctgccattatcgcggccaacgagatgggccttctggaaacaaccaagcgcgatctcgggatgtccaaagagcctggagttgtgagccccacgtcttatctggacgtggatctgcatcccgcttccgcctggacactctacgctgtcgccaccacagtgattacccctatgcttagacacaccatcgaaaatagcacagctaacgtttctctggccgcgattgccaaccaggctgtggtcctgatgggcctcgacaaggggtggccgatcagcaaaatggacctgggagtgccccttctggccctcggctgctactcccaggtcaatcctctgacgctgaccgctgccgtgctccttctgatcacacattatgccattatcgggcccggactgcaggcgaaggctacccgggaggcccaaaagagaacagctgccggcattatgaaaaaccctaccgttgatggcatcatgacgattgacctcgatcccgtgatctacgactctaagttcgagaaacagctggggcaggtcatgcttctggtgctctgtgccgttcagctgctgctcatgcgcacaagctgggctctttgcgaagccctgaccctggcgaccggacctatcacaaccctctgggagggctccccggggaagttttggaatacaacgattgccgtgtctatggctaacatcttccggggaagctatctggccggcgctgggcttgccttttccattatgaaaagcgtcggaaccggcaagagaggcacagggtctcaaggagaaaccctgggcgagaagtggaaaaagaaactcaatcagctgtcccgcaaggatttcgacctgtacaaaaagagcgggatcacagaagtggatcggaccgaggcgaaagagggactcaagagaggcgaaattacgcaccatgccgtgtcccgggggtctgctaagcttcagtggtttgttgagcgcaacatggtcatccccgaaggaagagtgattgacctgggctgtggccgggggggatggagctattactgcgccggcctgaaaaaggtgaccgaggtccgcgggtatacaaaaggaggccctgggcacgaagagcccgttcctatgtccacctacggatggaatatcgtgaagctcatgtctggcaaagatgtgttctacctgcccccggagaagtgtgacacacttctgtgcgatatcggcgaaagctcccctagccccaccgtcgaggaatctagaacaattcgggtgctcaagatggttgagccctggctgaaaaacaatcagttctgtatcaaggtgctgaacccttatatgcccaccgtcattgagcacctcgaacgccttcaaagaaaacatgggggaatgctggtgcggaatcctctgtcccgcaacagcacgcacgagatgtactggatctctaatggcacagggaacattgttgcttccgtgaatatggtcagcagactcctgcttaaccggtttaccatgacccatagacgcccgacaatcgaaaaggacgtggatctgggagccggcacgcggcacgtgaacgctgagcccgaaacccctaatatggacgtcatcggggagagaattaaacgcatcaaggaggaacacaactctacatggcattatgacgatgagaatccctacaagacctgggcctatcacggaagctacgaagttaaagcgacaggctccgcctctagcatgattaacggcgtggtgaagctcctgaccaaaccttgggacgtcgtgcccatggttacacagatggctatgaccgatacgaccccgttcgggcagcaacgggtgtttaaggagaaagtcgacacaagaacccctcgctccatgcccggaacacggagagtgatgggcatcaccgccgaatggctgtggcgcacgctcgggcggaataagaagcctagactgtgcacacgcgaggagttcaccaaaaaggttcggacaaacgctgccatgggagccgtgtttaccgaagagaatcagtgggatagcgcgaaagctgccgtcgaagacgaggatttctggaagcttgtggacagagaacgcgagctgcataaactcggcaagtgtgggtcctgcgtttataacatgatgggcaaaagagagaagaagctgggagaatttggcaaagccaaggggtctcgggctatttggtacatgtggcttggagcccgctacctggagttcgaagctctcggctttctgaatgaggatcactggttcagcagagagaactcctattctggggtggaaggagagggcctgcataaactcgggtacatcctgcgggacatcagcaagattcccggcggagccatgtatgcggatgacacggccggctgggacaccagaatcacagaagatgaccttcacaatgaggaaaaaattacccagcagatggatcctgagcaccggcaactggctaacgccatctttaagctcacataccagaataaggtcgtgaaagtccagcgccccaccccgacagggaccgtgatggacattatctccagaaaggatcagcggggatctggccaagttgggacgtatggactgaacacattcaccaatatggaggctcagcttatccgccagatggaaggcgagggggtgctgagcaaagccgacctcgaaaaccctcatctgcccgagaagaaaattacccagtggctggaaacaaagggcgtcgagagactcaagcggatggcgatctccggagatgactgcgtggtgaaacccattgatgaccgctttgccaacgctctgcttgccctgaatgatatgggcaaggttagaaaagacatccctcaatggcagccgagcaaggggtggcacgattggcagcaggtgcccttctgttctcatcacttccacgagctcattatgaaagacggacggaagctggtcgtgccttgccgcccccaagacgaacttatcggcagagctcggatttcccagggggccggatggagcctgaaggagaccgcttgtctcggcaaagcctacgcgcagatgtggtctctgatgtattttcatcgcagagatctgcggctcgcctccaacgctatctgcagcgccgttcctgtgcactgggtccccacatctcgcacgacctggtccatccatgcccaccatcaatggatgacaaccgaagacatgctgacagtgtggaatagagtctggattgaggataacccttggatggaagacaagacccccgtgacgacctgggagaatgttccgtaccttgggaaacgggaggatcagtggtgtggcagcctgatcggactcacatccagagctacctgggcccagaacattcctacagcgatccagcaagtgcgcagcctgattggcaatgaagagttccttgactacatgccctctatgaagcggtttagaaaagaagaggagagcgaaggggctatctggtga

SEQ ID NO: 20532 - RNA, 9873 nt, synthetic construct
  misc_feature 1..9873: note = derived and/or modified CDS sequence (opt5) from DENV-3__FJ873812__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatctctaatgagctgaactatatcctgtgggaaaataacattaagctcacggtggtcgtgggggacatcattggagttctggagcagggcaaacggacccttacacctcagcccatggagctgaagtactcctggaaaacctgggggaaggctaagatcgtgacagccgaaacccaaaacagctctttcattatcgatggacctaatacacccgagtgcccgtccgtcagcagagcctggaacgtgtgggaagtggaggactatggctttggcgtcttcaccacgaatatctggctcaaactgcgcgaagtttacacacagctgtgtgaccaccggcttatgtccgctgcggtgaaggatgagagagccgtgcacgctgacatggggtactggattgagtctcagaaaaacggaagctggaagctcgaaaaagcctccctgatcgaggtcaagacctgcacctggcctaagtctcatacactgtggagcaatggcgtgctcgaatccgatatgattatccccaaaagcctggccgggcctatttctcagcacaaccatcgccccggatatcacacccaaacggctggcccttggcaccttgggaagctggagctcgactttaattactgcgagggaacaaccgttgtgatcacagaaaactgtggcacccggggcccctccctgagaacaaccacggtcagcgggaaactgatccatgagtggtgctgtcgctcttgcacccttccgcctctccggtatatgggagaagatggctgttggtacgggatggagattagacccatctccgaaaaggaggagaatatggtgaaaagcctggtttctgccggaagcggcaaggtggacaacttcacaatgggggtcctgtgcctcgcgattctgtttgaagaggtgatgcggggaaagttcggcaaaaagcacatgatcgctggcgttttccttacctttgtgctgctcctgtccgggcagattacatggcgcgatatggcccataccctgatcatgattggaagcaatgcctctgacagaatgggcatgggggtcacgtatcttgctctgatcgccacattcaaaatccagccctttctcgcgctgggattctttctccggaagctgacctccagagaaaaccttctgctcggcgtggggctggctatggccacaaccctgcaacttcctgaggatattgaacagatggccaatggaatcgctctgggcctcatggccctgaaactcattacccagttcgagacataccagctgtggacggctcttatcagcctgacctgttccaacacaatttttaccctcacagtggcctggcgcaccgcgacgctgatcctggccggcgtctctcttctgccggtttgccaaagctcctctatgcggaagacagactggctccccatggctgtggccgctatgggggtgcctcccctgcctctcttcatctttagcctgaaggatacccttaaaagacgctcctggcccctgaatgagggagtcatggccgtgggcctggtttctattctcgccagctccctgcttagaaacgacgtgcctatggctgggcccctggtcgcgggaggcctcctgatcgcctgttatgtgattaccgggacaagcgctgatctcaccgttgaaaaggccgccgacatcacatgggaggaagaggctgaacagacgggagtgtctcacaacctgatgattaccgtcgacgatgacggcacaatgcggatcaaagatgacgagaccgagaatatccttacagtgctgctgaagaccgccctcctgattgtctccggcatcttcccgtacagcattcctgcgacgcttctggtgtggcatacctggcagaaacagacacaacgctctggggttctctgggatgtgccctcccctcccgaaacccagaaggctgagctggaagagggagtctacagaatcaaacagcagggcatttttgggaagacacaagtgggagttggcgtgcagaaggagggggtcttccacaccatgtggcacgtgacacggggagccgtgctcacgtataacggcaaacgcctggaaccgaattgggccagcgttaagaaagaccttatctcttacggcgggggatggagactgtccgctcagtggcaaaagggcgaggaagtccaggtgattgccgtggagcctgggaaaaaccccaagaattttcagaccatgcctggaacattccagaccaccacaggcgaaatcggggcgatcgctctggatttcaagcccggaacgagcggctcccccattatcaaccgggagggcaaagtcgtggggctctatggaaatggcgttgtgaccaagaacgggggatacgtcagcggcattgcccaaacaaatgccgagcctgacgggccgacccccgaactggaggaagagatgtttaaaaagcgcaaccttacaatcatggatctgcatcctggctctggaaaaaccagaaagtatctccccgctattgtgcgggaagccatcaagcgcagactgcggacgctcatcctggctcctacaagagttgtggccgcggagatggaggaagcccttaaaggcctgcccattcgctaccagaccaccgctacaaagagcgagcacaccgggcgggaaatcgtcgacctgatgtgccatgccacattcaccatgagactcctgtcccctgtgcgcgttccgaattataaccttattatcatggatgaggctcactttacggaccccgcctctattgccgctcggggatacatcagcacaagagtgggcatgggggaagcggccgctatcttcatgaccgccacacctcccggaaccgccgatgcttttcctcagtccaatgcccccattcaggacgaggagcgcgacatcccggaacggtcttggaacagcggcaatgagtggattacggatttcgcggggaaaaccgtctggtttgtgccttccatcaaggctggcaacgacattgccaactgtctgcgcaaaaatggaaagaaggtgatccaactctctagaaaaacattcgataccgaataccagaagacaaaactgaacgactgggattttgtcgttaccacagacattagcgagatgggcgccaatttcaaggctgatcgggtgatcgaccccagacggtgcctgaaacccgtgatcctcaccgatgggcctgagcgcgtcattcttgccggacccatgcctgtgacggcggcctccgctgcccagagacggggccgcgttgggagaaacccgcagaaggaaaatgaccaatatatctttacaggacagcccctgaacaatgatgaggaccatgctcactggaccgaagccaagatgctgctcgacaacattaatacccctgagggcatcattcccgctctgttcgaacctgagcgggagaaaagcgccgcgatcgatggggaatacagacttaagggcgagtctcgcaaaacattcgtggaactgatgcggagaggagacctccccgtctggctggcccacaaggtggcttccgagggcatcaaatataccgatcgcaagtggtgctttgacgggcagcggaacaatcagattctggaagagaacatggatgttgagatctggacaaaagaaggagagaagaagaaactcagaccgcgctggcttgacgcccggacgtacagcgatcctctggctctgaaggagttcaaagagtttgccgccggcagaaagtctattgctctcgacctggtgaccgaaatcgggcgcgtcccctcccatcttgcgcacagaacacggaatgccctggataacctcgtgatgctgcataccagcgagcacggaggccgcgcttatagacacgccgtcgaggaactgcctgagacaatggaaaccctccttctgctgggcctcatgattctgcttacagggggagccatgctgttcctcatctccggcaaagggatcggaaagacctctattggcctgatctgtgtgattgctagctccgggatgctgtggatggccgagatccccctccaatggattgcgagcgccatcgttcttgagtttttcatgatggtgctgctgattcctgaacccgagaagcagcggacaccgcaggacaatcaactcgcttacgtggtcatcggaatcctgacccttgccgctattatcgccgcgaacgaaatgggcctgctcgagacaaccaaacgcgatctgggcatgtctaaggaacctggggttgtgtcccccacgagctatctggacgtggatctccatcccgcctctgcttggacactttacgccgtcgctaccacagtgattacccctatgctgagacacaccatcgagaatagcacagccaacgtttccctggctgccattgcgaaccaggccgtggtcctcatgggactggacaaaggctggccgatctctaagatggaccttggggtgcccctgctcgctctgggatgctacagccaggtcaatcctctgacgctcaccgccgctgtgcttctgctgatcacacattatgccattatcggccccgggctccaggccaaagcgacccgggaggctcaaaagagaacagccgctggaattatgaagaaccctaccgttgatggcatcatgacgattgacctggatcccgtgatctacgactccaaatttgaaaagcagcttggccaggtcatgctgctcgtgctgtgtgccgttcagctgctccttatgcgcacatcttgggccctgtgcgaggctctgaccctcgccaccgggcctatcacaaccctgtgggaaggaagcccgggcaaattctggaatacaacgattgcggtgtccatggccaacatctttcgggggagctatcttgctggagccggcctggctttctctattatgaagtccgtcgggaccggaaaaagaggcacaggcagccaaggggagaccctcggagaaaagtggaagaaaaagctgaatcagctgtcccgcaaagattttgacctctacaagaaatctggcatcacagaggtggatcggaccgaggccaaggaagggcttaaaagaggagagattacgcaccatgcggtgagccggggctccgccaagctgcagtggttcgttgaacgcaacatggtcatccccgaggggagagtgattgacctgggatgtggccggggcgggtggtcttattactgcgctggactcaagaaagtgaccgaagtccgcggctatacaaaagggggacctggccacgaggagcccgttcctatgagcacctacgggtggaatatcgtgaaactgatgtccggaaaggatgtgttttaccttcccccggaaaaatgtgacacactgctctgcgatatcggcgagagctctccttcccccaccgtcgaagagagcagaacaattcgggtgctgaagatggttgagccctggctgaagaacaatcagttctgtatcaaagtgctcaacccttatatgcccaccgtcattgaacaccttgagcgcctgcaaagaaagcatggcgggatgctggtgcggaatcctctctctcgcaactccacgcacgaaatgtactggatcagcaatggaacaggcaacattgttgcctctgtgaatatggtcagcagactgcttctgaaccggttcaccatgacccatagacgcccgacaatcgagaaagacgtggatctcggggctggaacgcggcacgtgaacgccgaacccgagacccctaatatggacgtcatcggcgagagaattaagcgcatcaaagaagaacacaactccacatggcattatgacgatgaaaatccctacaagacctgggcttatcacgggtcttacgaggttaaggccacaggaagcgcgtccagcatgattaacggcgtggtgaaactgctgaccaagccttgggacgtcgtgcccatggttacacagatggccatgaccgatacgaccccgtttggccagcaacgggtgttcaaagaaaaggtcgacacaagaacccctcgctccatgcccgggacacggagagtgatgggaatcaccgctgagtggctctggcgcacgctgggccggaataaaaagcctagactttgcacacgcgaggaatttaccaagaaagttcggacaaacgccgctatgggggccgtgttcaccgaggaaaatcagtgggattctgccaaggcggctgtcgaggacgaagatttttggaaactggtggacagagagcgcgagctccataagctgggaaaatgtggcagctgcgtttataacatgatggggaagagagagaagaaacttggcgagttcggaaaggccaaaggctcccgggccatttggtacatgtggctgggggctcgctacctcgaatttgaggccctgggattcctgaatgaggatcactggttttctagagaaaacagctattccggcgtggagggggaaggactccataagctgggctacatccttcgggacatctctaaaattcccgggggcgctatgtatgccgatgacacggcgggatgggacaccagaatcacagaggatgacctgcacaatgaagagaagattacccagcagatggatcctgagcaccggcaactcgccaacgctatcttcaaactgacataccagaataaggtcgtgaaggtccagcgccccaccccgacaggcaccgtgatggacattatcagcagaaaagatcagcgggggtccggacaagttggcacgtatgggcttaacacatttaccaatatggaagcccagctgatccgccagatggagggagaaggcgtgctcagcaaggctgacctggagaaccctcatctgcccgagaagaagattacccagtggctcgagacaaaaggggtcgagagactgaagcggatggccatctctggcgatgactgcgtggtgaagcccattgatgaccgcttcgcgaacgcccttctggctctcaatgatatgggaaaagttagaaaggacatccctcaatggcagccgtccaaaggctggcacgattggcaacaggtgcccttttgtagccatcacttccacgaactgattatgaaggacgggcggaaacttgtcgtgccttgccgcccccaagacgagctgatcggacgggcccggatttctcagggcgctgggtggtccctcaaggaaaccgcctgtctgggaaaggcttacgcccagatgtggagcctgatgtatttccatcgcagagatctccggctggcgtctaacgccatctgctccgctgttcctgtgcactgggtccccacaagccgcacgacctggtccatccatgcccaccatcaatggatgacaaccgaggacatgcttacagtgtggaatagagtctggattgaagataacccttggatggaggacaaaacccccgtgacgacctgggagaatgttccgtacctgggcaagcgggaagatcagtggtgtgggagcctcatcggcctgacatctagagccacctgggctcagaacattcctacagccatccagcaagtgcgcagccttattggaaatgaggaatttctggactacatgccctccatgaaacggttcagaaaggaggaggaatctgagggcgcgatctggtga

SEQ ID NO: 20533 - RNA, 9873 nt, synthetic construct
  misc_feature 1..9873: note = derived and/or modified CDS sequence (opt5) from DENV-3__FJ873813__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacatatcagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaggccgctgacatcacatgggaggaagaggccgaacagacgggagtgagccataacctcatgattaccgtcgacgatgacggcacaatgcggatcaaagatgacgagaccgagaatatcctgacagtgcttctgaagaccgcgctgctcattgtctctggcatctttccgtattccattcctgctacgctgcttgtgtggcacacctggcagaaacagacacaacgcagcggggttctgtgggatgtgccctctcctcccgaaacccagaaggccgagctcgaagagggagtctacagaatcaaacagcagggcattttcgggaagacacaagtgggagttggcgtgcagaaggagggggtctttcacaccatgtggcatgtgacacggggagccgtgctgacgtacaacggcaaacgcctcgaaccgaattgggcttccgttaagaaagacctgatcagctatggcgggggatggagactttctgcccagtggcaaaagggcgaggaagtccaggtgattgcggtggagcctgggaaaaaccccaagaatttccagaccatgcctggaacattccagaccaccacaggcgaaatcggggctatcgccctggattttaagcccggaacgtccggcagccccattatcaaccgggagggcaaagtcgtggggctgtacggaaatggcgttgtgaccaagaacgggggatatgtctccggcattgcccaaacaaatgctgagcctgacgggccgacccccgaactcgaggaagagatgttcaaaaagcgcaacctgacaatcatggatcttcaccctggcagcggaaaaaccagaaagtacctgcccgccattgtgcgggaagctatcaagcgcagactccggacgctgatcctcgcccctacaagagttgtggcggccgagatggaggaagctctgaaaggccttcccattcgctatcagaccaccgccacaaagtctgagcataccgggcgggaaatcgtcgacctgatgtgccacgctacatttaccatgagactgctcagccctgtgcgcgttccgaattacaacctgattatcatggatgaggcccatttcacggaccccgcctccattgctgcgcggggatatatctctacaagagtgggcatgggggaagccgctgccatctttatgaccgccacacctcccggaaccgctgatgccttccctcagagcaatgcgcccattcaggacgaggagcgcgacatcccggaacggtcctggaactctggcaatgagtggattacggattttgctgggaaaaccgtctggttcgtgcctagcatcaaggccggcaacgacattgccaactgtcttcgcaaaaatggaaagaaggtgatccaactgtccagaaaaacatttgataccgaataccagaagacaaaactcaacgactgggatttcgtcgttaccacagacatttctgagatgggcgctaattttaaggccgatcgggtgatcgaccccagacggtgcctgaaacccgtgatcctgaccgatgggcctgagcgcgtcattctcgcgggacccatgcctgtgacggccgctagcgccgctcagagacggggccgcgttgggagaaacccgcagaaggaaaatgaccaatacatcttcacaggacagccccttaacaatgatgaggaccacgcccactggaccgaagctaagatgctgctggacaacattaatacccctgagggcatcattcccgccctcttcgaacctgagcgggagaaatccgcggccatcgatggggaatatagactgaagggcgagagccgcaaaacatttgtggaacttatgcggagaggagacctgcccgtctggctcgctcataaggtggcctctgagggcatcaaatacaccgatcgcaagtggtgcttcgacgggcagcggaacaatcagattctggaagagaacatggatgttgagatctggacaaaagaaggagagaagaagaaactgagaccgcgctggctcgacgctcggacgtattccgatcctcttgccctgaaggaatttaaagagttcgccgctggcagaaagagcattgcgctggacctcgtgaccgaaatcgggcgcgtcccctctcacctggcccatagaacacggaatgctcttgataacctggtgatgctccacacctccgagcacggaggccgcgcctacagacatgccgtcgaggaactgcctgagacaatggaaaccctgctccttctgggcctgatgattctcctgacagggggagctatgctttttctgatcagcggcaaagggatcggaaagacctccattggcctcatctgtgtgattgcctctagcgggatgctgtggatggcggagatccccctgcaatggattgcctccgctatcgttctcgagttctttatgatggtgcttctgattcctgaacccgagaagcagcggacaccgcaggacaatcaactggcctatgtggtcatcggaatcctcaccctggctgccattatcgcggccaacgaaatgggccttctggagacaaccaaacgcgatctcggcatgagcaaggaacctggggttgtgtctcccacgtcctacctggacgtggatctgcaccccgctagcgcctggacactctatgctgtcgccaccacagtgattacccctatgcttagacataccatcgaaaattctacagctaacgttagcctggccgcgattgccaaccaggctgtggtcctgatgggactcgacaaaggctggccgatctccaagatggacctgggggtgccccttctggccctcggatgctactctcaggtcaatcctctgacgctgaccgctgccgtgctccttctgatcacacactacgccattatcggccccgggctgcaggcgaaagctacccgggaggcccaaaagagaacagctgccggaattatgaagaaccctaccgttgatggcatcatgacgattgacctcgatcccgtgatctatgacagcaaattcgaaaagcagctgggccaggtcatgcttctggtgctctgtgccgttcagctgctgctcatgcgcacatcctgggctctttgcgaggccctgaccctggcgaccgggcctatcacaaccctctgggaaggatctccgggcaaattttggaatacaacgattgccgtgagcatggctaacatcttccgggggtcctacctggccggagctggccttgcctttagcattatgaagtctgtcgggaccggaaaaagaggcacaggctcccaaggggagaccctgggagaaaagtggaagaaaaagctcaatcagctgagccgcaaagatttcgacctgtataagaaatccggcatcacagaggtggatcggaccgaggcgaaggaagggctcaaaagaggagagattacgcatcacgccgtgtctcggggcagcgctaaacttcagtggtttgttgaacgcaacatggtcatccccgaggggagagtgattgacctgggatgtggccggggcgggtggtcctactattgcgccggactgaagaaagtgaccgaagtccgcggctacacaaaagggggacctggccacgaggagcccgttcctatgtctacctatgggtggaatatcgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttacatgcccaccgtcattgaacatctcgagcgccttcaaagaaagcacggcgggatgctggtgcggtatcctctgagccgcaattctacgcatgaaatgtactggatctccaacggaacaggcaatattgttgctagcgtgaacatggtctctagactcctgcttaatcggtttaccatgacccacagacgcccgacaatcgagaaagacgtggatctgggggccggaacgcggcacgtgaacgctgaacccgagacccctaacatggacgtcatcggcgagagaattaagcgcatcaaagaagaacacaatagcacatggcactatgacgatgaaaacccctacaagacctgggcctatcatgggtcctacgaggttaaggcgacaggatctgccagctccatgattaatggcgtggtgaaactcctgaccaagccttgggacgtcgtgcccatggttacacagatggctatgaccgatacgaccccgttcggccagcaacgggtgtttaaagaaaaggtcgacacaagaacccctcgcagcatgcccgggacacggagagtgatgggaatcaccgccgagtggctgtggcgcacgctcggccggaacaaaaagcctagactgtgcacacgcgaggagttcaccaagaaagttcggacaaatgctgccatgggggccgtgtttaccgaggaaaaccagtgggattccgcgaaggctgccgtcgaggacgaagatttctggaaacttgtggacagagagcgcgagctgcacaagctcggaaaatgtggctcttgcgtttataatatgatggggaagagagagaagaagctgggcgagtttggaaaggccaaaggcagccgggctatttggtacatgtggcttggggcccgctacctggagttcgaggctctcggatttctgaacgaggatcattggttctccagagaaaattcttatagcggcgtggagggggaaggactgcacaagctcggctacatcctgcgggacatctccaaaattcccgggggcgccatgtatgcggatgacacggccggatgggacaccagaatcacagaggatgaccttcacaacgaagagaagattacccagcagatggatcctgagcatcggcaactggctaatgccatctttaaactcacataccagaacaaggtcgtgaaggtccagcgccccaccccgacaggcaccgtgatggacattatctctagaaaagatcagcgggggagcggacaagttggcacgtatgggctgaatacattcaccaacatggaagctcagcttatccgccagatggagggagaaggcgtgctgtccaaggccgacctcgagaatcctcatctgcccgagaagaagattacccagtggctggagacaaaaggggtcgagagactcaagcggatggcgatcagcggcgatgactgcgtggtgaagcccattgatgaccgctttgccaacgctctgcttgccctgaacgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggctcggattagccagggcgccgggtggtctctgaaggaaaccgcttgtctcggaaaggcctacgcgcagatgtggtccctgatgtattttcaccgcagagatctgcggctcgccagcaatgctatctgctctgccgttcctgtgcattgggtccccacatcccgcacgacctggagcatccacgcccatcaccaatggatgacaaccgaggacatgctgacagtgtggaacagagtctggattgaagataatccttggatggaggacaaaacccccgtgacgacctgggagaacgttccgtaccttggcaagcgggaagatcagtggtgtgggtccctgatcggcctcacaagcagagctacctgggcccagaatattcctacagcgatccagcaagtgcgctctctgattggaaacgaggagttccttgactacatgcccagcatgaaacggtttagaaaggaggaggaatccgagggcgctatctggtga

SEQ ID NO: 20534 - RNA, 9873 nt, synthetic construct
  misc_feature 1..9873: note = derived and/or modified CDS sequence (opt5) from DENV-3__FJ850048__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctgacatcacatgggaggaagaggccgaacagacgggagtgagccacaacctcatgattaccgtcgacgatgacggcacaatgcggatcaaagatgacgagaccgagaatatcctgacagtgcttctgaagaccgcgctgctcattgtctctggcatctttccgtactccattcctgctacgctgcttgtgtggcatacctggcagaaacagacacaacgcagcggggttctgtgggatgtgccctctcctcccgaaacccagaaggccgagctcgaagagggagtctacagaatcaaacagcagggcattttcgggaagacacaagtgggagttggcgtgcagaaggagggggtctttcacaccatgtggcacgtgacacggggagccgtgctgacgtataacggcaaacgcctcgaaccgaattgggcttccgttaagaaagacctgatcagctacggcgggggatggagactttctgcccagtggcaaaagggcgaggaagtccaggtgattgcggtggagcctgggaaaaaccccaagaatttccagaccatgcctggaacattccagaccaccacaggcgaaatcggggctatcgccctggattttaagcccggaacgtccggcagccccattatcaaccgggagggcaaagtcgtggggctgtatggaaatggcgttgtgaccaagaacgggggatacgtctccggcattgcccaaacaaatgctgagcctgacgggccgacccccgaactcgaggaagagatgttcaaaaagcgcaacctgacaatcatggatcttcatcctggcagcggaaaaaccagaaagtatctgcccgccattgtgcgggaagctatcaagcgcagactccggacgctgatcctcgcccctacaagagttgtggcggccgagatggaggaagctctgaaaggccttcccattcgctaccagaccaccgccacaaagtctgagcacaccgggcgggaaatcgtcgacctgatgtgccatgctacatttaccatgagactgctcagccctgtgcgcgttccgaattataacctgattatcatggatgaggcccacttcacggaccccgcctccattgctgcgcggggatacatctctacaagagtgggcatgggggaagccgctgccatctttatgaccgccacacctcccggaaccgctgatgccttccctcagagcaatgcgcccattcaggacgaggagcgcgacatcccggaacggtcctggaactctggcaatgagtggattacggattttgctgggaaaaccgtctggttcgtgcctagcatcaaggccggcaacgacattgccaactgtcttcgcaaaaatggaaagaaggtgatccaactgtccagaaaaacatttgataccgaataccagaagacaaaactcaacgactgggatttcgtcgttaccacagacatttctgagatgggcgctaattttaaggccgatcgggtgatcgaccccagacggtgcctgaaacccgtgatcctgaccgatgggcctgagcgcgtcattctcgcgggacccatgcctgtgacggccgctagcgccgctcagagacggggccgcgttgggagaaacccgcagaaggaaaatgaccaatatatcttcacaggacagccccttaacaatgatgaggaccatgcccactggaccgaagctaagatgctgctggacaacattaatacccctgagggcatcattcccgccctcttcgaacctgagcgggagaaatccgcggccatcgatggggaatacagactgaagggcgagagccgcaaaacatttgtggaacttatgcggagaggagacctgcccgtctggctcgctcacaaggtggcctctgagggcatcaaatataccgatcgcaagtggtgcttcgacgggcagcggaacaatcagattctggaagagaacatggatgttgagatctggacaaaagaaggagagaagaagaaactgagaccgcgctggctcgacgctcggacgtactccgatcctcttgccctgaaggaatttaaagagttcgccgctggcagaaagagcattgcgctggacctcgtgaccgaaatcgggcgcgtcccctctcatctggcccacagaacacggaatgctcttgataacctggtgatgctccatacctccgagcacggaggccgcgcctatagacacgccgtcgaggaactgcctgagacaatggaaaccctgctccttctgggcctgatgattctcctgacagggggagctatgctttttctgatcagcggcaaagggatcggaaagacctccattggcctcatctgtgtgattgcctctagcgggatgctgtggatggcggagatccccctgcaatggattgcctccgctatcgttctcgagttctttatgatggtgcttctgattcctgaacccgagaagcagcggacaccgcaggacaatcaactggcctacgtggtcatcggaatcctcaccctggctgccattatcgcggccaacgaaatgggccttctggagacaaccaaacgcgatctcggcatgagcaaggaacctggggttgtgtctcccacgtcctatctggacgtggatctgcatcccgctagcgcctggacactctacgctgtcgccaccacagtgattacccctatgcttagacacaccatcgaaaattctacagctaacgttagcctggccgcgattgccaaccaggctgtggtcctgatgggactcgacaaaggctggccgatctccaagatggacctgggggtgccccttctggccctcggatgctactctcaggtcaatcctctgacgctgaccgctgccgtgctccttctgatcacacattatgccattatcggccccgggctgcaggcgaaagctacccgggaggcccaaaagagaacagctgccggaattatgaagaaccctaccgttgatggcatcatgacgattgacctcgatcccgtgatctacgacagcaaattcgaaaagcagctgggccaggtcatgcttctggtgctctgtgccgttcagctgctgctcatgcgcacatcctgggctctttgcgaggccctgaccctggcgaccgggcctatcacaaccctctgggaaggatctccgggcaaattttggaatacaacgattgccgtgagcatggctaacatcttccgggggtcctatctggccggagctggccttgcctttagcattatgaagtctgtcgggaccggaaaaagaggcacaggctcccaaggggagaccctgggagaaaagtggaagaaaaagctcaatcagctgagccgcaaagatttcgacctgtacaagaaatccggcatcacagaggtggatcggaccgaggcgaaggaagggctcaaaagaggagagattacgcaccatgccgtgtctcggggcagcgctaaacttcagtggtttgttgaacgcaacatggtcatccccgaggggagagtgattgacctgggatgtggccggggcgggtggtcctattactgcgccggactgaagaaagtgaccgaagtccgcggctatacaaaagggggacctggccacgaggagcccgttcctatgtctacctacgggtggaatatcgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttatatgcccaccgtcattgaacacctcgagcgccttcaaagaaagcatggcgggatgctggtgcggaatcctctgagccgcaactctacgcacgaaatgtactggatctccaatggaacaggcaacattgttgctagcgtgaatatggtctctagactcctgcttaaccggtttaccatgacccatagacgcccgacaatcgagaaagacgtggatctgggggccggaacgcggcacgtgaacgctgaacccgagacccctaatatggacgtcatcggcgagagaattaagcgcatcaaagaagaacacaacagcacatggcattatgacgatgaaaatccctacaagacctgggcctatcacgggtcctacgaggttaaggcgacaggatctgccagctccatgattaacggcgtggtgaaactcctgaccaagccttgggacgtcgtgcccatggttacacagatggctatgaccgatacgaccccgttcggccagcaacgggtgtttaaagaaaaggtcgacacaagaacccctcgcagcatgcccgggacacggagagtgatgggaatcaccgccgagtggctgtggcgcacgctcggccggaataaaaagcctagactgtgcacacgcgaggagttcaccaagaaagttcggacaaacgctgccatgggggccgtgtttaccgaggaaaatcagtgggattccgcgaaggctgccgtcgaggacgaagatttctggaaacttgtggacagagagcgcgagctgcataagctcggaaaatgtggctcttgcgtttataacatgatggggaagagagagaagaagctgggcgagtttggaaaggccaaaggcagccgggctatttggtacatgtggcttggggcccgctacctggagttcgaggctctcggatttctgaatgaggatcactggttctccagagaaaactcttatagcggcgtggagggggaaggactgcataagctcggctacatcctgcgggacatctccaaaattcccgggggcgccatgtatgcggatgacacggccggatgggacaccagaatcacagaggatgaccttcacaatgaagagaagattacccagcagatggatcctgagcaccggcaactggctaacgccatctttaaactcacataccagaataaggtcgtgaaggtccagcgccccaccccgacaggcaccgtgatggacattatctctagaaaagatcagcgggggagcggacaagttggcacgtatgggctgaacacattcaccaatatggaagctcagcttatccgccagatggagggagaaggcgtgctgtccaaggccgacctcgagaaccctcatctgcccgagaagaagattacccagtggctggagacaaaaggggtcgagagactcaagcggatggcgatcagcggcgatgactgcgtggtgaagcccattgatgaccgctttgccaacgctctgcttgccctgaatgatatgggaaaagttagaaaggacatccctcaatggcagccgtctaaaggctggcacgattggcaacaggtgcccttctgttcccatcacttccacgaactcattatgaaggacgggcggaaactggtcgtgccttgccgcccccaagacgagcttatcggacgggctcggattagccagggcgccgggtggtctctgaaggaaaccgcttgtctcggaaaggcctacgcgcagatgtggtccctgatgtattttcatcgcagagatctgcggctcgccagcaacgctatctgctctgccgttcctgtgcactgggtccccacatcccgcacgacctggagcatccatgcccaccatcaatggatgacaaccgaggacatgctgacagtgtggaatagagtctggattgaagataacccttggatggaggacaaaacccccgtgacgacctgggagaatgttccgtaccttggcaagcgggaagatcagtggtgtgggtccctgatcggcctcacaagcagagctacctgggcccagaacattcctacagcgatccagcaagtgcgctctctgattggaaatgaggagttccttgactacatgcccagcatgaaacggtttagaaaggaggaggaatccgagggcgctatctggtga

SEQ ID NO: 20535 - RNA, 9873 nt, synthetic construct
  misc_feature 1..9873: note = derived and/or modified CDS sequence (opt5) from DENV-3__FJ850049__SS-prME
  source 1..9873: mol_type = other RNA
accagcctgtgcctcatgatgatcctgcccgccgctcttgccttccacctgacgtcccgggacggcgaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacatatcagctctggacggccctgatctcccttacctgtagcaacacaattttcaccctgacagtggcgtggcgcaccgccacgctcatcctggctggcgtctccctgcttccgatgtgccaatctagctccatgcggaagacagactggctgcccatggccgttgctgccatgggggtgcctcccctccctctgtttatcttctctctcaaggataccctgaaaagacgcagctggccccttaatgagggagtgatggccgtcggcctggtgtccattctggcttctagcctcctgagaaacgacgttcctatggcggggccccttgtggccggaggcctgctcatcgcttgttacgtcattaccgggacatccgccgatctgaccgtggaaaaggccgctaacatcacatgggaggaagaggccgaacagacgggagttagccataatctcatgattaccgtggacgacgatggcacaatgcggatcaaagacgatgagaccgagaacatcctgacagtccttctgaagaccgcgctgctcattgtgtctggcatctttccgtattccattcctgctacgctgcttgtctggcacacctggcagaaacagacacaacgcagcggggtgctgtgggacgttccctctcctcccgaaacccagaaggccgagctcgaagagggagtgtacagaatcaaacagcagggcattttcgggaagacacaagtcggagtgggcgttcagaaggagggggtgtttcacaccatgtggcatgtcacacggggagccgtgctgacgtacaatggcaaacgcctcgaaccgaactgggcttccgtgaagaaagatctgatcagctatggcgggggatggagactttctgcccagtggcaaaagggcgaggaagttcaggtcattgcggtggagcctgggaaaaatcccaagaacttccagaccatgcctggaacattccagaccaccacaggcgaaatcggggctatcgccctggactttaagcccggaacgtccggcagccccattatcaatcgggagggcaaagtggtcgggctgtacggaaacggcgtggttaccaagaatgggggatatgtgtccggcattgcccaaacaaacgctgagcctgatgggccgacccccgaactcgaggaagagatgttcaaaaagcgcaatctgacaatcatggaccttcaccctggcagcggaaaaaccagaaagtacctgcccgccattgtccgggaagctatcaagcgcagactccggacgctgatcctcgcccctacaagagtggttgcggccgagatggaggaagctctgaaaggccttcccattcgctatcagaccaccgccacaaagtctgagcataccgggcgggaaatcgtggatctgatgtgccacgctacatttaccatgagactgctcagccctgtccgcgtgccgaactacaatctgattatcatggacgaggcccatttcacggatcccgcctccattgctgcgcggggatatatctctacaagagttggcatgggggaagccgctgccatctttatgaccgccacacctcccggaaccgctgacgccttccctcagagcaacgcgcccattcaggatgaggagcgcgacatcccggaacggtcctggaactctggcaacgagtggattacggactttgctgggaaaaccgtgtggttcgtccctagcatcaaggccggcaacgatattgccaattgtcttcgcaaaaacggaaagaaggtgatccaactgtccagaaaaacatttgacaccgaataccagaagacaaaactcaatgattgggacttcgtggtcaccacagatatttctgagatgggcgctaactttaaggccgaccgggttatcgatcccagacggtgcctgaaacccgtgatcctgaccgacgggcctgagcgcgtgattctcgcgggacccatgcctgtcacggccgctagcgccgctcagagacggggccgcgtggggagaaatccgcagaaggaaaacgatcaatacatcttcacaggacagccccttaataacgacgaggatcacgcccactggaccgaagctaagatgctgctggacaatattaacacccctgagggcatcattcccgccctcttcgaacctgagcgggagaaatccgcggccatcgacggggaatatagactgaagggcgagagccgcaaaacatttgttgaacttatgcggagaggagatctgcccgtgtggctcgctcataaggtcgcctctgagggcatcaaatacaccgaccgcaagtggtgcttcgatgggcagcggaataaccagattctggaagagaatatggacgtggagatctggacaaaagaaggagagaagaagaaactgagaccgcgctggctcgatgctcggacgtattccgaccctcttgccctgaaggaatttaaagagttcgccgctggcagaaagagcattgcgctggatctcgttaccgaaatcgggcgcgtgccctctcacctggcccatagaacacggaacgctcttgacaatctggtcatgctccacacctccgagcacggaggccgcgcctacagacatgccgtggaggaactgcctgagacaatggaaaccctgctccttctgggcctgatgattctcctgacagggggagctatgctttttctgatcagcggcaaagggatcggaaagacctccattggcctcatctgtgtcattgcctctagcgggatgctgtggatggcggagatccccctgcaatggattgcctccgctatcgtgctcgagttctttatgatggttcttctgattcctgaacccgagaagcagcggacaccgcaggataaccaactggcctatgtggtgatcggaatcctcaccctggctgccattatcgcggccaatgaaatgggccttctggagacaaccaaacgcgacctcggcatgagcaaggaacctggggtcgtttctcccacgtcctacctggatgtggacctgcaccccgctagcgcctggacactctatgctgtggccaccacagtcattacccctatgcttagacataccatcgagaactctacagctaacgtgagcctggccgcgattgccaatcaggctgttgtgctgatgggactcgataaaggctggccgatctccaagatggacctgggggtcccccttctggccctcggatgctactctcaggtgaaccctctgacgctgaccgctgccgtcctccttctgatcacacactacgccattatcggccccgggctgcaggcgaaagctacccgggaggcccaaaagagaacagctgccggaattatgaagaatcctaccgtggacggcatcatgacgattgatctcgaccccgttatctatgatagcaaattcgaaaagcagctgggccaggtgatgcttctggtcctctgtgccgtgcagctgctgctcatgcgcacatcctgggctctttgcgaggccctgaccctggcgaccgggcctatcacaaccctctgggaaggatctccgggcaaattttggaacacaacgattgccgttagcatggctaatatcttccgggggtcctacctggccggagctggccttgcctttagcattatgaagtctgtggggaccggaaaaagaggcacaggctcccaaggggagaccctgggagaaaagtggaagaaaaagctcaaccagctgagccgcaaagacttcgatctgtataagaaatccggcatcacagaggtcgaccggaccgaggcgaaggaagggctcaaaagaggagagattacgcatcacgccgtgtctcggggcagcgctaaacttcagtggtttgtggaacgcaatatggttatccccgaggggagagtcattgatctgggatgtggccggggcgggtggtcctactattgcgccggactgaagaaagtgaccgaagtgcgcggctacacaaaagggggacctggccacgaggagcccgtccctatgtctacctatgggtggaacatcgttaaactcatgagcggaaaggacgtgttctacctgcccccggaaaaatgtgatacacttctgtgcgacatcggcgagtccagcccttctcccaccgtggaagagtccagaacaattcgggtcctcaagatggtggagccctggctgaagaataaccagttctgtatcaaagttctgaatccttacatgcccaccgtgattgaacatctcgagcgccttcaaagaaagcacggcgggatgctggtccggaaccctctgagccgcaattctacgcatgaaatgtattggatctccaacggaacaggcaatattgtggctagcgttaacatggtgtctagactcctgcttaaccggtttaccatgacccacagacgcccgacaatcgagaaagatgtcgacctgggggccggaacgcggcacgtgaatgctgaacccgagacccctaacatggatgtgatcggcgagagaattaagcgcatcaaagaagaacacaatagcacatggcactacgacgacgaaaacccctataagacctgggcctaccatgggtcctatgaggtcaaggcgacaggatctgccagctccatgattaatggcgttgtgaaactcctgaccaagccttgggatgtggtccccatggtgacacagatggctatgaccgacacgaccccgttcggccagcaacgggtttttaaagaaaaggtggatacaagaacccctcgcagcatgcccgggacacggagagtcatgggaatcaccgccgagtggctgtggcgcacgctcggccggaacaaaaagcctagactgtgcacacgcgaggagttcaccaagaaagtgcggacaaatgctgccatgggggccgtttttaccgaggaaaaccagtgggactccgcgaaggctgccgtggaggatgaagacttctggaaacttgtcgatagagagcgcgagctgcacaagctcggaaaatgtggctcttgcgtgtacaatatgatggggaagagagagaagaagctgggcgagtttggaaaggccaaaggcagccgggctatttggtatatgtggcttggggcccgctacctggagttcgaggctctcggatttctgaacgaggaccattggttctccagagaaaattcttacagcggcgttgagggggaaggactgcacaagctcggctatatcctgcgggatatctccaaaattcccgggggcgccatgtacgcggacgatacggccggatgggacaccagaatcacagaggacgatcttcacaacgaagagaagattacccagcagatggaccctgagcatcggcaactggctaatgccatctttaaactcacatatcagaacaaggtggtcaaggtgcagcgccccaccccgacaggcaccgtcatggatattatctctagaaaagaccagcgggggagcggacaagtgggcacgtacgggctgaatacattcaccaacatggaagctcagcttatccgccagatggagggagaaggcgttctgtccaaggccgatctcgagaaccctcatctgcccgagaagaagattacccagtggctggagacaaaaggggtggagagactcaagcggatggcgatcagcggcgacgattgcgtcgtgaagcccattgacgatcgctttgccaatgctctgcttgccctgaacgacatgggaaaagtgagaaaggatatccctcaatggcagccgtctaaaggctggcatgactggcagcaggttcccttctgttcccaccacttccatgaactcattatgaaggatgggcggaaactggtggtcccttgccgcccccaagacgagcttatcggacgggctcggattagccagggcgccgggtggtctctgaaggaaaccgcttgtctcggaaaggcctatgcgcagatgtggtccctgatgtactttcaccgcagagacctgcggctcgccagcaatgctatctgctctgccgtgcctgttcattgggtgcccacatcccgcacgacctggagcatccacgcccatcaccaatggatgacaaccgaggatatgctgacagtctggaacagagtgtggattgaagacaatccttggatggaggataaaacccccgtcacgacctgggagaacgtgccgtatcttggcaagcgggaagaccagtggtgtgggtccctgatcggcctcacaagcagagctacctgggcccagaatattcctacagcgatccagcaagttcgctctctgattggaaacgaggagttccttgattacatgcccagcatgaaacggtttagaaaggaggaggaatccgagggcgctatctggtga

SEQ ID NO: 20536 - RNA, 9873 nt, synthetic construct
  misc_feature 1..9873: note = derived and/or modified CDS sequence (opt5) from DENV-3__FJ898476__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattgcgctggacctcgtgaccgaaatcggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgattctcctgacgggaggcgctatgctttttctgatctccgggaaaggaatcggcaagaccagcattgggctcatctgtgtgattgcctcctctggaatgctgtggatggcggagatccccctgcaatggattgccagcgctatcgttctcgagttctttatgatggtgcttctgattcctgaacccgagaagcagcggacaccgcaggacaatcaactggcctacgtggtcatcggcatcctcaccctggctgccattatcgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgattacccctatgcttagacacaccatcgagaatagcacagctaacgtttctctggccgcgattgccaaccaggctgtggtcctgatgggcctcgacaaagggtggccgatcagcaagatggacctgggagtgccccttctggccctcggctgctactcccaggtcaatcctctgacgctgaccgctgccgtgctccttctgatcacacattatgccattatcgggcccggactgcaggcgaaagctacccgggaggcccaaaagagaacagctgccggcattatgaagaaccctaccgttgatggcatcatgacgattgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctatcacaaccctctgggaaggctccccggggaaattttggaatacaacgattgccgtgtctatggctaacatcttccggggaagctatctggccggcgctgggcttgccttttccattatgaaaagcgtcggaaccggcaaaagaggcacagggtctcaaggagagaccctgggcgaaaagtggaagaaaaagctcaatcagctgtcccgcaaagatttcgacctgtacaagaaaagcgggatcacagaggtggatcggaccgaggcgaaggaaggactcaaaagaggcgagattacgcaccatgccgtgtcccgggggtctgctaaacttcagtggtttgttgaacgcaacatggtcatccccgagggaagagtgattgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatatcggcgagagctcccctagccccaccgtcgaagagtctagaacaattcgggtgctcaagatggttgagccctggctgaagaacaatcagttctgtatcaaagtgctgaacccttatatgcccaccgtcattgaacacctcgagcgccttcaaagaaagcatgggggaatgctggtgcggaatcctctgtcccgcaacagcacgcacgaaatgtactggatctctaatggcacagggaacattgttgcttccgtgaatatggtcagcagactcctgcttaaccggtttaccatgacccatagacgcccgacaatcgagaaagacgtggatctgggagccggcacgcggcacgtgaacgctgaacccgagacccctaatatggacgtcatcggggagagaattaagcgcatcaaagaagaacacaactctacatggcattatgacgatgaaaatccctacaagacctgggcctatcacggaagctacgaggttaaggcgacaggctccgcctctagcatgattaacggcgtggtgaaactcctgaccaagccttgggacgtcgtgcccatggttacacagatggctatgaccgatacgaccccgttcgggcagcaacgggtgtttaaagaaaaggtcgacacaagaacccctcgctccatgcccggaacacggagagtgatgggcatcaccgccgagtggctgtggcgcacgctcgggcggaataaaaagcctagactgtgcacacgcgaggagttcaccaagaaagttcggacaaacgctgccatgggagccgtgtttaccgaggaaaatcagtgggatagcgcgaaggctgccgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggctatttggtacatgtggcttggagcccgctacctggagttcgaggctctcggctttctgaatgaggatcactggttcagcagagaaaactcctattctggggtggagggagaaggcctgcataagctcgggtacatcctgcgggacatcagcaaaattcccggcggagccatgtatgcggatgacacggccggctgggacaccagaatcacagaggatgaccttcacaatgaagagaagattacccagcagatggatcctgagcaccggcaactggctaacgccatctttaaactcacataccagaataaggtcgtgaaggtccagcgccccaccccgacagggaccgtgatggacattatctccagaaaagatcagcggggatctggccaagttgggacgtatggactgaacacattcaccaatatggaagctcagcttatccgccagatggagggcgaaggggtgctgagcaaggccgacctcgagaaccctcatctgcccgagaaaaagattacccagtggctggagacaaaaggcgtcgagagactcaagcggatggcgatctccggagatgactgcgtggtgaagcccattgatgaccgctttgccaacgctctgcttgccctgaatgatatgggcaaagttagaaaggacatccctcaatggcagccgagcaaagggtggcacgattggcaacaggtgcccttctgttctcatcacttccacgaactcattatgaaggacggacggaaactggtcgtgccttgccgcccccaagacgagcttatcggcagagctcggatttcccagggggccggatggagcctgaaggaaaccgcttgtctcggcaaggcctacgcgcagatgtggtctctgatgtattttcatcgcagagatctgcggctcgcctccaacgctatctgcagcgccgttcctgtgcactgggtccccacatctcgcacgacctggtccatccatgcccaccatcaatggatgacaaccgaggacatgctgacagtgtggaatagagtctggattgaagataacccttggatggaggacaaaacccccgtgacgacctgggagaatgttccgtaccttgggaagcgggaagatcagtggtgtggcagcctgatcggactcacatccagagctacctgggcccagaacattcctacagcgatccagcaagtgcgcagcctgattggcaatgaggagttccttgactacatgccctctatgaaacggtttagaaaggaggaggaaagcgagggggctatctggtga

SEQ ID NO: 20537 - RNA, 9873 nt, synthetic construct
  misc_feature 1..9873: note = derived and/or modified CDS sequence (opt5) from DENV-3__FJ898475__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggctagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttccttacctttgtgctgctcctgagcgggcagattacatggcgcgatatggcccataccctgatcatgattggatccaatgctagcgacagaatgggcatgggggtcacgtatcttgccctgatcgcgacattcaaaatccagccctttctcgctctgggattctttctccggaagctgacctctagagaaaaccttctgctcggcgtggggctggccatggccacaaccctgcaacttcctgaggatattgaacagatggctaatggaatcgccctgggcctcatggctctgaaactcattacccagttcgagacataccagctgtggacggcccttatctccctgacctgtagcaacacaatttttaccctcacagtggcgtggcgcaccgccacgctgatcctggctggcgtctcccttctgccggtttgccaatctagctccatgcggaagacagactggctccccatggccgtggctgccatgggggtgcctcccctgcctctcttcatcttttctctgaaggatacccttaaaagacgcagctggcccctgaatgagggagtcatggccgtgggcctggtttccattctcgcttctagcctgcttagaaacgacgtgcctatggcggggcccctggtcgccggaggcctcctgatcgcttgttatgtgattaccgggacatccgccgatctcaccgttgaaaaggccgctgacatcacatgggaggaagaggccgaacagacgggagtgagccacaacctgatgattaccgtcgacgatgacggcacaatgcggatcaaagatgacgagaccgagaatatccttacagtgctgctgaagaccgcgctcctgattgtctctggcatcttcccgtactccattcctgctacgcttctggtgtggcatacctggcagaaacagacacaacgcagcggggttctctgggatgtgccctctcctcccgaaacccagaaggccgagctggaagagggagtctacagaatcaaacagcagggcatttttgggaagacacaagtgggagttggcgtgcagaaggagggggtcttccacaccatgtggcacgtgacacggggagccgtgctcacgtataacggcaaacgcctggaaccgaattgggcttccgttaagaaagaccttatcagctacggcgggggatggagactgtctgcccagtggcaaaagggcgaggaagtccaggtgattgcggtggagcctgggaaaaaccccaagaattttcagaccatgcctggaacattccagaccaccacaggcgaaatcggggctatcgccctggatttcaagcccggaacgtccggcagccccattatcaaccgggagggcaaagtcgtggggctctatggaaatggcgttgtgaccaagaacgggggatacgtctccggcattgcccaaacaaatgctgagcctgacgggccgacccccgaactggaggaagagatgtttaaaaagcgcaaccttacaatcatggatctgcatcctggcagcggaaaaaccagaaagtatctccccgccattgtgcgggaagctatcaagcgcagactgcggacgctcatcctggcccctacaagagttgtggcggccgagatggaggaagctcttaaaggcctgcccattcgctaccagaccaccgccacaaagtctgagcacaccgggcgggaaatcgtcgacctgatgtgccatgctacattcaccatgagactcctgagccctgtgcgcgttccgaattataaccttattatcatggatgaggcccactttacggaccccgcctccattgctgcgcggggatacatctctacaagagtgggcatgggggaagccgctgccatcttcatgaccgccacacctcccggaaccgctgatgcctttcctcagagcaatgcgcccattcaggacgaggagcgcgacatcccggaacggtcctggaactctggcaatgagtggattacggatttcgctgggaaaaccgtctggtttgtgcctagcatcaaggccggcaacgacattgccaactgtctgcgcaaaaatggaaagaaggtgatccaactctccagaaaaacattcgataccgaataccagaagacaaaactgaacgactgggattttgtcgttaccacagacatttctgagatgggcgctaatttcaaggccgatcgggtgatcgaccccagacggtgcctgaaacccgtgatcctcaccgatgggcctgagcgcgtcattcttgcgggacccatgcctgtgacggccgctagcgccgctcagagacggggccgcgttgggagaaacccgcagaaggaaaatgaccaatatatctttacaggacagcccctgaacaatgatgaggaccatgcccactggaccgaagctaagatgctgctcgacaacattaatacccctgagggcatcattcccgccctgttcgaacctgagcgggagaaatccgcggccatcgatggggaatacagacttaagggcgagagccgcaaaacattcgtggaactgatgcggagaggagacctccccgtctggctggctcacaaggtggcctctgagggcatcaaatataccgatcgcaagtggtgctttgacgggcagcggaacaatcagattctggaagagaacatggatgttgagatctggacaaaagaaggagagaagaagaaactcagaccgcgctggcttgacgctcggacgtactccgatcctctggccctgaaggagttcaaagagtttgccgctggcagaaagagcattgcgctcgacctggtgaccgaaatcgggcgcgtcccctctcatcttgcccacagaacacggaatgctctggataacctcgtgatgctgcatacctccgagcacggaggccgcgcctatagacacgccgtcgaggaactgcctgagacaatggaaaccctccttctgctgggcctcatgattctgcttacagggggagctatgctgttcctcatcagcggcaaagggatcggaaagacctccattggcctgatctgtgtgattgcctctagcgggatgctgtggatggcggagatccccctccaatggattgcctccgctatcgttcttgagtttttcatgatggtgctgctgattcctgaacccgagaagcagcggacaccgcaggacaatcaactcgcctacgtggtcatcggaatcctgacccttgctgccattatcgcggccaacgaaatgggcctgctcgagacaaccaaacgcgatctgggcatgagcaaggaacctggggttgtgtctcccacgtcctatctggacgtggatctccatcccgctagcgcctggacactttacgctgtcgccaccacagtgattacccctatgctgagacacaccatcgaaaattctacagctaacgttagcctggccgcgattgccaaccaggctgtggtcctcatgggactggacaaaggctggccgatctccaagatggaccttggggtgcccctgctcgccctgggatgctactctcaggtcaatcctctgacgctcaccgctgccgtgcttctgctgatcacacattatgccattatcggccccgggctccaggcgaaagctacccgggaggcccaaaagagaacagctgccggaattatgaagaaccctaccgttgatggcatcatgacgattgacctggatcccgtgatctacgacagcaaatttgaaaagcagcttggccaggtcatgctgctcgtgctgtgtgccgttcagctgctccttatgcgcacatcctgggctctgtgcgaggccctgaccctcgcgaccgggcctatcacaaccctgtgggaaggatctccgggcaaattctggaatacaacgattgccgtgagcatggctaacatctttcgggggtcctatcttgccggagctggcctggccttcagcattatgaagtctgtcgggaccggaaaaagaggcacaggctcccaaggggagaccctcggagaaaagtggaagaaaaagctgaatcagctgagccgcaaagattttgacctctacaagaaatccggcatcacagaggtggatcggaccgaggcgaaggaagggcttaaaagaggagagattacgcaccatgccgtgtctcggggcagcgctaagctgcagtggttcgttgaacgcaacatggtcatccccgaggggagagtgattgacctgggatgtggccggggcgggtggtcctattactgcgccggactcaagaaagtgaccgaagtccgcggctatacaaaagggggacctggccacgaggagcccgttcctatgtctacctacgggtggaatatcgtgaaactgatgagcggaaaggatgtgttttaccttcccccggaaaaatgtgacacactgctctgcgatatcggcgagtccagcccttctcccaccgtcgaagagtccagaacaattcgggtgctgaagatggttgagccctggctgaagaacaatcagttctgtatcaaagtgctcaacccttatatgcccaccgtcattgaacaccttgagcgcctgcaaagaaagcatggcgggatgctggtgcggaatcctctcagccgcaactctacgcacgaaatgtactggatctccaatggaacaggcaacattgttgctagcgtgaatatggtctctagactgcttctgaaccggttcaccatgacccatagacgcccgacaatcgagaaagacgtggatctcggggccggaacgcggcacgtgaacgctgaacccgagacccctaatatggacgtcatcggcgagagaattaagcgcatcaaagaagaacacaacagcacatggcattatgacgatgaaaatccctacaagacctgggcctatcacgggtcctacgaggttaaggcgacaggatctgccagctccatgattaacggcgtggtgaaactgctgaccaagccttgggacgtcgtgcccatggttacacagatggctatgaccgatacgaccccgtttggccagcaacgggtgttcaaagaaaaggtcgacacaagaacccctcgcagcatgcccgggacacggagagtgatgggaatcaccgccgagtggctctggcgcacgctgggccggaataaaaagcctagactttgcacacgcgaggaatttaccaagaaagttcggacaaacgctgccatgggggccgtgttcaccgaggaaaatcagtgggattccgcgaaggctgccgtcgaggacgaagatttttggaaactggtggacagagagcgcgagctccataagctgggaaaatgtggctcttgcgtttataacatgatggggaagagagagaagaaacttggcgagttcggaaaggccaaaggcagccgggctatttggtacatgtggctgggggcccgctacctcgaatttgaggctctgggattcctgaatgaggatcactggttttccagagaaaactcttatagcggcgtggagggggaaggactccataagctgggctacatccttcgggacatctccaaaattcccgggggcgccatgtatgcggatgacacggccggatgggacaccagaatcacagaggatgacctgcacaatgaagagaagattacccagcagatggatcctgagcaccggcaactcgctaacgccatcttcaaactgacataccagaataaggtcgtgaaggtccagcgccccaccccgacaggcaccgtgatggacattatctctagaaaagatcagcgggggagcggacaagttggcacgtatgggcttaacacatttaccaatatggaagctcagctgatccgccagatggagggagaaggcgtgctctccaaggccgacctggagaaccctcatctgcccgagaagaagattacccagtggctcgagacaaaaggggtcgagagactgaagcggatggcgatcagcggcgatgactgcgtggtgaagcccattgatgaccgcttcgccaacgcccttctggccctcaatgatatgggaaaagttagaaaggacatccctcaatggcagccgtctaaaggctggcacgattggcaacaggtgcccttttgttcccatcacttccacgaactgattatgaaggacgggcggaaacttgtcgtgccttgccgcccccaagacgagctgatcggacgggctcggattagccagggcgccgggtggtctctcaaggaaaccgcttgtctgggaaaggcctacgcgcagatgtggtccctgatgtatttccatcgcagagatctccggctggccagcaacgctatctgctctgccgttcctgtgcactgggtccccacatcccgcacgacctggagcatccatgcccaccatcaatggatgacaaccgaggacatgcttacagtgtggaatagagtctggattgaagataacccttggatggaggacaaaacccccgtgacgacctgggagaatgttccgtacctgggcaagcgggaagatcagtggtgtgggtccctcatcggcctgacaagcagagctacctgggcccagaacattcctacagcgatccagcaagtgcgctctcttattggaaatgaggaatttctggactacatgcccagcatgaaacggttcagaaaggaggaggaatccgagggcgctatctggtga

SEQ ID NO: 20538 - RNA, 9873 nt, synthetic construct
  misc_feature 1..9873: note = derived and/or modified CDS sequence (opt5) from DENV-3__GQ199861__SS-prME
  source 1..9873: mol_type = other RNA
accagcctgtgcctcatgatgatcctgcccgccgctcttgccttccacctgacgtcccgggacggcgaacctcggatgattgtggggaagaatgaacgcggaaagtctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacatatcagctctggacggccctgatctcccttacctgtagcaacacaattttcaccctgacagtggcgtggcgcaccgccacgctcatcctggctggcgtctccctgcttccgatgtgccaatctagctccatgcggaagacagactggctgcccatggccgttgctgccatgggggtgcctcccctccctctgtttatcttctctctcaaggataccctgaaaagacgcagctggccccttaatgagggagtgatggccgtcggcctggtgtccattctggcttctagcctcctgagaaacgacgttcctatggcggggccccttgtggccggaggcctgctcatcgcttgttacgtcattaccgggacatccgccgatctgaccgtggaaaaggccgctgacatcacatgggaggaagaggccgaacagacgggagttagccataacctcatgattaccgtggacgatgacggcacaatgcggatcaaagatgacgagaccgagaatatcctgacagtccttctgaagaccgcgctgctcattgtgtctggcatctttccgtattccattcctgctacgctgcttgtctggcacacctggcagaaacagacacaacgcagcggggtgctgtgggatgttccctctcctcccgaaacccagaaggccgagctcgaagagggagtgtacagaatcaaacagcagggcattttcgggaagacacaagtcggagtgggcgttcagaaggagggggtgtttcacaccatgtggcatgtcacacggggagccgtgctgacgtacaacggcaaacgcctcgaaccgaattgggctaacgtgaagaaagacctgatctcctatggcgggggatggagacttagcgcccagtggcaaaagggcgaggaagttcaggtcattgcggtggagcctgggaaaaatcccaagaacttccagaccatgcctggaacattccagaccaccacaggcgaaatcggggctatcgccctggattttaagcccggaacgtctggctcccccattatcaatcgggagggcaaagtggtcgggctgtacggaaacggcgtggttaccaagaatgggggatatgtgagcggcattgcccaaacaaacgctgagcctgacgggccgacccccgaactcgaggaagagatgttcaaaaagcgcaatctgacaatcatggatcttcaccctggctccggaaaaaccagaaagtacctgcccgccattgtccgggaagctatcaagcgcagactccggacgctgatcctcgcccctacaagagtggttgcggccgagatggaggaagctctgaaaggccttcccattcgctatcagaccaccgccacaaagagcgagcataccgggcgggaaatcgtggacctgatgtgccacgctacatttaccatgagactgctctctcctgtccgcgtgccgaactacaatctgattatcatggatgaggcccatttcacggaccccgccagcattgctgcgcggggatatatctccacaagagttggcatgggggaagccgctgccatctttatgaccgccacacctcccggaaccgctgatgccttccctcagtctaacgcgcccattcaggacgaggagcgcgacatcccggaacggagctggaactccggcaacgagtggattacggattttgctgggaaaaccgtgtggttcgtcccttctatcaaggccggcaacgacattgccaattgtcttcgcaaaaacggaaagaaggtgatccaactgagcagaaaaacatttgataccgaataccagaagacaaaactcaatgactgggatttcgtggtcaccacagacatttccgagatgggcgctaactttaaggccgatcgggttatcgaccccagacggtgcctgaaacccgtgatcctgaccgatgggcctgagcgcgtgattctcgcgggacccatgcctgtcacggccgcttctgccgctcagagacggggccgcgtggggagaaatccgcagaaggaaaacgaccaatacatcttcacaggacagccccttaataacgatgaggaccacgcccactggaccgaagctaagatgctgctggacaatattaacacccctgagggcatcattcccgccctcttcgaacctgagcgggagaaaagcgcggccatcgatggggaatatagactgaagggcgagtcccgcaaaacatttgttgaacttatgcggagaggagacctgcccgtgtggctcgctcataaggtcgccagcgagggcatcaaatacaccgatcgcaagtggtgcttcgacgggcagcggaataaccagattctggaagagaatatggatgtggagatctggacaaaagaaggagagaagaagaaactgagaccgcgctggctcgacgctcggacgtattctgatcctcttgccctgaaggaatttaaagagttcgccgctggcagaaagtccattgcgctggacctcgttaccgaaatcgggcgcgtgcccagccacctggcccatagaacacggaacgctcttgataatctggtcatgctccacacctctgagcacggaggccgcgcctacagacatgccgtggaggaactgcctgagacaatggaaaccctgctccttctgggcctgatgattctcctgacagggggagctatgctttttctgatctccggcaaagggatcggaaagaccagcattggcctcatctgtgtcattgcctcctctgggatgctgtggatggcggagatccccctgcaatggattgccagcgctatcgtgctcgagttctttatgatggttcttctgattcctgaacccgagaagcagcggacaccgcaggacaaccaactggcctatgtggtgatcggaatcctcaccctggctgccattatcgcggccaatgaaatgggccttctggagacaaccaaacgcgatctcggcatgtccaaggaacctggggtcgttagccccacgtcttacctggacgtggatctgcaccccgcttccgcctggacactctatgctgtggccaccacagtcattacccctatgcttagacataccatcgagaacagcacagctaacgtgtctctggccgcgattgccaatcaggctgttgtgctgatgggactcgacaaaggctggccgatcagcaagatggacctgggggtcccccttctggccctcggatgctactcccaggtgaaccctctgacgctgaccgctgccgtcctccttctgatcacacactacgccattatcggccccgggctgcaggcgaaagctacccgggaggcccaaaagagaacagctgccggaattatgaagaatcctaccgtggatggcatcatgacgattgacctcgatcccgttatctatgactctaaattcgaaaagcagctgggccaggtgatgcttctggtcctctgtgccgtgcagctgctgctcatgcgcacaagctgggctctttgcgaggccctgaccctggcgaccgggcctatcacaaccctctgggaaggatccccgggcaaattttggaacacaacgattgccgtttctatggctaatatcttccgggggagctacctggccggagctggccttgccttttccattatgaaaagcgtggggaccggaaaaagaggcacaggctctcaaggggagaccctgggagaaaagtggaagaaaaagctcaaccagctgtcccgcaaagatttcgacctgtataagaaaagcggcatcacagaggtcgatcggaccgaggcgaaggaagggctcaaaagaggagagattacgcatcacgccgtgtcccggggctctgctaaacttcagtggtttgtggaacgcaatatggttatccccgaggggagagtcattgacctgggatgtggccggggcgggtggagctactattgcgccggactgaagaaagtgaccgaagtgcgcggctacacaaaagggggacctggccacgaggagcccgtccctatgtccacctatgggtggaacatcgttaaactcatgtctggaaaggatgtgttctacctgcccccggaaaaatgtgacacacttctgtgcgatatcggcgagagctcccctagccccaccgtggaagagtctagaacaattcgggtcctcaagatggtggagccctggctgaagaataaccagttctgtatcaaagttctgaatccttacatgcccaccgtgattgaacatctcgagcgccttcaaagaaagcacggcgggatgctggtccggaaccctctgtcccgcaatagcacgcatgaaatgtattggatctctaacggaacaggcaatattgtggcttccgttaacatggtgagcagactcctgcttaaccggtttaccatgacccacagacgcccgacaatcgagaaagacgtcgatctgggggccggaacgcggcacgtgaatgctgaacccgagacccctaacatggacgtgatcggcgagagaattaagcgcatcaaagaagaacacaattctacatggcactacgacgatgaaaacccctataagacctgggcctaccatgggagctatgaggtcaaggcgacaggatccgcctctagcatgattaatggcgttgtgaaactcctgaccaagccttgggacgtggtccccatggtgacacagatggctatgaccgatacgaccccgttcggccagcaacgggtttttaaagaaaaggtggacacaagaacccctcgctccatgcccgggacacggagagtcatgggaatcaccgccgagtggctgtggcgcacgctcggccggaacaaaaagcctagactgtgcacacgcgaggagttcaccaagaaagtgcggacaaatgctgccatgggggccgtttttaccgaggaaaaccagtgggatagcgcgaaggctgccgtggaggacgaagatttctggaaacttgtcgacagagagcgcgagctgcacaagctcggaaaatgtggctcctgcgtgtacaatatgatggggaagagagagaagaagctgggcgagtttggaaaggccaaaggctctcgggctatttggtatatgtggcttggggcccgctacctggagttcgaggctctcggatttctgaacgaggatcattggttcagcagagaaaattcctactctggcgttgagggggaaggactgcacaagctcggctatatcctgcgggacatcagcaaaattcccgggggcgccatgtacgcggatgacacggccggatgggacaccagaatcacagaggatgaccttcacaacgaagagaagattacccagcagatggatcctgagcatcggcaactggctaatgccatctttaaactcacatatcagaacaaggtggtcaaggtgcagcgccccaccccgacaggcaccgtcatggacattatctccagaaaagatcagcgggggtctggacaagtgggcacgtacgggctgaatacattcaccaacatggaagctcagcttatccgccagatggagggagaaggcgttctgagcaaggccgacctcgagaaccctcatctgcccgagaagaagattacccagtggctggagacaaaaggggtggagagactcaagcggatggcgatctccggcgatgactgcgtcgtgaagcccattgatgaccgctttgccaatgctctgcttgccctgaacgatatgggaaaagtgagaaaggacatccctcaatggcagccgagcaaaggctggcatgattggcagcaggttcccttctgttctcaccacttccatgaactcattatgaaggacgggcggaaactggtggtcccttgccgcccccaagacgagcttatcggacgggctcggatttcccagggcgccgggtggagcctgaaggaaaccgcttgtctcggaaaggcctatgcgcagatgtggtctctgatgtactttcaccgcagagatctgcggctcgcctccaatgctatctgcagcgccgtgcctgttcattgggtgcccacatctcgcacgacctggtccatccacgcccatcaccaatggatgacaaccgaggacatgctgacagtctggaacagagtgtggattgaagataatccttggatggaggacaaaacccccgtcacgacctgggagaacgtgccgtatcttggcaagcgggaagatcagtggtgtgggagcctgatcggcctcacatccagagctacctgggcccagaatattcctacagcgatccagcaagttcgcagcctgattggaaacgaggagttccttgactacatgccctctatgaaacggtttagaaaggaggaggaaagcgagggcgctatctggtga

SEQ ID NO: 20539 - RNA, 9873 nt, synthetic construct
  misc_feature 1..9873: note = derived and/or modified CDS sequence (opt5) from DENV-3__GQ199862__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggctagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctgacatcacatgggaggaagaggccgaacagacgggagtgagccacaacctcatgattaccgtcgacgatgacggcacaatgcggatcaaagatgacgagaccgagaatatcctgacagtgcttctgaagaccgcgctgctcattgtctctggcatctttccgtactccattcctgctacgctgcttgtgtggcatacctggcagaaacagacacaacgcagcggggttctgtgggatgtgccctctcctcccgaaacccagaaggccgagctcgaagagggagtctacagaatcaaacagcagggcattctggggaagacacaagtgggagttggcgtgcagaaggagggggtcttccacaccatgtggcacgtgacacggggagccgtgctcacgtataacggcaaacgcctggaaccgaattgggcttccgttaagaaagaccttatcagctacggcgggggatggagactgtctgcccagtggcaaaagggcgaggaagtccaggtgattgcggtggagcctgggaaaaaccccaagaattttcagaccatgcctggaacattccagaccaccacaggcgaaatcggggctatcgccctggatttcaagcccggaacgtccggcagccccattatcaaccgggagggcaaagtcgtggggctctatggaaatggcgttgtgaccaagaacgggggatacgtctccggcattgcccaaacaaatgctgagcctgacgggccgacccccgaactggaggaagagatgtttaaaaagcgcaaccttacaatcatggatctgcatcctggcagcggaaaaaccagaaagtatctccccgccattgtgcgggaagctatcaagcgcagactgcggacgctcatcctggcccctacaagagttgtggcggccgagatggaggaagctcttaaaggcctgcccattcgctaccagaccaccgccacaaagtctgagcacaccgggcgggaaatcgtcgacctgatgtgccatgctacattcaccatgagactcctgagccctgtgcgcgttccgaattataaccttattatcatggatgaggcccactttacggaccccgcctccattgctgcgcggggatacatctctacaagagtgggcatgggggaagccgctgccatcttcatgaccgccacacctcccggaaccgctgatgcctttcctcagagcaatgcgcccattcaggacgaggagcgcgacatcccggaacggtcctggaactctggcaatgagtggattacggatttcgctgggaaaaccgtctggtttgtgcctagcatcaaggccggcaacgacattgccaactgtctgcgcaaaaatggaaagaaggtgatccaactctccagaaaaacattcgataccgaataccagaagacaaaactgaacgactgggattttgtcgttaccacagacatttctgagatgggcgctaatttcaaggccgatcgggtgatcgaccccagacggtgcctgaaacccgtgatcctcaccgatgggcctgagcgcgtcattcttgcgggacccatgcctgtgacggccgctagcgccgctcagagacggggccgcgttgggagaaacccgcagaaggaaaatgaccaatatatctttacaggacagcccctgaacaatgatgaggaccatgcccactggaccgaagctaagatgctgctcgacaacattaatacccctgagggcatcattcccgccctgttcgaacctgagcgggagaaatccgcggccatcgatggggaatacagacttaagggcgagagccgcaaaacattcgtggaactgatgcggagaggagacctccccgtctggctggctcacaaggtggcctctgagggcatcaaatataccgatcgcaagtggtgctttgacgggcagcggaacaatcagattctggaagagaacatggatgttgagatctggacaaaagaaggagagaagaagaaactcagaccgcgctggcttgacgctcggacgtactccgatcctctggccctgaaggagttcaaagagtttgccgctggcagaaagagcattgcgctcgacctggtgaccgaaatcgggcgcgtcccctctcatcttgcccacagaacacggaatgctctggataacctcgtgatgctgcatacctccgagcacggaggccgcgcctatagacacgccgtcgaggaactgcctgagacaatggaaaccctccttctgctgggcctcatgattctgcttacagggggagctatgctgttcctcatcagcggcaaagggatcggaaagacctccattggcctgatctgtgtgattgcctctagcgggatgctgtggatggcggagatccccctccaatggattgcctccgctatcgttcttgagtttttcatgatggtgctgctgattcctgaacccgagaagcagcggacaccgcaggacaatcaactcgcctacgtggtcatcggaatcctgacccttgctgccattatcgcggccaacgaaatgggcctgctcgagacaaccaaacgcgatctgggcatgagcaaggaacctggggttgtgtctcccacgtcctatctggacgtggatctccatcccgctagcgcctggacactttacgctgtcgccaccacagtgattacccctatgctgagacacaccatcgaaaattctacagctaacgttagcctggccgcgattgccaaccaggctgtggtcctcatgggactggacaaaggctggccgatctccaagatggaccttggggtgcccctgctcgccctgggatgctactctcaggtcaatcctctgacgctcaccgctgccgtgcttctgctgatcacacattatgccattatcggccccgggctccaggcgaaagctacccgggaggcccaaaagagaacagctgccggaattatgaagaaccctaccgttgatggcatcatgacgattgacctggatcccgtgatctacgacagcaaatttgaaaagcagcttggccaggtcatgctgctcgtgctgtgtgccgttcagctgctccttatgcgcacatcctgggctctgtgcgaggccctgaccctcgcgaccgggcctgtgacaaccctgtgggaaggatctccgggcaaattctggaatacaacgatcgccgtcagcatggctaacatttttcgggggtcctatcttgccggagctggcctggccttcagcatcatgaagtctgtggggaccggaaaaagaggcacaggctcccaaggggagaccctcggagaaaagtggaagaaaaagctgaatcagctgagccgcaaagattttgacctctacaagaaatccggcattacagaggtggatcggaccgaggcgaaggaagggcttaaaagaggagagatcacgcaccatgccgtttctcggggcagcgctaagctgcagtggttcgtcgaacgcaacatggtgattcccgaggggagagtgatcgacctgggatgtggccggggcgggtggtcctattactgcgccggactcaagaaagtcaccgaagttcgcggctatacaaaagggggacctggccacgaggagcccgtgcctatgtctacctacgggtggaatattgtgaaactgatgagcggaaaggatgtcttttaccttcccccggaaaaatgtgacacactgctctgcgatatcggcgagtccagcccttctcccaccgtggaagagtccagaacaatccgggttctgaagatggtggagccctggctgaagaacaatcagttctgtattaaagtcctcaacccttatatgcccaccgtgatcgaacaccttgagcgcctgcaaagaaagcatggcgggatgctggttcggaatcctctcagccgcaactctacgcacgaaatgtactggatttccaatggaacaggcaacatcgtggctagcgtcaatatggtgtctagactgcttctgaaccggttcaccatgacccatagacgcccgacaattgagaaagacgtggatctcggggccggaacgcggcacgtcaacgctgaacccgagacccctaatatggacgttatcggcgagagaatcaagcgcattaaagaagaacacaacagcacatggcattatgacgatgaaaatccctacaagacctgggcctatcacgggtcctacgaggtgaaggcgacaggatctgccagctccatgatcaacggcgtggtcaaactgctgaccaagccttgggacgtggttcccatggtgacacagatggctatgaccgatacgaccccgtttggccagcaacgggtcttcaaagaaaaggtggacacaagaacccctcgcagcatgcccgggacacggagagttatgggaattaccgccgagtggctctggcgcacgctgggccggaataaaaagcctagactttgcacacgcgaggaatttaccaagaaagtgcggacaaacgctgccatgggggccgtcttcaccgaggaaaatcagtgggattccgcgaaggctgccgtggaggacgaagatttttggaaactggttgacagagagcgcgagctccataagctgggaaaatgtggctcttgcgtgtataacatgatggggaagagagagaagaaacttggcgagttcggaaaggccaaaggcagccgggctatctggtacatgtggctgggggcccgctacctcgaatttgaggctctgggattcctgaatgaggatcactggttttccagagaaaactcttatagcggcgtcgagggggaaggactccataagctgggctacattcttcgggacatctccaaaatccccgggggcgccatgtatgcggatgacacggccggatgggacaccagaattacagaggatgacctgcacaatgaagagaagatcacccagcagatggatcctgagcaccggcaactcgctaacgccattttcaaactgacataccagaataaggtggtcaaggtgcagcgccccaccccgacaggcaccgttatggacatcatttctagaaaagatcagcgggggagcggacaagtgggcacgtatgggcttaacacatttaccaatatggaagctcagctgatccgccagatggagggagaaggcgtcctctccaaggccgacctggagaaccctcatctgcccgagaagaagatcacccagtggctcgagacaaaaggggtggagagactgaagcggatggcgattagcggcgatgactgcgtggttaagcccatcgatgaccgcttcgccaacgcccttctggccctcaatgatatgggaaaagtgagaaaggacattcctcaatggcagccgtctaaaggctggcacgattggcagcaggtccccttttgttcccatcacttccacgaactgatcatgaaggacgggcggaaacttgtggttccttgccgcccccaagacgagctgattggacgggctcggatcagccagggcgccgggtggtctctcaaggaaaccgcttgtctgggaaaggcctacgcgcagatgtggtccctgatgtatttccatcgcagagatctccggctggccagcaacgctatttgctctgccgtgcctgtccactgggtgcccacatcccgcacgacctggagcatccatgcccaccatcaatggatgacaaccgaggacatgcttacagtctggaatagagtgtggatcgaagataacccttggatggaggacaaaacccccgttacgacctgggagaatgtgccgtacctgggcaagcgggaagatcagtggtgtgggtccctcattggcctgacaagcagagctacctgggcccagaacatccctacagcgattcagcaagtccgctctcttatcggaaatgaggaatttctggactacatgcccagcatgaaacggttcagaaaggaggaggaatccgagggcgctatttggtga

SEQ ID NO: 20540 - RNA, 9873 nt, synthetic construct
  misc_feature 1..9873: note = derived and/or modified CDS sequence (opt5) from DENV-3__GQ199863__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggtgatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgttccctgtaaaattcctttcagcacagaggacggccaagggaaggctcataacggaagactgatcaccgccaatcccgtggtcacgaaaaaggaggaacccgtgaacattgaggcggaacctccgttcggcgagtccaatatcgtgattgggatcggcgataacgctctgaaaatcaattggtataagaagggatctagcattggcaaaatgtttgaagccacagccagaggggctagacgcatggccatccttggagacaccgcttgggatttcggctccgttgggggagtcctcaacagcctgggcaagatggtgcaccagatttttgggtctgcctacaccgcgctgttctccggcgtgagctgggtcatgaaaatcggaattggcgtgctcctgacatggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgacgaacgaggttcatacctggacagaacagtacaaatttcaagctgattcccccaagcggctggccaccgcgatcgccggcgcttgggagaatggagtgtgtggcattagaagcacaacccgcatggaaaaccttctctggaaacagatcgccaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagccgaaacccaaaactccagcttcattatcgatggacctaatacacccgagtgcccgtctgtgtccagagcctggaacgtgtgggaagtcgaggactatggctttggcgttttcaccacgaatatctggctcaaactgcgcgaagtgtacacacagctgtgtgaccaccggcttatgagcgctgcggtgaaggatgagagagccgtccacgctgacatggggtactggattgagtcccagaaaaacggatcttggaagctcgaaaaagccagcctgatcgaggtgaagacctgcacctggcctaagtcccatacactgtggtctaatggcgttctcgaaagcgatatgattatccccaaatccctggccgggcctattagccagcacaaccatcgccccggatatcacacccaaacggctggcccttggcaccttgggaagctggagctcgactttaattactgcgagggaacaaccgtggtcatcacagaaaactgtggcacccggggcccctctctgagaacaaccacggtgtccgggaaactgatccatgagtggtgctgtcgcagctgcacccttccgcctctccggtatatgggagaagatggctgttggtacgggatggagattagacccatctctgaaaaggaggagaatatggttaaatccctggtgagcgccggatctggcaaggtcgacaacttcacaatgggggtgctgtgcctcgcgattctgtttgaagaggttatgcggggaaagttcggcaaaaagcacatgatcgctggcgtgttctttaccttcgtccttctgctcagcgggcagattacatggcgcgatatggcccataccctgatcatgattggatccaatgccagcgacagaatgggcatgggggtgacgtatctggctcttatcgccacatttaaaatccagcccttcctggcgctcggatttttcctgcggaagctcacctctagagaaaacctgcttctgggcgtggggctcgctatggccacaaccctgcaactgcctgaggatattgaacagatggccaatggaatcgctcttggcctgatggccctcaaactgattacccagtttgagacataccagctctggacggctctgatctcccttacctgtagcaacacaattttcaccctgacagtcgcctggcgcaccgcgacgctcatcctggccggcgtttccctgcttccggtgtgccaatctagctccatgcggaagacagactggctgcccatggctgtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttatgttattaccgggacatccgctgatctgaccgtggaaaaggccgccgacatcacatgggaggaagaggctgaacagacgggagtcagccacaacctcatgattaccgtggacgatgacggcacaatgcggatcaaagatgacgagaccgagaatatcctgacagtccttctgaagaccgccctgctcattgtgtctggcatctttccgtactccattcctgcgacgctgcttgtttggcatacctggcagaaacagacacaacgcagcggggtgctgtgggatgtcccctctcctcccgaaacccagaaggctgagctcgaagagggagtgtacagaatcaaacagcagggcattttcgggaagacacaagttggagtgggcgtccagaaggagggggtgtttcacaccatgtggcacgtgacacggggagccgttctgacgtataacggcaaacgcctcgaaccgaattgggcctccgtcaagaaagacctgatcagctacggcgggggatggagactttctgctcagtggcaaaagggcgaggaagtccaggtgattgccgtcgagcctgggaaaaaccccaagaatttccagaccatgcctggaacattccagaccaccacaggcgaaatcggggcgatcgctctggattttaagcccggaacgtccggcagccccattatcaaccgggagggcaaagtggttgggctgtatggaaatggcgtggtcaccaagaacgggggatacgtgtccggcattgcccaaacaaatgccgagcctgacgggccgacccccgaactcgaggaagagatgttcaaaaagcgcaacctgacaatcatggatcttcatcctggcagcggaaaaaccagaaagtatctgcccgctattgttcgggaagccatcaagcgcagactccggacgctgatcctcgctcctacaagagtggtcgccgcggagatggaggaagccctgaaaggccttcccattcgctaccagaccaccgctacaaagtctgagcacaccgggcgggaaatcgtggacctgatgtgccatgccacatttaccatgagactgctcagccctgttcgcgtgccgaattataacctgattatcatggatgaggctcacttcacggaccccgcctccattgccgctcggggatacatctctacaagagtcggcatgggggaagcggccgctatctttatgaccgccacacctcccggaaccgccgatgctttccctcagagcaatgcccccattcaggacgaggagcgcgacatcccggaacggtcctggaactctggcaatgagtggattacggattttgcggggaaaaccgtgtggttcgtgcctagcatcaaggctggcaacgacattgccaactgtcttcgcaaaaatggaaagaaggtcatccaactgtccagaaaaacatttgataccgaataccagaagacaaaactcaacgactgggatttcgttgtgaccacagacatttctgagatgggcgccaattttaaggctgatcgggtgatcgaccccagacggtgcctgaaacccgtcatcctgaccgatgggcctgagcgcgtgattctcgccggacccatgcctgttacggcggccagcgctgcccagagacggggccgcgtggggagaaacccgcagaaggaaaatgaccaatatatcttcacaggacagccccttaacaatgatgaggaccatgctcactggaccgaagccaagatgctgctggacaacattaatacccctgagggcatcattcccgctctcttcgaacctgagcgggagaaatccgccgcgatcgatggggaatacagactgaagggcgagagccgcaaaacatttgtcgaacttatgcggagaggagacctgcccgtgtggctcgcccacaaggttgcttctgagggcatcaaatataccgatcgcaagtggtgcttcgacgggcagcggaacaatcagattctggaagagaacatggatgtggagatctggacaaaagaaggagagaagaagaaactgagaccgcgctggctcgacgcccggatttactccgatcctcttgctctgaaggaatttaaagagttcgccgccggcagaaagagcatcgctctggacctcgtcacggaaattgggcgcgtgccctctcatctggcgcacagaacccggaatgcccttgataacctggtcatgctccatacatccgagcacggaggccgcgcttatagacacgccgtggaggaactgcctgagaccatggaaacactgctccttctgggcctgatgatcctcctgaccgggggagccatgctttttctgatcagcggcaaagggattggaaagacgtccatcggcctcatttgtgttatcgcttctagcgggatgctgtggatggccgagattcccctgcaatggatcgcgtccgccattgtgctcgagttctttatgatggtgcttctgatccctgaacccgagaagcagcggaccccgcaggacaatcaactggcttacgtcgttatcggcattctcacactggccgctatcattgccgcgaacgaaatgggccttctggagaccacaaaacgcgatctcggcatgagcaaggaacctggggtggtgtctcccacctcctatctggacgtcgatctgcatcccgccagcgcttggacgctctacgccgtggctacaaccgttatcacacctatgcttagacacaccattgaaaattctaccgccaacgtgagcctggctgccatcgcgaaccaggccgtcgtgctgatgggactcgacaaaggctggccgatctccaagatggacctgggggtcccccttctggctctcggatgctactctcaggtgaatcctctgacactgacggccgctgttctccttctgattacccattatgccatcattggccccgggctgcaggccaaagcgacacgggaggctcaaaagagaaccgccgctggaatcatgaagaaccctacagtggatggcattatgaccatcgacctcgatcccgtcatctacgacagcaaattcgaaaagcagctgggccaggtgatgcttctggttctctgtgccgtgcagctgctgctcatgcgcacgtcctgggccctttgcgaggctctgacactggccaccgggcctattaccacactctgggaaggatctccgggcaaattttggaataccacaatcgcggtcagcatggccaacattttccgggggtcctatctggctggagccggccttgcttttagcatcatgaagtctgtggggacgggaaaaagaggcaccggctcccaaggggagacactgggagaaaagtggaagaaaaagctcaatcagctgagccgcaaagatttcgacctgtacaagaaatccggcattaccgaggtggatcggacagaggccaaggaagggctcaaaagaggagagatcacccaccatgcggtttctcggggcagcgccaaacttcagtggtttgtcgaacgcaacatggtgattcccgaggggagagtgatcgacctgggatgtggccggggcgggtggtcctattactgcgctggactgaagaaagtcacggaagttcgcggctataccaaagggggacctggccacgaggagcccgtgcctatgtctacatacgggtggaatatcgtgaaactcatgagcggaaaggatgtcttctacctgcccccggaaaaatgtgacacccttctgtgcgatattggcgagtccagcccttctcccacagtggaagagtccagaaccatccgggttctcaagatggtggagccctggctgaagaacaatcagttctgtattaaagtcctgaacccttatatgcccacagtgatcgaacacctcgagcgccttcaaagaaagcatggcgggatgctggttcggaatcctctgagccgcaactctacccacgaaatgtactggatttccaatggaacgggcaacatcgtggccagcgtcaatatggtgtctagactcctgcttaaccggtttacaatgacccatagacgcccgaccatcgagaaagacgtggatctgggggctggaacacggcacgtcaacgccgaacccgagacgcctaatatggacgttattggcgagagaatcaagcgcattaaagaagaacacaacagcacctggcattatgacgatgaaaatccctacaagacatgggcttatcacgggtcctacgaggtgaaggccaccggatctgcgagctccatgatcaacggcgtggtcaaactcctgacaaagccttgggacgtggttcccatggtgacccagatggccatgacagataccacgccgttcggccagcaacgggtctttaaagaaaaggtggacaccagaacacctcgcagcatgcccgggacccggagagttatgggaattacagctgagtggctgtggcgcaccctcggccggaataaaaagcctagactgtgcacgcgcgaggagttcacaaagaaagtgcggaccaacgccgctatgggggccgtctttacagaggaaaatcagtgggattccgccaaggcggctgtggaggacgaagatttctggaaacttgttgacagagagcgcgagctgcataagctcggaaaatgtggctcttgcgtgtataacatgatggggaagagagagaagaagctgggcgagtttggaaaggccaaaggcagccgggccatctggtacatgtggcttggggctcgctacctggagttcgaggccctcggatttctgaatgaggatcactggttctccagagaaaactcttatagcggcgtcgagggggaaggactgcataagctcggctacatcctgcgggacatttccaaaatccccgggggcgctatgtatgccgatgacaccgcgggatgggacacgagaattaccgaggatgaccttcacaatgaagagaagatcacacagcagatggatcctgagcaccggcaactggccaacgctatttttaaactcacctaccagaataaggtggtcaaggtgcagcgccccacaccgaccggcacagttatggacatcatctctagaaaagatcagcgggggagcggacaagtgggcacctatgggctgaacacgttcacaaatatggaagcccagcttattcgccagatggagggagaaggcgtcctgtccaaggctgacctcgagaaccctcatctgcccgagaagaagatcacccagtggctggagaccaaaggggtggagagactcaagcggatggccattagcggcgatgactgcgtggttaagcccatcgatgaccgctttgcgaacgccctgcttgctctgaatgatatgggaaaagtgagaaaggacattcctcaatggcagccgtctaaaggctggcacgattggcagcaggtccccttctgttcccatcacttccacgaactcatcatgaaggacgggcggaaactggtggttccttgccgcccccaagacgagcttattggacgggcccggatcagccagggcgctgggtggtctctgaaggaaacagcctgtctcggaaaggcttacgcccagatgtggtccctgatgtattttcatcgcagagatctgcggctcgcgagcaacgccatctgctctgctgtgcctgtccactgggtgcccacctcccgcacaacgtggagcattcatgcccaccatcaatggatgaccacagaggacatgctgaccgtctggaatagagtgtggatcgaagataacccttggatggaggacaaaacacccgttaccacgtgggagaatgtgccgtaccttggcaagcgggaagatcagtggtgtgggtccctgattggcctcaccagcagagccacatgggctcagaacatccctaccgccattcagcaagtccgctctctgatcggaaatgaggagttccttgactacatgcccagcatgaaacggtttagaaaggaggaggaatccgagggcgcgatctggtga

SEQ ID NO: 20541 - RNA, 9873 nt, synthetic construct
  misc_feature 1..9873: note = derived and/or modified CDS sequence (opt5) from DENV-3__GQ199864__SS-prME
  source 1..9873: mol_type = other RNA
accagcctgtgcctcatgatgatcctgcccgccgctcttgccttccacctgacgtcccgggacggagaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactgaacaccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaatcgggattttgtcgaagggctcagcggagctacctgggtggacgtggtcctggagcacggcgggtgcgttaccacaatggccaagaacaaacccacgctggatattgagctccagaagaccgaagctacacaactggccacccttcgcaaactgtgtatcgagggaaagattacaaatatcaccacggactccagatgccctacacagggcgaagcgaccctcccggaggaacaggatcagaactatgtgtgtaaacacacctacgtggaccggggctgggggaatggatgcggcctgttcgggaagggaagccttgtcacatgcgccaagtttcaatgtctggagcccattgagggcaaagtggttcagcatgaaaacctcaagtataccgtgatcatcacagtccacacgggggatcagcatcaggtgggaaatgagacccaaggcgttacagctgaaattacccctcaggcctctacaaccgaggctatcctgcccgaatacggcacgctggggctcgagtgctcccctcgcaccggactggacttcaacgagatgattcttctgacaatgaaaaataaggcctggatggtgcacagacagtggtttttcgacctccccctgccgtggaccagcggcgccacaaccgaaacgcctacatggaaccggaaagagcttctggtcacctttaagaatgctcacgcgaaaaagcaagaagtggtcgtgctcgggtctcaggagggagccatgcatacagctctgaccggcgccaccgaaatccagaactccgggggcacaagcattttcgccggacacctgaagtgtcgcctcaaaatggataagctggagcttaaaggcatgtcttatgctatgtgcacgaacacctttgttctgaagaaagaggtgtccgaaacacagcatgggaccatcctcatcaaggtcgagtacaagggagaagacgtgccctgtaaaattcctttcagcacagaggatggccaagggaaggcccacaatggaagactgatcaccgcgaaccccgttgtgacgaaaaaggaggaacccgtcaatattgaggctgaacctccgttcggcgagtccaacatcgtgattgggatcggcgacaatgccctgaaaatcaactggtacaagaagggatctagcattggcaaaatgtttgaagccacagctagaggggccagacgcatggctatccttggagataccgcctgggacttcggctccgtcgggggagttctcaatagcctgggcaagatggtccatcagatttttgggtctgcgtataccgccctgttctccggcgtgagctgggtgatgaaaatcggaattggcgtcctcctgacatggatcgggcttaactctaagaataccagcatgtccttttcttgcattgctatcggaatcattacactgtacctcggcgccgtggttcaggctgatatggggtgtgtgatcaactggaaaggaaaggagctgaagtgcggcagcgggattttcgtcacgaatgaggtgcacacctggacagaacagtataaatttcaagccgactcccccaagcggctggcgaccgccatcgctggcgcctgggagaacggagtttgtggcattagaagcacaacccgcatggaaaatcttctctggaaacagatcgctaacgagctgaattacatcctgtgggaaaacaacattaagctcacggtggtcgtgggggatatcattggagttctggagcagggcaaacggacccttacacctcagcccatggagctgaagtattcttggaaaacctgggggaaggccaagatcgtgacagccgaaacccaaaattccagcttcattatcgacggacctaacacacccgagtgcccgtctgtctccagagcttggaatgtgtgggaagtggaggattacggctttggcgtcttcaccacgaacatctggctcaaactgcgcgaagtttatacacagctgtgtgaccaccggcttatgagcgcggccgtgaaggacgagagagctgtgcatgccgatatggggtactggattgagtcccagaaaaatggatcttggaagctcgaaaaagccagcctgatcgaggtcaagacctgcacctggcctaagtcccacacactgtggtctaacggcgtgctcgaaagcgacatgattatccccaaatccctggctgggcctattagccagcataatcaccgccccggataccacacccaaacggccggcccttggcatcttgggaagctggagctcgattttaactattgcgagggaacaaccgttgtgatcacagaaaattgtggcacccggggcccctctctgagaacaaccacggtctccgggaaactgatccacgagtggtgctgtcgcagctgcacccttccgcctctccggtacatgggagaagacggctgttggtatgggatggagattagacccatctctgaaaaggaggagaacatggtgaaatccctggttagcgcgggatctggcaaggtggataatttcacaattggggtcctgtgcctcgctatcctgtttgaagaggtgatgcggggaaagttcggcaaaaagcatatgattgccggcgttttctttaccttcgtgcttctgctcagcgggcagatcacatggcgcgacatggcccacaccctgattatgatcggatccaacgctagcgatagaatgggcatgggggtcacgtacctggcccttatcgcgacatttaaaattcagcccttcctggctctcggatttttcctgcggaagctcacctctagagaaaatctgcttctgggcgtggggctcgccatggccacaaccctgcaactgcctgaggacatcgaacagatggctaacggaattgcccttggcctgatggctctcaaactgatcacccagtttgagacatatcagctctggacggccctgatttcccttacctgtagcaatacaatcttcaccctgacagtggcgtggcgcaccgccacgctcatcctggctggcgtctccctgcttccggtttgccaatctagctccatgcggaagacagattggctgcccatggccgtggctgccatgggggtgcctcccctccctctgtttattttctctctcaaggacaccctgaaaagacgcagctggccccttaacgagggagtcatggccgtgggcctggtttccatcctggcttctagcctcctgagaaacgatgtgcctatggcggggccccttgtcgccggaggcctgctcattgcttgttacgtgatcaccgggacatccgccgacctgaccgttgaaaaggccgctgatattacatgggaggaagaggccgaacagacgggagtgagccataatctcatgatcaccgtcgacgacgatggcacaatgcggatcaaagacgatgagaccgagaacattctgacagtgcttctgaagaccgcgctgctcatcgtctctggcatttttccgtattccatccctgctacgctgcttgtgtggcacacctggcagaaacagacacaacgcagcggggttctgtgggacgtgccctctcctcccgaaacccagaaggccgagctcgaagagggagtctacagaattaaacagcagggcatcttcgggaagacacaagtgggagttggcgtgcagaaggagggggtctttcacaccatgtggcatgtgacacggggagccgtgctgacgtacaatggcaaacgcctcgaaccgaactgggcttccgttaagaaagatctgattagctatggcgggggatggagactttctgcccagtggcaaaagggcgaggaagtccaggtgatcgcggtggagcctgggaaaaatcccaagaacttccagaccatgcctggaacattccagaccaccacaggcgaaatcggggctattgccctggactttaagcccggaacgtccggcagccccatcattaatcgggagggcaaagtcgtggggctgtacggaaacggcgttgtgaccaagaatgggggatatgtctccggcatcgcccaaacaaacgctgagcctgatgggccgacccccgaactcgaggaagagatgttcaaaaagcgcaatctgacaattatggaccttcaccctggcagcggaaaaaccagaaagtacctgcccgccatcgtgcgggaagctatcaagcgcagactccggacgctgattctcgcccctacaagagttgtggcggccgagatggaggaagctctgaaaggccttcccatccgctatcagaccaccgccacaaagtctgagcataccgggcgggaaattgtcgatctgatgtgccacgctacatttaccatgagactgctcagccctgtgcgcgttccgaactacaatctgatcattatggacgaggcccatttcacggatcccgcctccatcgctgcgcggggatatatctctacaagagtgggcatgggggaagccgctgccatttttatgaccgccacacctcccggaaccgctgacgccttccctcagagcaacgcgcccatccaggatgaggagcgcgacattccggaacggtcctggaactctggcaacgagtggatcacggactttgctgggaaaaccgtctggttcgtgcctagcattaaggccggcaacgatatcgccaattgtcttcgcaaaaacggaaagaaggtgattcaactgtccagaaaaacatttgacaccgaataccagaagacaaaactcaatgattgggacttcgtcgttaccacagatatctctgagatgggcgctaactttaaggccgaccgggtgatcgatcccagacggtgcctgaaacccgtgattctgaccgacgggcctgagcgcgtcatcctcgcgggacccatgcctgtgacggccgctagcgccgctcagagacggggccgcgttgggagaaatccgcagaaggaaaacgatcaatacattttcacaggacagccccttaataacgacgaggatcacgcccactggaccgaagctaagatgctgctggacaatatcaacacccctgagggcattatccccgccctcttcgaacctgagcgggagaaatccgcggccatcgacggggaatatagactgaagggcgagagccgcaaaacatttgtggaacttatgcggagaggagatctgcccgtctggctcgctcataaggtggcctctgagggcattaaatacaccgaccgcaagtggtgcttcgatgggcagcggaataaccagatcctggaagagaatatggacgttgagatttggacaaaagaaggagagaagaagaaactgagaccgcgctggctcgatgctcggacgtattccgaccctcttgccctgaaggaatttaaagagttcgccgctggcagaaagagcatcgcgctggatctcgtgaccgaaattgggcgcgtcccctctcacctggcccatagaacacggaacgctcttgacaatctggtgatgctccacacctccgagcacggaggccgcgcctacagacatgccgtcgaggaactgcctgagacaatggaaaccctgctccttctgggcctgatgatcctcctgacagggggagctatgctttttctgatcagcggcaaagggattggaaagacctccatcggcctcatttgtgtgatcgcctctagcgggatgctgtggatggcggagattcccctgcaatggatcgcctccgctattgttctcgagttctttatgatggtgcttctgatccctgaacccgagaagcagcggacaccgcaggataaccaactggcctatgtggtcatcggcattctcaccctggctgccatcattgcggccaatgaaatgggccttctggagacaaccaaacgcgacctcggcatgagcaaggaacctggggttgtgtctcccacgtcctacctggatgtggacctgcaccccgctagcgcctggacactctatgctgtcgccaccacagtgatcacccctatgcttagacataccattgagaactctacagctaacgttagcctggccgcgatcgccaatcaggctgtggtcctgatgggactcgataaaggctggccgatctccaagatggacctgggggtgccccttctggccctcggatgctactctcaggtcaaccctctgacgctgaccgctgccgtgctccttctgattacacactacgccatcattggccccgggctgcaggcgaaagctacccgggaggcccaaaagagaacagctgccggaatcatgaagaatcctaccgttgacggcattatgacgatcgatctcgaccccgtgatctatgatagcaaattcgaaaagcagctgggccaggtcatgcttctggtgctctgtgccgttcagctgctgctcatgcgcacatcctgggctctttgcgaggccctgaccctggcgaccgggcctattacaaccctctgggaaggatctccgggcaaattttggaacacaacgatcgccgtgagcatggctaatattttccgggggtcctacctggccggagctggccttgcctttagcatcatgaagtctgtcgggaccggaaaaagaggcacaggctcccaaggggagaccctgggagaaaagtggaagaaaaagctcaaccagctgagccgcaaagacttcgatctgtataagaaatccggcattacagaggtggaccggaccgaggcgaaggaagggctcaaaagaggagagatcacgcatcacgccgtgtctcggggcagcgctaaacttcagtggtttgttgaacgcaatatggtcattcccgaggggagagtgatcgatctgggatgtggccggggcgggtggtcctactattgcgccggactgaagaaagtgaccgaagtccgcggctacacaaaagggggacctggccacgaggagcccgttcctatgtctacctatgggtggaacatcgtgaaactcatgagcggaaaggacgtgttctacctgcccccggaaaaatgtgatacacttctgtgcgacattggcgagtccagcccttctcccaccgtcgaagagtccagaacaatccgggtgctcaagatggttgagccctggctgaagaataaccagttctgtattaaagtgctgaatccttacatgcccaccgtcatcgaacatctcgagcgccttcaaagaaagcacggcgggatgctggtgcggaaccctctgagccgcaattctacgcatgaaatgtattggatttccaacggaacaggcaatatcgttgctagcgtgaacatggtctctagactcctgcttaaccggtttaccatgacccacagacgcccgacaatcgagaaagatgtggacctgggggccggaacgcggcacgtgaatgctgaacccgagacccctaacatggatgtcattggcgagagaatcaagcgcattaaagaagaacacaatagcacatggcactacgacgacgaaaacccctataagacctgggcctaccatgggtcctatgaggttaaggcgacaggatctgccagctccatgatcaatggcgtggtgaaactcctgaccaagccttgggatgtcgtgcccatggttacacagatggctatgaccgacacgaccccgttcggccagcaacgggtgtttaaagaaaaggtcgatacaagaacccctcgcagcatgcccgggacacggagagtgatgggaattaccgccgagtggctgtggcgcacgctcggccggaacaaaaagcctagactgtgcacacgcgaggagttcaccaagaaagttcggacaaatgctgccatgggggccgtgtttaccgaggaaaaccagtgggactccgcgaaggctgccgtcgaggatgaagacttctggaaacttgtggatagagagcgcgagctgcacaagctcggaaaatgtggctcttgcgtttacaatatgatggggaagagagagaagaagctgggcgagtttggaaaggccaaaggcagccgggctatctggtatatgtggcttggggcccgctacctggagttcgaggctctcggatttctgaacgaggaccattggttctccagagaaaattcttacagcggcgtggagggggaaggactgcacaagctcggctatatcctgcgggatatttccaaaatccccgggggcgccatgtacgcggacgatacggccggatgggacaccagaattacagaggacgatcttcacaacgaagagaagatcacccagcagatggaccctgagcatcggcaactggctaatgccatttttaaactcacatatcagaacaaggtcgtgaaggtccagcgccccaccccgacaggcaccgtgatggatatcatctctagaaaagaccagcgggggagcggacaagttggcacgtacgggctgaatacattcaccaacatggaagctcagcttattcgccagatggagggagaaggcgtgctgtccaaggccgatctcgagaaccctcatctgcccgagaagaagatcacccagtggctggagacaaaaggggtcgagagactcaagcggatggcgattagcggcgacgattgcgtggtgaagcccatcgacgatcgctttgccaatgctctgcttgccctgaacgacatgggaaaagttagaaaggatattcctcaatggcagccgtctaaaggctggcatgactggcaacaggtgcccttctgttcccaccacttccatgaactcatcatgaaggatgggcggaaactggtcgtgccttgccgcccccaagacgagcttattggacgggctcggatcagccagggcgccgggtggtctctgaaggaaaccgcttgtctcggaaaggcctatgcgcagatgtggtccctgatgtactttcaccgcagagacctgcggctcgccagcaatgctatctgctctgccgttcctgtgcattgggtccccacatcccgcacgacctggagcattcacgcccatcaccaatggatgacaaccgaggatatgctgacagtgtggaacagagtctggatcgaagacaatccttggatggaggataaaacccccgtgacgacctgggagaacgttccgtatcttggcaagcgggaagaccagtggtgtgggtccctgattggcctcacaagcagagctacctgggcccagaatatccctacagcgattcagcaagtgcgctctctgatcggaaacgaggagttccttgattacatgcccagcatgaaacggtttagaaaggaggaggaatccgagggcgctatctggtga

SEQ ID NO: 20542 - RNA, 9873 nt, synthetic construct
  misc_feature 1..9873: note = derived and/or modified CDS sequence (opt5) from DENV-3__GQ199865__SS-prME
  source 1..9873: mol_type = other RNA
accagcctgtgcctcatgatgatcctgcccgccgctcttgccttccacctgacatcccgggacggagaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcggcggggttctcaacagcctggggaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacatatcagctctggacggccctgatctcccttacctgtagcaacacaattttcaccctgacagtggcgtggcgcaccgccacgctcatcctggctggcgtctccctgcttccgatgtgccaatctagctccatgcggaagacagactggctgcccatggccgttgctgccatgggggtgcctcccctccctctgtttatcttctctctcaaggataccctgaaaagacgcagctggccccttaatgagggagtgatggccgtcggcctggtgtccattctggcttctagcctcctgagaaacgacgttcctatggcggggccccttgtggccggaggcctgctcatcgcttgttacgtcattaccgggacatccgccgatctgaccgtggaaaaggccgctgacatcacatggggagaggaagccgagcagacgggcgttagccatatgctcatgattaccgtggaagacgatggcacaatgcggatcaaagacgatgagaccgagaacatcctgacagtccttctgaagaccgcgctgctcattgtgtctgggatctttccgtattccattcctgctacgctgcttgtctggcacacctggcagaaacagacacaacgcagcggagtgctgtgggacgttccctctcctcccgaaacccagaaggccgagctcgaagagggcgtgtacagaatcaaacagcaggggattttcggaaagacacaagtcggcgtgggggttcagaaggagggagtgtttcacaccatgtggcatgtcacacggggcgccgtgctgacgtacaatggcaaacgcctcgaaccgaactgggcttccgtgaagaaagatctgatcagctatgggggaggctggagactttctgcccagtggcaaaagggggaggaagttcaggtcattgcggtggagcctggcaagaatcccaagaacttccagaccatgcctggcacattccagaccaccacaggggaaatcggagctatcgccctggactttaagcccggcacgtccggcagccccattatcaatcgggaggggaaagtggtcggactgtacggcaacggggtggttaccaagaatggaggctatgtgtccgggattgcccaaacaaacgctgagcctgatggcccgacccccgaactcgaggaagagatgttcaaaaagcgcaatctgacaatcatggaccttcaccctggaagcggcaaaaccagaaagtacctgcccgccattgtccgggaagctatcaagcgcagactccggacgctgatcctcgcccctacaagagtggttgcggccgagatggaggaagctctgaaagggcttcccattcgctatcagaccaccgccacaaagtctgagcataccggacgggaaatcgtggatctgatgtgccacgctacatttaccatgagactgctcagccctgtccgcgtgccgaactacaatctgattatcatggacgaggcccatttcacggatcccgcctccattgctgcgcggggctatatctctacaagagttgggatgggagaagccgctgccatctttatgaccgccacacctcccggcaccgctgacgccttccctcagagcaacgcgcccattcaggatgaggagcgcgacatcccggaacggtcctggaactctgggaacgagtggattacggactttgctggcaaaaccgtgtggttcgtccctagcatcaaggccggaaatgatattgccaactgtcttcgcaaaaacggcaagaaggtgatccaactgtccagaaaaacatttgacaccgaataccagaagacaaaactcaatgattgggacttcgtggtcaccacagatatttctgagatgggggctaactttaaggccgaccgggttatcgatcccagacggtgcctgaaacccgtgatcctgaccgacggacctgagcgcgtgattctcgcgggccccatgcctgtcacggccgctagcgccgctcagagacgggggcgcgtgggaagaaatccgcagaaggaaaacgatcaatacatcttcacaggccagccccttaataacgacgaggatcacgcccactggaccgaagctaagatgctgctggacaatattaacacccctgaggggatcattcccgccctcttcgaacctgagcgggagaaatccgcggccatcgacggcgaatatagactgaagggagagagccgcaaaacatttgttgaacttatgcggagaggcgatctgcccgtgtggctcgctcataaggtcgcctctgaggggatcaaatacaccgaccgcaagtggtgcttcgatggacagcggaataaccagattctggaagagaatatggacgtggagatctggacaaaagaaggcgagaagaagaaactgagaccgcgctggctcgatgctcggacgtattccgaccctcttgccctgaaggaatttaaagagttcgccgctgggagaaagagcattgcgctggatctcgttaccgaaatcggacgcgtgccctctcacctggcccatagaacacggaacgctcttgacaatctggtcatgctccacacctccgagcacggcggccgcgcctacagacatgccgtggaggaactgcctgagacaatggaaaccctgctccttctggggctgatgattctcctgacgggaggcgctatgctttttctgatcagcgggaaaggaatcggcaagacctccattgggctcatctgtgtcattgcctctagcggaatgctgtggatggcggagatccccctgcaatggattgcctccgctatcgtgctcgagttctttatgatggttcttctgattcctgaacccgagaagcagcggacaccgcaggataaccaactggcctatgtggtgatcggcatcctcaccctggctgccattatcgcggccaatgaaatgggccttctggagacaaccaaacgcgacctcgggatgagcaaggaacctggagtcgtttctcccacgtcctacctggatgtggacctgcaccccgctagcgcctggacactctatgctgtggccaccacagtcattacccctatgcttagacataccatcgagaactctacagctaatgtgagcctggccgcgattgccaaccaggctgttgtgctgatgggcctcgataaagggtggccgatctccaagatggacctgggagtcccccttctggccctcggctgctactctcaggtgaaccctctgacgctgaccgctgccgtcctccttctgatcacacactacgccattatcgggcccggactgcaggcgaaagctacccgggaggcccaaaagagaacagctgccggcattatgaagaatcctaccgtggacggcatcatgacgattgatctcgaccccgttatctatgatagcaaattcgaaaagcagctgggacaggtgatgcttctggtcctctgtgccgtgcagctgctgctcatgcgcacatcctgggctctttgcgaggccctgaccctggcgaccggacctatcacaaccctctgggaaggctctccggggaaattttggaacacaacgattgccgttagcatggctaatatcttccggggatcctacctggccggcgctgggcttgcctttagcattatgaagtctgtgggaaccggcaaaagaggcacagggtcccaaggagagaccctgggcgaaaagtggaagaaaaagctcaaccagctgagccgcaaagacttcgatctgtataagaaatccgggatcacagaggtcgaccggaccgaggcgaaggaaggactcaaaagaggcgagattacgcatcacgccgtgtctcgggggagcgctaaacttcagtggtttgtggaacgcaatatggttatccccgagggaagagtcattgatctgggctgtggcagagggggatggtcctactattgcgccggcctgaagaaagtgaccgaagtgcgcgggtacacaaagggaggccctgggcacgaggagcccgtccctatgtctacctatggatggaacatcgttaaactcatgagcggcaaggacgtgttctacctgcccccggaaaaatgtgatacacttctgtgcgacatcggcgagtccagcccttctcccaccgtggaagagtccagaacaattcgggtcctcaagatggtggagccctggctgaagaataaccagttctgtatcaaagttctgaatccttacatgcccaccgtgattgaacatctcgagcgccttcaaagaaagcacgggggaatgctggtccggaaccctctgagccgcaattctacgcatgaaatgtattggatctccaacggcacagggaatattgtggctagcgttaacatggtgtctagactcctgcttaatcggtttaccatgacccacagacgcccgacaatcgagaaagatgtcgacctgggagccggcacgcggcacgtgaacgctgaacccgagacccctaacatggatgtgatcggggagagaattaagcgcatcaaagaagaacacaatagcacatggcactacgacgacgaaaacccctataagacctgggcctaccatggatcctatgaggtcaaggcgacaggctctgccagctccatgattaatggcgttgtgaaactcctgaccaagccttgggatgtggtccccatggtgacacagatggctatgaccgacacgaccccgttcgggcagcaacgggtttttaaagaaaaggtggatacaagaacccctcgcagcatgcccggaacacggagagtcatgggcatcaccgccgagtggctgtggcgcacgctcgggcggaacaaaaagcctagactgtgcacacgcgaggagttcaccaagaaagtgcggacaaatgctgccatgggagccgtttttaccgaggaaaaccagtgggactccgcgaaggctgccgtggaggatgaagacttctggaaacttgtcgatagagagcgcgagctgcacaagctcggcaaatgtgggtcttgcgtgtacaatatgatgggcaagagagagaaaaagctgggagagtttggcaaggccaaagggagccgggctatttggtatatgtggcttggagcccgctacctggagttcgaggctctcggctttctgaacgaggaccattggttctccagagaaaattcttacagcggggttgagggagaaggcctgcacaagctcgggtatatcctgcgggatatctccaaaattcccggcggagccatgtacgcggacgatacggccggctgggacaccagaatcacagaggacgatcttcacaacgaagagaagattacccagcagatggaccctgagcatcggcaactggctaatgccatctttaaactcacatatcagaacaaggtggtcaaggtgcagcgccccaccccgacagggaccgtcatggatattatctctagaaaagaccagcggggaagcggccaagtggggacgtacggactgaatacattcaccaacatggaagctcagcttatccgccagatggagggcgaaggggttctgtccaaggccgatctcgagaatcctcatctgcccgagaaaaagattacccagtggctggagacaaaaggcgtggagagactcaagcggatggcgatcagcggagacgattgcgtcgtgaagcccattgacgatcgctttgccaacgctctgcttgccctgaacgacatgggcaaagtgagaaaggatatccctcaatggcagccgtctaaagggtggcatgactggcagcaggttcccttctgttcccaccacttccatgaactcattatgaaggatggacggaaactggtggtcccttgccgcccccaagacgagcttatcggcagagctcggattagccagggggccggatggtctctgaaggaaaccgcttgtctcggcaaggcctatgcgcagatgtggtccctgatgtactttcaccgcagagacctgcggctcgccagcaatgctatctgctctgccgtgcctgttcattgggtgcccacatcccgcacgacctggagcatccacgcccatcaccaatggatgacaaccgaggatatgctgacagtctggaacagagtgtggattgaagacaatccttggatggaggataaaacccccgtcacgacctgggagaacgtgccgtatcttgggaagcgggaagaccagtggtgtggctccctgatcggactcacaagcagagctacctgggcccagaatattcctacagcgatccagcaagttcgctctctgattggcaacgaggagttccttgattacatgcccagcatgaaacggtttagaaaggaggaggaatccgagggggctatctggtga

SEQ ID NO: 20543 - RNA, 9873 nt, synthetic construct
  misc_feature 1..9873: note = derived and/or modified CDS sequence (opt5) from DENV-3__GQ199870__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattgcgctggacctcgtgaccgaaatcggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgattctcctgacgggaggcgctatgctttttctgatctccgggaaaggaatcggcaagaccagcattgggctcatctgtgtgattgcctcctctggaatgctgtggatggcggagatccccctgcaatggattgccagcgctatcgttctcgagttctttatgatggtgcttctgattcctgaacccgagaagcagcggacaccgcaggacaatcaactggcctacgtggtcatcggcatcctcaccctggctgccattatcgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgattacccctatgcttagacacaccatcgagaatagcacagctaacgtttctctggccgcgattgccaaccaggctgtggtcctgatgggcctcgacaaagggtggccgatcagcaagatggacctgggagtgccccttctggccctcggctgctactcccaggtcaatcctctgacgctgaccgctgccgtgctccttctgatcacacattatgccattatcgggcccggactgcaggcgaaagctacccgggaggcccaaaagagaacagctgccggcattatgaagaaccctaccgttgatggcatcatgacgattgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctatcacaaccctctgggaaggctccccggggaaattttggaatacaacgattgccgtgtctatggctaacatcttccggggaagctatctggccggcgctgggcttgccttttccattatgaaaagcgtcggaaccggcaaaagaggcacagggtctcaaggagagaccctgggcgaaaagtggaagaaaaagctcaatcagctgtcccgcaaagatttcgacctgtacaagaaaagcgggatcacagaggtggatcggaccgaggcgaaggaaggactcaaaagaggcgagattacgcaccatgccgtgtcccgggggtctgctaaacttcagtggtttgttgaacgcaacatggtcatccccgagggaagagtgattgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatatcggcgagagctcccctagccccaccgtcgaagagtctagaacaattcgggtgctcaagatggttgagccctggctgaagaacaatcagttctgtatcaaagtgctgaacccttatatgcccaccgtcattgaacacctcgagcgccttcaaagaaagcatgggggaatgctggtgcggaatcctctgtcccgcaacagcacgcacgaaatgtcttggatctccaatggcacagggaacattgttgctagcgtgaatatggtctctagactcctgcttaaccggagcaccatgacccatagacgcccgacaatcgagaaagacgtggatctgggagccggcccccggcacgtgaacgctgaccctgaaccccctaatatggacgtcatcggggagagaattaagcgcgttaaagaggaacacaactccacgtggcattacgatgacgagaatccctataagacctgggcctaccacggatcttatgaagtgaaggcgacaggcagcgcctccagcatgatcaacggcgtggtcaaactcctgaccaagccgtgggatgtggttcctatggtgccccagatggctatgacagacaccacaccttttgggcagcaacgggtcttcaaagagaaggtggataccagaacgccccgctccattcctggaacccggagagttatgggcatcacagccgaatggctgtggcgcaccctcgggcggaataaaaagcccagactgtgcacacgcgaggagtttaccaagaaagtgcggacgaacgctgccatgggagccgtcttcacagaagagaatcagtgggactctgcgaaggctgccgtggaagatgaggacttttggaaacttgttgatagagaacgcgagctgcataagctcggcaaatgtgggagctgcgtgtacaacatgatgggcaagagagagaaaaagctgggagagttcggcaaggccaaagggtcccgggctatttggtatatgtggcttggagcccgctacctggagtttgaagctctcggcttcctgaatgaggaccactggttttctagagagaacagctactccggggtcgaaggagagggcctgcataagctcgggtatatcctgcgggatatctctaaaattccgggcggagccatgtacgcggacgacaccgccggctgggatacaagaatcaccgaagacgatcttcacaatgaggaaaagattacgcagcagatggaccctgagcaccggcaactggctaacgccatcttcaaactcacctatcagaataaggtggtcaaggtgcagcgccccacacccaccgggacagttatggatattatcagcagaaaagaccagcggggatccggccaagtggggacctacggactgaacacatttaccaatatggaggctcagcttatccgccagatggaaggcgagggggtcctgagcaaggccgatctcgaaaaccctcatctgccggagaaaaagattacgcagtggctggaaacaaaaggcgtggagagactcaagcggatggcgatctctggagacgattgcgtggttaagcccattgacgatcgcttcgccaacgctctgcttgccctgaatgacatgggcaaagtgagaaaggatatccctcaatggcagccctccaaagggtggcacgactggcagcaggtccctttttgtagccatcacttccacgagctcattatgaaggacggacggaaactggtggttccctgccgccctcaagatgaacttatcggcagagctcggatttctcagggggccggatggtccctgaaggagaccgcttgtctcggcaaggcctatgcgcagatgtggagcctgatgtacttccatcgcagagacctgcggctcgcctctaacgctatctgctccgccgtgcccgtccactgggtgccgaccagccgcacaacctggtccatccatgcccaccatcaatggatgacaacggaagatatgctgaccgtctggaatagagtgtggattgaggacaacccttggatggaagataaaacacccgttaccacatgggagaatgtgccttatcttgggaagcgggaggaccagtggtgtggcagcctgatcggactcacctctagagctacgtgggcccagaacattcccaccgcgatccagcaagtccgcagcctgattggcaatgaagagtttcttgattacatgccgtccatgaaacggttcagaaaggaagaggagtctgaaggggctatctggtga

SEQ ID NO: 20544 - RNA, 9873 nt, synthetic construct
  misc_feature 1..9873: note = derived and/or modified CDS sequence (opt5) from DENV-3__JF937630__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacagacaggagtgagccacaacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacatataacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtatggaaatggcgttgtgacgaagaacgggggatacgtctccggcattgctcaaaccaatgccgagcctgacgggccgacacccgaactcgaggaagagatgttcaaaaagcgcaacctgaccatcatggatcttcatcctggcagcggaaaaacaagaaagtatctgcccgctattgtgcgggaagccatcaagcgcagactccggaccctgatcctcgcgcctacgagagttgtggccgctgagatggaggaagccctgaaaggccttcccattcgctaccagacaaccgctaccaagtctgagcacacagggcgggaaatcgtcgacctgatgtgccatgccacctttacaatgagactgctcagccctgtgcgcgttccgaattataacctgattatcatggatgaggcccacttcaccgaccccgcttccattgcggcccggggatacatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatatatcttcacgggacagccccttaacaatgatgaggaccatgctcactggacagaagccaagatgctgctggacaacattaatacccctgagggcatcattcccgccctcttcgaacctgagcgggagaaatccgccgctatcgatggggaatacagactgaagggcgagagccgcaaaacctttgtggaacttatgcggagaggagacctgcccgtctggctcgcccacaaggtggcttctgagggcatcaaatatacagatcgcaagtggtgcttcgacgggcagcggaacaatcagattctggaagagaacatggatgttgagatctggaccaaagaaggagagaagaagaaactgagaccgcgctggctcgacgcccggacatactccgatcctcttgccctgaaggaatttaaagagttcgctgcgggcagaaagagcattgccctggacctcgtgacggaaatcgggcgcgtcccctctcatctggctcacagaacccggaatgcccttgataacctggtgatgctccatacatccgagcacggaggccgcgcctatagacacgctgtcgaggaactgcctgagaccatggaaacactgctccttctgggcctgatgattctcctgaccgggggagccatgctttttctgatcagcggcaaagggatcggaaagacgtccattggcctcatctgtgtgattgcgtctagcgggatgctgtggatggccgagatccccctgcaatggattgcttccgccatcgttctcgagttctttatgatggtgcttctgattcctgaacccgagaagcagcggaccccgcaggacaatcaactggcttacgtggtcatcggaatcctcacactggccgcgattatcgccgctaacgaaatgggccttctggagaccacaaaacgcgatctcggcatgagcaaggaacctggggttgtgtctcccacctcctatctggacgtggatctgcatcccgccagcgcttggacgctctacgccgtcgctacaaccgtgattacacctatgcttagacacaccatcgaaaattctaccgccaacgttagcctggcggccattgctaaccaggccgtggtcctgatgggactcgacaaaggctggccgatctccaagatggacctgggggtgccccttctggctctcggatgctactctcaggtcaatcctctgacactgacggccgccgtgctccttctgatcacccattatgcgattatcggccccgggctgcaggctaaagccacacgggaggctcaaaagagaaccgccgccggaattatgaagaaccctacagttgatggcatcatgaccattgacctcgatcccgtgatctacgacagcaaattcgaaaagcagctgggccaggtcatgcttctggtgctctgtgctgttcagctgctgctcatgcgcacgtcctgggccctttgcgaggcgctgacactggccaccgggcctatcaccacactctgggaaggatctccgggcaaattttggaataccacaattgctgtgagcatggccaacatcttccgggggtcctatctggctggagccggccttgcgtttagcattatgaagtctgtcgggacgggaaaaagaggcaccggctcccaaggggagacactgggagaaaagtggaagaaaaagctcaatcagctgagccgcaaagatttcgacctgtacaagaaatccggcatcaccgaggtggatcggacagaggccaaggaagggctcaaaagaggagagattacccaccatgctgtgtctcggggcagcgccaaacttcagtggtttgttgaacgcaacatggtcatccccgaggggagagtgattgacctgggatgtggccggggcgggtggtcctattactgcgctggactgaagaaagtgacggaagtccgcggctataccaaagggggacctggccacgaggagcccgttcctatgtctacatacgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttatatgcccacagtcattgaacacctcgagcgccttcaaagaaagcatggcgggatgctggtgcggaatcctctgagccgcaactctacccacgaaatgtactggatctccaatggaacgggcaacattgttgccagcgtgaatatggtctctagactcctgcttaaccggtttacaatgacccatagacgcccgaccatcgagaaagacgtggatctgggggctggaacacggcacgtgaacgccgaacccgagacgcctaatatggacgtcatcggcgagagaattaagcgcatcaaagaagaacacaacagcacctggcattatgacgatgaaaatccctacaagacatgggcgtatcacgggtcctacgaggttaaggccaccggatctgctagctccatgattaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaatcacagctgagtggctgtggcgcaccctcggccggaataaaaagcctagactgtgcacgcgcgaggagttcacaaagaaagttcggaccaacgccgccatgggggcggtgtttacagaggaaaatcagtgggattccgctaaggccgccgtcgaggacgaagatttctggaaacttgtggacagagagcgcgagctgcataagctcggaaaatgtggctcttgcgtttataacatgatggggaagagagagaagaagctgggcgagtttggaaaggctaaaggcagccgggccatttggtacatgtggcttggggctcgctacctggagttcgaggccctcggatttctgaatgaggatcactggttctccagagaaaactcttatagcggcgtggagggggaaggactgcataagctcggctacatcctgcgggacatctccaaaattcccgggggcgcgatgtatgccgatgacaccgctggatgggacacgagaatcaccgaggatgaccttcacaatgaagagaagattacacagcagatggatcctgagcaccggcaactggccaacgctatctttaaactcacctaccagaataaggtcgtgaaggtccagcgccccacaccgaccggcacagtgatggacattatctctagaaaagatcagcgggggagcggacaagttggcacctatgggctgaacacgttcacaaatatggaagcccagcttatccgccagatggagggagaaggcgtgctgtccaaggcggacctcgagaaccctcatctgcccgagaagaagattacccagtggctggagaccaaaggggtcgagagactcaagcggatggccatcagcggcgatgactgcgtggtgaagcccattgatgaccgctttgctaacgccctgcttgctctgaatgatatgggaaaagttagaaaggacatccctcaatggcagccgtctaaaggctggcacgattggcaacaggtgcccttctgttcccatcacttccacgaactcattatgaaggacgggcggaaactggtcgtgccttgccgcccccaagacgagcttatcggacgggcgcggattagccagggcgctgggtggtctctgaaggaaacagcctgtctcggaaaggcgtacgcccagatgtggtccctgatgtattttcatcgcagagatctgcggctcgctagcaacgccatctgctctgccgttcctgtgcactgggtccccacctcccgcacaacgtggagcatccatgctcaccatcaatggatgaccacagaggacatgctgaccgtgtggaatagagtctggattgaagataacccttggatggaggacaaaacacccgtgaccacgtgggagaatgttccgtaccttggcaagcgggaagatcagtggtgtgggtccctgatcggcctcaccagcagagccacatgggcgcagaacattcctaccgctatccagcaagtgcgctctctgattggaaatgaggagttccttgactacatgcccagcatgaaacggtttagaaaggaggaggaatccgagggcgccatctggtga

SEQ ID NO: 20545 - RNA, 9873 nt, synthetic construct
  misc_feature 1..9873: note = derived and/or modified CDS sequence (opt5) from DENV-3__JN000936__SS-prME
  source 1..9873: mol_type = other RNA
accagcctgtgcctcatgatgattctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttgtgttcacctttgtccttctgctcagcgggcagattacatggcgcgatatggcccataccctgatcatgattggatccaatgctagcgacagaatgggcatgggggtgacgtatctggcccttatcgcgacattcaaaatccagccctttctggctctcggattctttctgcggaagctcacctctagagaaaacctgcttctgggcgtggggctcgccatggccacaaccctgcaactgcctgaggatattgaacagatggctaatggaatcgcccttggcctgatggctctcaaactgattacccagttcgagatctaccagctctggacagccctgatttcccttacgtgtagcaacaccatctttacactgaccgtcgcgtggcgcacagccaccctcatcctggctggcgtttccctgcttccgatgtgccaatctagctccatgcggaagacggactggctgcccatggccgtggctgccatgggggtgcctcccctccctctgttcatcttttctctcaaggatacactgaaaagacgcagctggccccttaatgagggagtcatggccgtgggcctggtttccatcctggcttctagcctcctgagaaacgacgtgcctatggcggggccccttgtcgccggaggcctgctcattgcttgttatgtgatcaccgggacctccgccgatctgacagttgaaaaggccgctgacattacctgggaggaagaggccgaacagacaggagtgagccacaacctcatgatcacggtcgacgatgacggcaccatgcggatcaaagatgacgagacagagaatattctgaccgtgcttctgaagacagcgctgctcatcgtctctggcattttcccgtactccatccctgctaccctgcttgtgtggcatacgtggcagaaacagacccaacgcagcggggttctgtgggatgtgccctctcctcccgaaacacagaaggccgagctcgaagagggagtctacagaattaaacagcagggcatctttgggaagacccaagtgggagttggcgtgcagaaggagggggtcttccacacaatgtggcacgtgacccggggagccgtgctgacatataacggcaaacgcctcgaaccgaattgggcttccgttaagaaagacctgattagctacggcgggggatggagactttctgcccagtggcaaaagggcgaggaagtccaggtgatcgcggtggagcctgggaaaaaccccaagaattttcagacgatgcctggaaccttccagacaaccaccggcgaaatcggggctattgccctggatttcaagcccggaacatccggcagccccatcattaaccgggagggcaaagtcgtggggctgtatggaaatggcgttgtgacgaagaacgggggatacgtctccggcatcgcccaaaccaatgctgagcctgacgggccgacacccgaactcgaggaagagatgtttaaaaagcgcaacctgaccattatggatcttcatcctggcagcggaaaaacaagaaagtatctgcccgccatcgtgcgggaagctatcaagcgcagactccggaccctgattctcgcccctacgagagttgtggcggccgagatggaggaagctctgaaaggccttcccatccgctaccagacaaccgccaccaagtctgagcacacagggcgggaaattgtcgacctgatgtgccatgctaccttcacaatgagactgctcagccctgtgcgcgttccgaattataacctgatcattatggatgaggcccactttaccgaccccgcctccatcgctgcgcggggatacatctctacgagagtgggcatgggggaagccgctgccattttcatgacagccacccctcccggaacagctgatgcctttcctcagagcaatgcgcccatccaggacgaggagcgcgacattccggaacggtcctggaactctggcaatgagtggatcaccgatttcgctgggaaaacggtctggtttgtgcctagcattaaggccggcaacgacatcgccaactgtcttcgcaaaaatggaaagaaggtgattcaactgtccagaaaaaccttcgatacagaataccagaagaccaaactcaacgactgggattttgtcgttacaaccgacatctctgagatgggcgctaatttcaaggccgatcgggtgatcgaccccagacggtgcctgaaacccgtgattctgacagatgggcctgagcgcgtcatcctcgcgggacccatgcctgtgaccgccgctagcgccgctcagagacggggccgcgttgggagaaacccgcagaaggaaaatgaccaatatatttttacgggacagccccttaacaatgatgaggaccatgcccactggacagaagctaagatgctgctggacaacatcaatacccctgagggcattatccccgccctcttcgaacctgagcgggagaaatccgcggccatcgatggggaatacagactgaagggcgagagccgcaaaaccttcgtggaacttatgcggagaggagacctgcccgtctggctcgctcacaaggtggcctctgagggcattaaatatacagatcgcaagtggtgctttgacgggcagcggaacaatcagatcctggaagagaacatggatgttgagatttggaccaaagaaggagagaagaagaaactgagaccgcgctggctcgacgctcggacatactccgatcctcttgccctgaaggagttcaaagagtttgccgctggcagaaagagcatcgcgctggacctcgtgacggaaattgggcgcgtcccctctcatctggcccacagaacccggaatgctcttgataacctggtgatgctccatacatccgagcacggaggccgcgcctatagacacgccgtcgaggaactgcctgagaccatggaaacactgctccttctgggcctgatgatcctcctgaccgggggagctatgcttttcctgatcagcggcaaagggattggaaagacgtccatcggcctcatttgtgtgatcacctctagcgggatgctgtggatggccgagattcccctgcaatggatcgcgtccgccattgttctcgagtttttcatgatggtgcttctgatccctgaacccgagaagcagcggacaccgcaggacaatcaactggcttacgtggtcatcggcattctcaccctggccgctatcattgccgcgaacgaaatgggccttctggagacaaccaaacgcgatctcggcatgagcaaggaacctggggttgtgtctcccacgtcctatctggacgtggatctgcatcccgccagcgcttggacactctacgccgtcgctaccacagtgatcacccctatgcttagacacaccattgaaaattctacagccaacgttagcctggctgccatcgcgaaccaggccgtggtcctgatgggactcgacaaaggctggccgatctccaagatggacctgggggtgccccttctggctctcggatgctactctcaggtcaatcctctgacgctgaccgccgctgtgctccttctgattacacattatgccatcattggccccgggctgcaggccaaagcgacccgggaggctcaaaagagaacagccgctggaatcatgaagaaccctaccgttgatggcattatgacgatcgacctcgatcccgtgatctacgacagcaaatttgaaaagcagctgggccaggtcatgcttctggtgctctgtgccgttcagctgctgctcatgcgcacatcctgggccctttgcgaggctctgaccctggccaccgggcctattacaaccctctgggaaggatctccgggcaaattctggaatacaacgatcgcggtgagcatggccaacatttttcgggggtcctatctggctggagccggccttgctttcagcatcatgaagtctgtcgggaccggaaaaagaggcacaggctcccaaggggagaccctgggagaaaagtggaagaaaaagctcaatcagctgagccgcaaagattttgacctgtacaagaaatccggcattacagaggtggatcggaccgaggccaaggaagggctcaaaagaggagagatcacgcaccatgcggtgtctcggggcagcgccaaacttcagtggttcgttgaacgcaacatggtcattcccgaggggagagtgatcgacctgggatgtggccggggcgggtggtcctattactgcgctggactgaagaaagtgaccgaagtccgcggctatacaaaagggggacctggccacgaggagcccgttcctatgtctacctacgggtggaatatcgtgaaactcatgagcggaaaggatgtgttttacctgcccccggaaaaatgtgacacacttctgtgcgatattggcgagtccagcccttctcccaccgtcgaagagtccagaacaatccgggtgctcaagatggttgagccctggctgaagaacaatcagttctgtattaaagtgctgaacccttatatgcccaccgtcatcgaacacctcgagcgccttcaaagaaagcatggcgggatgctggtgcggaatcctctgagccgcaactctacgcacgaaatgtactggatttccaatggaacaggcaacatcgttgccagcgtgaatatggtctctagactcctgcttaaccggttcaccatgacccatagacgcccgacaatcgagaaagacgtggatctgggggctggaacgcggcacgtgaacgccgaacccgagacccctaatatggacgtcattggcgagagaatcaagcgcattaaagaagaacacaacagcacatggcattatgacgatgaaaatccctacaagacctgggcttatcacgggtcctacgaggttaaggccacaggatctgcgagctccatgatcaacggcgtggtgaaactcctgaccaagccttgggacgtcgtgcccatggttacacagatggccatgaccgatacgaccccgtttggccagcaacgggtgttcaaagaaaaggtcgacacaagaacccctcgcagcatgcccgggacacggagagtgatgggaattaccgctgagtggctgtggcgcacgctcggccggaataaaaagcctagactgtgcacacgcgaggaatttaccaagaaagttcggacaaacgccgctatgggggccgtgttcaccgaggaaaatcagtgggattccgccaaggcggctgtcgaggacgaagatttttggaaacttgtggacagagagcgcgagctgcataagctcggaaaatgtggctcttgcgtttataacatgatggggaagagagagaagaagctgggcgagttcggaaaggccaaaggcagccgggccatctggtacatgtggcttggggctcgctacctggaatttgaggccctcggattcctgaatgaggatcactggttttccagagaaaactcttatagcggcgtggagggggaaggactgcataagctcggctacatcctgcgggacatttccaaaatccccgggggcgctatgtatgccgatgacacggcgggatgggacaccagaattacagaggatgaccttcacaatgaagagaagatcacccagcagatggatcctgagcaccggcaactggccaacgctattttcaaactcacataccagaataaggtcgtgaaggtccagcgccccaccccgacaggcaccgtgatggacatcatctctagaaaagatcagcgggggagcggacaagttggcacgtatgggctgaacacatttaccaatatggaagcccagcttattcgccagatggagggagaaggcgtgctgtccaaggctgacctcgagaaccctcatctgcccgagaagaagatcacccagtggctggagacaaaaggggtcgagagactcaagcggatggccattagcggcgatgactgcgtggtgaagcccatcgatgaccgcttcgcgaacgccctgcttgctctgaatgatatgggaaaagttagaaaggacattcctcaatggcagccgtctaaaggctggcacgattggcaacaggtgcccttttgttcccatcacttccacgaactcatcatgaaggacgggcggaaactggtcgtgccttgccgcccccaagacgagcttattggacgggcccggatcagccagggcgctgggtggtctctgaaggaaaccgcctgtctcggaaaggcttacgcccagatgtggtccctgatgtatttccatcgcagagatctgcggctcgcgagcaacgccatctgctctgctgttcctgtgcactgggtccccacatcccgcacgacctggagcattcatgcccaccatcaatggatgacaaccgacgatatgctgacagtgtggaatagagtctggatcgaggacaacccttggatggaagataaaacccccgtgacgacctgggagaatgttccgtaccttggcaagcgggaggaccagtggtgtgggtccctgattggcctcacaagcagagccacctgggctcagaacatccctacagccattcagcaagtgcgctctctgatcggaaatgaagagtttcttgattacatgcccagcatgaaacggttcagaaaggaagaggagtccgaaggcgcgatctggtga

SEQ ID NO: 20546 - RNA, 9873 nt, synthetic construct
  misc_feature 1..9873: note = derived and/or modified CDS sequence (opt5) from DENV-3__HQ541796__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatacagtgatcgggattggcgataacgccctgaaaatcaattggtataagaagggatctagcatcggcaaaatgtttgaagccaccgctagaggggccagacgcatggctattcttggagacaccgcctgggatttcggctccgtcgggggagttctcaacagcctgggcaagatggtccaccagatctttgggtctgcgtacacagccctgttctccggcgtgagctgggtgatgaaaattggaatcggcgtcctcctgacctggattgggcttaattctaagaacacaagcatgtccttttcttgcatcgctattggaatcatcacgctgtatctcggcgccgtggttcaggctgacatggggtgtgtgattaattggaaaggaaaggagctgaagtgcggcagcgggatcttcgtcaccaacgaggtgcatacatggaccgaacagtacaaatttcaagccgattcccccaagcggctggcgacagccattgctggcgcctgggagaatggagtttgtggcatcagaagcaccacgcgcatggaaaaccttctctggaaacagattgctaatgagctgaactatatcctgtgggaaaataacatcaagctcaccgtggtcgtgggggacattatcggagttctggagcagggcaaacggacacttacccctcagcccatggagctgaagtactcttggaaaacatgggggaaggccaagattgtgaccgccgaaacacaaaactccagcttcatcattgatggacctaatacccccgagtgcccgtctgtctccagagcttggaacgtgtgggaagtggaggactatggctttggcgtcttcacgacaaatatctggctcaaactgcgcgaagtttacacccagctgtgtgaccaccggcttatgagcgcggccgtgaaggatgagagagctgtgcacgccgacatggggtactggatcgagtcccagaaaaacggatcttggaagctcgaaaaagccagcctgattgaggtcaagacctgcacatggcctaagtcccataccctgtggtctaatggcgtgctcgaaagcgatatgatcattcccaaatccctggctgggcctatcagccagcacaaccatcgccccggatatcacacgcaaacagccggcccttggcaccttgggaagctggagctcgactttaattactgcgagggaaccacagttgtgattaccgaaaactgtggcacacggggcccctctctgagaaccacgaccgtctccgggaaactgatccatgagtggtgctgtcgcagctgcacacttccgcctctccggtatatgggagaagatggctgttggtacgggatggagatcagacccatttctgaaaaggaggagaatatggtgaaatccctggttagcgcgggatctggcaaggtggacaacttcaccatgggggtcctgtgcctcgctatcctgtttgaagaggtgatgcggggaaagttcggcaaaaagcacatgattgccggcgttttctttacattcgtgcttctgctcagcgggcagatcacctggcgcgatatggcccatacgctgattatgatcggatccaatgctagcgacagaatgggcatgggggtcacatatctggcccttattgcgacctttaaaatccagcccttcctggctctcggatttttcctgcggaagctcacatctagagaaaacctgcttctgggcgtggggctcgccatggccaccaccctgcaactgcctgaggatatcgaacagatggctaatggaattgcccttggcctgatggctctcaaactgatcacacagtttgagacgtaccagctctggaccgccctgatttcccttacatgtagcaacaccatcttcacactgaccgtggcgtggcgcacggccacactcattctggctggcgtctccctgcttccggtttgccaatctagctccatgcggaagaccgactggctgcccatggccgtggctgccatgggggtgcctcccctccctctgtttatcttcggactcaaggataccctgaaaagacgctcttggccccttaatgagggcgtcatggccgtggggctggttagcatcctggcttcctctctcctgagaaacgacgtgcctatggcgggaccccttgtcgccggcgggctgctcattgcttgttatgtgatcacaggaaccagcgccgatctgacagttgaaaaggccgctgacattacgtgggaggaagaggccgaacagaccggcgtgtcccacaacctcatgatcacagtcgacgatgacggcaccatgcggattaaagatgacgagacagagaatatcctgaccgtgcttctgaagacggcgctgctcatcgtcagcgggatttttccgtactctatccctgctaccctgcttgtgtggcatacatggcagaaacagacccaacgctccggagttctgtgggatgtgcccagccctcccgaaacacagaaggccgagctcgaagagggcgtctacagaattaaacagcaggggatcttcggaaagacccaagtgggcgttggggtgcagaaggagggagtctttcacacaatgtggcacgtgacgcggggcgccgtgctgacctataacggcaaacgcctcgaaccgaattgggcttctgttaagaaagacctgatttcctacgggggaggctggagacttagcgcccagtggcaaaagggggaggaagtccaggtgatcgcggtggagcctggcaagaaccccaagaatttccagacaatgcctggcaccttccagaccacaacgggggaaattggagctatcgccctggattttaagcccggcacctctggctcccccatcattaaccgggaggggaaagtcgtgggactgtatggcaatggggttgtgacaaagaacggaggctacgtcagcgggatcgcccaaaccaatgctgagcctgacggcccgacacccgaactcgaggaagagatgttcaaaaagcgcaacctgaccattatggatcttcatcctggatccggcaaaacgagaaagtatctgcccgccatcgtgcgggaagctattaagcgcagactccggacactgatcctcgcccctaccagagttgtggcggccgagatggaggaagctctgaaagggcttcccatccgctaccagaccacagccaccaagagcgagcacacaggacgggaaattgtcgacctgatgtgccatgctacctttacgatgagactgctctctcctgtgcgcgttccgaattataacctgatcattatggatgaggcccacttcacagaccccgccagcatcgctgcgcggggctacatttccaccagagtggggatgggagaagccgctgccatctttatgacagccacccctcccggcacggctgatgccttccctcagtctaatgcgcccatccaggacgaggagcgcgacattccggaacggagctggaactccgggaatgagtggatcaccgattttgctggcaaaacagtctggttcgtgccttctattaaggccggaaacgacatcgccaactgtcttcgcaaaaatggcaagaaggtgattcaactgagcagaaaaacctttgatacagaataccagaagaccaaactcaacgactgggatttcgtcgttacaaccgacatctccgagatgggggctaattttaaggccgatcgggtgattgaccccagacggtgcctgaaacccgtgatcctgacggatggacctgagcgcgtcatcctcgcgggccccatgcctgtgacagccgcttctgccgctcagagacgggggcgcgttggaagaaacccgcagaaggaaaatgaccaatatattttcaccggccagccccttaacaatgatgaggaccatgcccactggaccgaagctaagatgctgctggacaacatcaatacacctgaggggattatccccgccctcttcgaacctgagcgggagaaaagcgcggccattgatggcgaatacagactgaagggagagtcccgcaaaacctttgtggaacttatgcggagaggcgacctgacagtctggctcgctcacaaggtggccagcgaggggatcaaatatacggatcgcaagtggtgcttcgacggacagcggaacaatcagatcctggaagagaacatggatgttgagatttggaccaaagaaggcgagaagaagaaactgagaccccgctggctcgacgctcggacatactctgatccgcttgccctgaaggaatttaaagagttcgccgctgggagaaagtccatcgcgctggacctcgtgaccgaaattggacgcgtccctagccatctggcccacagaacacggaatgctcttgataacctggtgatgctccatacctctgagcacggcggccgcgcctatagacacgccgtcgaggaactgcccgagacgatggaaaccctgctccttctggggctgatgatcctcctgacaggaggcgctatgctttttctgatttccgggaaaggaatcggcaagaccagcatcgggctcatttgtgtgatcgcctcctctggaatgctgtggatggcggagattcctctgcaatggatcgccagcgctattgttctcgagttctttatgatggtgcttctgatccccgaacctgagaagcagcggacaccccaggacaatcaactggcctacgtggtcattggcatcctcaccctggctgccatcattgcggccaacgaaatgggccttctggagacgacaaaacgcgatctcgggatgtccaaggaaccgggagttgtgagccctacctcttatctggacgtggatctgcatcccgcttccgcctggacactctacgctgtcgccaccaccgtgatcacacccatgcttagacacacgattgagaatagcaccgctaacgtttctctggccgcgatcgccaaccaggctgtggtcctgatgggcctcgacaaagggtggcctattagcaagatggacctgggagtgccgcttctggccctcggctgctactcccaggtcaatcccctgacactgaccgctgccgtgctccttctgatcacacattatgccatcattgggcctggactgcaggcgaaagctacccgggaggcccaaaagagaacggctgccggcatcatgaagaaccccacagttgatggcattatgaccatcgacctcgatcctgtgatttacgactctaaattcgaaaagcagctggggcaggtcatgcttctggtgctctgtgccgttcagctgctgctcatgcgcaccagctgggctctttgcgaggccctgacactggcgaccggacccatcacaacgctctgggaaggctcccctgggaaattttggaataccacaatcgccgtgtctatggctaacattttccggggaagctatctggccggcgctgggcttgccttttccatcatgaaaagcgtcggaaccggcaaaagaggcacagggtctcaaggagagaccctgggcgaaaagtggaagaaaaagctcaatcagctgtcccgcaaagatttcgacctgtacaagaaaagcgggattacggaggtggatcggaccgaggcgaaggaaggactcaaaagaggcgagatcacacaccatgccgtgtcccgggggtctgctaaacttcagtggtttgttgaacgcaacatggtcattccggagggaagagtgatcgacctgggctgtggcagagggggatggagctattactgcgccggcctgaagaaagtgaccgaagtccgcgggtatacaaagggaggccccgggcacgaggagcctgttcccatgtccacctacggatggaatattgtgaaactcatgtctggcaaggatgtgttctacctgcctcccgaaaaatgtgacacacttctgtgcgatatcggcgagagctccccgagccctaccgtcgaagagtctagaacgatccgggtgctcaagatggttgagccctggctgaagaacaatcagttctgtattaaagtgctgaacccctatatgcctacagtcatcgaacacctcgagcgccttcaaagaaagcatgggggaatgctggtgcggaatcccctgtcccgcaacagcacccacgaaatgtactggatttctaatggcaccgggaacatcgttgcttccgtgaatatggtcagcagactcctgcttaaccggtttacaatgacgcatagacgccctaccattgagaaagacgtggatctgggagccggcacacggcacgtgaacgctgaaccggagacccccaatatggacgtcatcggggagagaatcaagcgcattaaagaagaacacaactctacatggcattatgacgatgaaaatccttacaagacctgggcctatcacggaagctacgaggttaaggcgacaggctccgcctctagcatgatcaacggcgtggtgaaactcctgaccaagccctgggacgtcgtgcctatggttacgcagatggctatgaccgatacaacccccttcgggcagcaacgggtgtttaaagaaaaggtcgacacaagaaccccgcgctccatgcctggaacgcggagagtgatgggcattacagccgagtggctgtggcgcaccctcgggcggaataaaaagcccagactgtgcacacgcgaggagttcaccaagaaagttcggacgaacgctgccatgggagccgtgtttaccgaggaaaatcagtgggatagcgcgaaggctgccgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggctatctggtacatgtggcttggagcccgctacctggagttcgaggctctcggctttctgaatgaggatcactggttcagcagagaaaactcctattctggggtggagggagaaggcctgcataagctcgggtacattctgcgggacatcagcaaaatccctggcggagccatgtatgcggatgacacagccggctgggacaccagaattacagaggatgaccttcacaatgaagagaagatcacccagcagatggatcccgagcaccggcaactggctaacgccatttttaaactcacataccagaataaggtcgtgaaggtccagcgccctacccccacggggacagtgatggacatcatttccagaaaagatcagcggggatctggccaagttgggacctatggactgaacaccttcacaaatatggaagctcagcttatccgccagatggagggcgaaggggtgctgagcaaggccgacctcgagaacccgcatctgcctgagaaaaagatcacccagtggctggagacaaaaggcgtcgagagactcaagcggatggcgatttccggagatgactgcgtggtgaagcccatcgatgaccgctttgccaacgctctgcttgccctgaatgatatgggcaaagttagaaaggacattccccaatggcagcctagcaaagggtggcacgattggcaacaggtgccgttctgttctcatcacttccacgaactcatcatgaaggacggacggaaactggtcgtgccctgccgccctcaagacgagcttattggcagagctcggatctcccagggggccggatggagcctgaaggaaacggcttgtctcggcaaggcctacgcgcagatgtggtctctgatgtattttcatcgcagagatctgcggctcgcctccaacgctatttgcagcgccgttcccgtgcactgggtccctacctctcgcacaacctggtccatccatgcccaccatcaatggatgacaaccgaggacatgctgacggtgtggaatagagtctggatcgaagataacccctggatggaggacaaaacccctgtgacaacctgggagaatgttccctaccttgggaagcgggaagatcagtggtgtggcagcctgattggactcacatccagagctacctgggcccagaacatcccgacggcgattcagcaagtgcgcagcctgatcggcaatgaggagttccttgactacatgccttctatgaaacggtttagaaaggaggaggaaagcgagggggctatttggtga

SEQ ID NO: 20547 - RNA, 9873 nt, synthetic construct
  misc_feature 1..9873: note = derived and/or modified CDS sequence (opt5) from DENV-3__HQ166034__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggactggctgcccatggccgttgctgccatgggggtgcctcccctccctctgtttattttctctctcaaggatacactgaaaagacgcagctggccccttaatgagggagtgatggccgtcggcctggtgtccatcctggcttctagcctcctgagaaacgacgttcctatggcggggccccttgtggccggaggcctgctcattgcttgttacgtcatcaccgggacctccgccgatctgacagtggaaaaggccgctgacattacctgggaggaagaggccgaacagacaggagttagccataacctcatgatcacggtggacgatgacggcaccatgcggatcaaagatgacgagacagagaatattctgaccgtccttctgaagacagcgctgctcatcgtgtctggcatttttccgtattccatccctgctaccctgcttgtctggcacacgtggcagaaacagacccaacgcagcggggtgctgtgggatgttccctctcctcccgaaacacagaaggccgagctcgaagagggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgaaccgaattgggcttccgtgaagaaagacctgattagctatggcgggggatggagactttctgcccagtggcaaaagggcgaggaagttcaggtcatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtggtcgggctgtacggaaatggcgtggttacgaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtccgggaagctatcaagcgcagactccggaccctgattctcgcccctacgagagtggttgcggccgagatggaggaagctctgaaaggccttcccatccgctatcagacaaccgccaccaagtctgagcatacagggcgggaaattgtggacctgatgtgccacgctacctttacaatgagactgctcagccctgtccgcgtgccgaattacaacctgatcattatggatgaggcccatttcaccgaccccgcctccatcgctgcgcggggatatatctctacgagagttggcatgggggaagccgctgccatttttatgacagccacccctcccggaacagctgatgccttccctcagagcaatgcgcccatccaggacgaggagcgcgacattccggaacggtcctggaactctggcaatgagtggatcaccgattttgctgggaaaacggtgtggttcgtccctagcattaaggccggcaacgacatcgccaactgtcttcgcaaaaatggaaagaaggtgattcaactgtccagaaaaacctttgatacagaataccagaagaccaaactcaacgactgggatttcgtggtcacaaccgacatctctgagatgggcgctaattttaaggccgatcgggttatcgaccccagacggtgcctgaaacccgtgattctgacagatgggcctgagcgcgtgatcctcgcgggacccatgcctgtcaccgccgctagcgccgctcagagacggggccgcgtggggagaaacccgcagaaggaaaatgaccaatacattttcacgggacagccccttaacaatgatgaggaccacgcccactggacagaagctaagatgctgctggacaacatcaatacccctgagggcattatccccgccctcttcgaacctgagcgggagaaatccgcggccatcgatggggaatatagactgaagggcgagagccgcaaaacctttgttgaacttatgcggagaggagacctgcccgtgtggctcgctcataaggtcgcctctgagggcattaaatacacagatcgcaagtggtgcttcgacgggcagcggaacaatcagatcctggaagagaacatggatgtggagatttggaccaaagaaggagagaagaagaaactgagaccgcgctggctcgacgctcggacatattccgatcctcttgccctgaaggaatttaaagagttcgccgctggcagaaagagcatcgcgctggacctcgttacggaaattgggcgcgtgccctctcacctggcccatagaacccggaatgctcttgataacctggtcatgctccacacatccgagcacggaggccgcgcctacagacatgccgtggaggaactgcctgagaccatggaaacactgctccttctgggcctgatgatcctcctgaccgggggagctatgctttttctgatcagcggcaaagggattggaaagacgtccatcggcctcatttgtgtcatcgcctctagcgggatgctgtggatggcggagattcccctgcaatggatcgcctccgctattgtgctcgagttctttatgatggttcttctgatccctgaacccgagaagcagcggaccccgcaggacaatcaactggcctatgtggtgatcggcattctcacactggctgccatcattgcggccaacgaaatgggccttctggagaccacaaaacgcgatctcggcatgagcaaggaacctggggtcgtttctcccacctcctacctggacgtggatctgcaccccgctagcgcctggacgctctatgctgtggccacaaccgtcatcacacctatgcttagacataccattgaaaattctaccgctaacgtgagcctggccgcgatcgccaaccaggctgttgtgctgatgggactcgacaaaggctggccgatctccaagatggacctgggggtcccccttctggccctcggatgctactctcaggtgaatcctctgacactgacggctgccgtcctccttctgattacccactacgccatcattggccccgggctgcaggcgaaagctacacgggaggcccaaaagagaaccgctgccggaatcatgaagaaccctacagtggatggcattatgaccatcgacctcgatcccgttatctatgacagcaaattcgaaaagcagctgggccaggtgatgcttctggtcctctgtgtggttcagctgctgctcatgcgcacgtcctgggccctttgcgaggctctgacactggccaccgggcctattaccacactctgggaaggatctccgggcaaattttggaataccacaatcgcggtgagcatggccaacattttccgggggtcctacctggctggagccggccttgcttttagcatcatgaagtctgtcgggacgggaaaaagaggcaccggctcccaaggggagacactgggagaaaagtggaagaaaaagctcaatcagctgagccgcaaagatttcgacctgtataagaaatccggcattaccgaggtggatcggacagaggccaaggaagggctcaaaagaggagagatcacccatcacgcggtgtctcggggcagcgccaaacttcagtggtttgttgaacgcaacatggtcattcccgaggggagagtgatcgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatattggcgagtccagcccttctcccacagtcgaagagtccagaaccatccgggtgctcaagatggttgagccctggctgaagaacaatcagttctgtattaaagtgctgaacccttacatgcccacagtcatcgaacatctcgagcgccttcaaagaaagcacggcgggatgctggtgcggaatcctctgagccgcaactctacccatgaaatgtattggatttccaatggaacgggcaacatcgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcattggcgagagaatcaagcgcattaaagaagaacacaacagcacctggcactacgacgatgaaaatccctataagacatgggcttaccatgggtcctatgaggttaaggccaccggatctgcgagctccatgatcaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaattacagctgagtggctgtggcgcaccctcggccggaataaaaagcctagactgtgcacgcgcgaggagttcacaaagaaagttcggaccaacgccgctatgggggccgtgtttacagaggaaaatcagtgggattccgccaaggcggctgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggccatctggtatatgtggcttggggctcgctacctggagttcgaggccctcggatttctgaatgaggatcattggttctccagagaaaactcttacagcggcgtggagggggaaggactgcacaagctcggctatatcctgcgggacatttccaaaatccccggggctgccatgtacgcggatgacaccgccggctgggacacgagaattaccgaggatgaccttcacaatgaagagaagatcacacagcagatggatcctgagcatcggcaactggctaacgccatttttaaactcacctatcagaataaggtcgtgaaggtccagcgccccacaccgaccggaacagtgatggacatcatctctagaaaagatcagcggggcagcgggcaagttggaacctacggcctgaacacgttcacaaatatggaagctcagcttattcgccagatggagggggaaggagtgctgtccaaggccgacctcgagaaccctcatctgcccgagaagaagatcacccagtggctggagaccaaaggcgtcgagagactcaagcggatggcgattagcggggatgactgcgtggtgaagcccatcgatgaccgctttgccaacgctctgcttgccctgaatgatatgggcaaagttagaaaggacattcctcaatggcagccgtctaaaggatggcatgattggcaacaggtgcccttctgttcccaccacttccatgaactcatcatgaaggacggccggaaactggtcgtgccttgccgcccccaagacgagcttattgggagagctcggatcagccagggagccggctggtctctgaaggaaacagcttgtctcgggaaggcctatgcgcagatgtggtccctgatgtactttcaccgcagagatctgcggctcgccagcaacgctatctgctctgccgttcctgtgcattgggtccccacctcccgcacaacgtggagcattcacgcccatcaccaatggatgaccacagaggacatgctgaccgtgtggaatagagtctggatcgaagataacccttggatggaggacaaaacacccgtgaccacgtgggagaatgttccgtatcttggaaagcgggaagatcagtggtgtggctccctgattgggctcaccagcagagctacatgggcccagaacatccctaccgcgattcagcaagtgcgctctctgatcggcaatgaggagttccttgactacatgcccagcatgaaacggtttagaaaggaggaggaatccgagggagctatctggtga

SEQ ID NO: 20548 - RNA, 9873 nt, synthetic construct
  misc_feature 1..9873: note = derived and/or modified CDS sequence (opt5) from DENV-3__HM756274__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttcggactcaaggatacactgaaaagacgctcttggccccttaatgagggcgtcatggctgtggggctggttagcattctggcgtcctctctcctgagaaacgacgtgcctatggccggaccccttgtcgctggcgggctgctcatcgcctgttatgtgattaccggaaccagcgccgatctgacagttgaaaaggctgccgacatcacctgggaggaagaggcggaacagacaggcgtgtcccacaacctcatgattacggtcgacgatgacggcaccatgcggatcaaagatgacgagacagagaatatcctgaccgtgcttctgaagacagctctgctcattgtcagcgggatctttccgtactctattcctgccaccctgcttgtgtggcatacgtggcagaaacagacccaacgctccggagttctgtgggatgtgcccagccctcccgaaacacagaaggccgagctcgaagagggcgtctacagaatcaaacagcaggggattttcggaaagacccaagtgggcgttggggtgcagaaggagggagtctttcacacaatgtggcacgtgacccggggcgctgtgctgacacataacggcaaacgcctcgaaccgaattgggcctctgttaagaaagacctgatctcctatgggggaggctggagacttagcgcgcagtggcaaaagggggaggaagtccaggtgattgctgtggagcctggcaagaaccccaagaatttccagacgatgcctggcaccttccagacaaccaccggggaaatcggagccatcgccctggattttaagcccggcacatctggctcccccattatcaaccgggaggggaaagtcgtgggactgtacggcaatggggttgtgacgaagaacggaggctatgtcagcgggattgctcaaaccaatgccgagcctgacggcccgacacccgaactcgaggaagagatgttcaaaaagcgcaacctgaccatcatggatcttcaccctggatccggcaaaacaagaaagtacctgcccgctattgtgcgggaagccatcaagcgcagactccggaccctgatcctcgcgcctacgagagttgtggccgctgagatggaggaagccctgaaagggcttcccattcgctatcagacaaccgctaccaagagcgagcatacaggacgggaaatcgtcgacctgatgtgccacgccacctttacaatgagactgctctctcctgtgcgcgttccgaattacaacctgattatcatggatgaggcccatttcaccgaccccgctagcattgcggcccggggctatatctccacgagagtggggatgggagaagctgccgccatctttatgacagctacccctcccggcacagccgatgcgttccctcagtctaatgctcccattcaggacgaggagcgcgacatcccggaacggagctggaactccgggaatgagtggattaccgattttgccggcaaaacggtctggttcgtgccttctatcaaggccggaaacgacattgctaactgtcttcgcaaaaatggcaagaaggtgatccaactgagcagaaaaacctttgatacagaataccagaagaccaaactcaacgactgggatttcgtcgttacaaccgacatttccgagatgggggccaattttaaggcggatcgggtgatcgaccccagacggtgcctgaaacccgtgatcctgacagatggacctgagcgcgtcattctcgccggccccatgcctgtgaccgctgcctctgctgcccagagacgggggcgcgttggaagaaacccgcagaaggaaaatgaccaatacatcttcacgggccagccccttaacaatgatgaggaccacgctcactggacagaagccaagatgctgctggacaacattaatacccctgaggggatcattcccgccctcttcgaacctgagcgggagaaaagcgccgctatcgatggcgaatatagactgaagggagagtcccgcaaaacctttgtggaacttatgcggagaggcgacctgcccgtctggctcgcccataaggtggctagcgaggggatcaaatacacagatcgcaagtggtgcttcgacggacagcggaacaatcagattctggaagagaacatggatgttgagatctggaccaaagaaggcgagaagaagaaactgagaccgcgctggctcgacgcccggacatattctgatcctcttgccctgaaggaatttaaagagttcgctgcggggagaaagtccattgccctggacctcgtgacggaaatcggacgcgtccccagccacctggctcatagaacccggaatgcccttgataacctggtgatgctccacacatctgagcacggcggccgcgcctacagacatgctgtcgaggaactgcctgagaccatggaaacactgctccttctggggctgatgattctcctgaccggaggcgccatgctttttctgatctccgggaaaggaatcggcaagacgagcattgggctcatctgtgtgattgcgtcctctggaatgctgtggatggccgagatccccctgcaatggattgctagcgccatcgttctcgagttctttatgatggtgcttctgattcctgaacccgagaagcagcggaccccgcaggacaatcaactggcttatgtggtcatcggcatcctcacactggccgcgattatcgccgctaacgaaatgggccttctggagaccacaaaacgcgatctcgggatgtccaaggaacctggagttgtgagccccacctcttacctggacgtggatctgcaccccgcctccgcttggacgctctatgccgtcgctacaaccgtgattacacctatgcttagacataccatcgagaatagcaccgccaacgtttctctggcggccattgctaaccaggccgtggtcctgatgggcctcgacaaagggtggccgatcagcaagatggacctgggagtgccccttctggctctcggctgctactcccaggtcaatcctctgacactgacggccgccgtgctccttctgatcacccactacgcgattatcgggcccggactgcaggctaaagccacacgggaggctcaaaagagaaccgccgccggcattatgaagaaccctacagttgatggcatcatgaccattgacctcgatcccgtgatctatgactctaaattcgaaaagcagctggggcaggtcatgcttctggtgctctgtgctgttcagctgctgctcatgcgcacgagctgggccctttgcgaggcgctgacactggccaccggacctatcaccacactctgggaaggctccccggggaaattttggaataccacaattgctgtgtctatggccaacatcttccggggaagctacctggctggcgccgggcttgcgttttccattatgaaaagcgtcggaacgggcaaaagaggcaccgggtctcaaggagagacactgggcgaaaagtggaagaaaaagctcaatcagctgtcccgcaaagatttcgacctgtataagaaaagcgggatcaccgaggtggatcggacagaggccaaggaaggactcaaaagaggcgagattacccatcacgctgtgtcccgggggtctgccaaacttcagtggtttgttgaacgcaacatggtcatccccgagggaagagtgattgacctgggctgtggcagagggggatggagctactattgcgctggcctgaagaaagtgacggaagtccgcgggtacaccaagggaggccctgggcacgaggagcccgttcctatgtccacatatggatggaatatcgtgaaactcatgtctggcaaggatgtgttctacctgcccccggaaaaatgtgacacccttctgtgcgatatcggcgagagctcccctagccccacagtcgaagagtctagaaccattcgggtgctcaagatggttgagccctggctgaagaacaatcagttctgtatcaaagtgctgaacccttacatgcccacagtcattgaacatctcgagcgccttcaaagaaagcacgggggaatgctggtgcggaatcctctgtcccgcaacagcacccatgaaatgtattggatctctaatggcacggggaacattgttgcctccgtgaatatggtcagcagactcctgcttaaccggtttacaatgacccacagacgcccgaccatcgagaaagacgtggatctgggagctggcacacggcacgtgaacgccgaacccgagacgcctaatatggacgtcatcggggagagaattaagcgcatcaaagaagaacacaactctacctggcactacgacgatgaaaatccctataagacatgggcgtaccatggaagctatgaggttaaggccaccggctccgcttctagcatgattaacggcgtggtgaaactcctgacaaagccttgggacgtcgtgcccatggttacccagatggccatgacagataccacgccgttcgggcagcaacgggtgtttaaagaaaaggtcgacaccagaacacctcgctccatgcccggaacccggagagtgatgggcatcacagctgagtggctgtggcgcaccctcgggcggaataaaaagcctagactgtgcacgcgcgaggagttcacaaagaaagttcggaccaacgccgccatgggagcggtgtttacagaggaaaatcagtgggatagcgctaaggccgccgtcgaggacgaagatttctggaaacttgtggacagagagcgcgagctgcacaagctcggcaaatgtgggtcctgcgtttacaacatgatgggcaagagagagaagaagctgggagagtttggcaaggctaaagggtctcgggccatttggtatatgtggcttggagctcgctacctggagttcgaggccctcggctttctgaatgaggatcattggttcagcagagaaaactcctactctggggtggagggagaaggcctgcacaagctcgggtatatcctgcgggacatcagcaaaattcccggcggagcgatgtacgccgatgacaccgctggctgggacacgagaatcaccgaggatgaccttcacaatgaagagaagattacacagcagatggatcctgagcatcggcaactggccaacgctatctttaaactcacctatcagaataaggtcgtgaaggtccagcgccccacaccgaccgggacagtgatggacattatctccagaaaagatcagcggggatctggccaagttgggacctacggactgaacacgttcacaaatatggaagcccagcttatccgccagatggagggcgaaggggtgctgagcaaggcggacctcgagaaccctcatctgcccgagaaaaagattacccagtggctggagaccaaaggcgtcgagagactcaagcggatggccatctccggagatgactgcgtggtgaagcccattgatgaccgctttgctaacgccctgcttgctctgaatgatatgggcaaagttagaaaggacatccctcaatggcagccgagcaaagggtggcatgattggcaacaggtgcccttctgttctcaccacttccatgaactcattatgaaggacggacggaaactggtcgtgccttgccgcccccaagacgagcttatcggcagagcccggatttcccagggggctggatggagcctgaaggaaacagcctgtctcggcaaggcgtatgcccagatgtggtctctgatgtactttcaccgcagagatctgcggctcgcttccaacgccatctgcagcgccgttcctgtgcattgggtccccacctctcgcacaacgtggtccatccacgctcatcaccaatggatgaccacagaggacatgctgaccgtgtggaatagagtctggattgaagataacccttggatggaggacaaaacacccgtgaccacgtgggagaatgttccgtatcttgggaagcgggaagatcagtggtgtggcagcctgatcggactcacctccagagccacatgggcgcagaacattcctaccgctatccagcaagtgcgcagcctgattggcaatgaggagttccttgactacatgccctctatgaaacggtttagaaaggaggaggaaagcgagggggccatctggtga

SEQ ID NO: 20549 - RNA, 9873 nt, synthetic construct
  misc_feature 1..9873: note = derived and/or modified CDS sequence (opt5) from DENV-3__HM756275__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggactggctgcccatggccgttgctgccatgggggtgcctcccctccctctgtttattttctctctcaaggatacactgaaaagacgcagctggccccttaatgagggagtgatggccgtcggcctggtgtccatcctggcttctagcctcctgagaaacgacgttcctatggcggggccccttgtggccggaggcctgctcattgcttgttacgtcatcaccgggacctccgccgatctgacagtggaaaaggccgctgacattacctgggaggaagaggccgaacagacaggagttagccataacctcatgatcacggtggacgatgacggcaccatgcggatcaaagatgacgagacagagaatattctgaccgtccttctgaagacagcgctgctcatcgtgtctggcatttttccgtattccatccctgctaccctgcttgtctggcacacgtggcagaaacagacccaacgcagcggggtgctgtgggatgttccctctcctcccgaaacacagaaggccgagctcgaagagggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgaaccgaattgggcttccgtgaagaaagacctgattagctatggcgggggatggagactttctgcccagtggcaaaagggcgaggaagttcaggtcatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtggtcgggctgtacggaaatggcgtggttacgaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtccgggaagctatcaagcgcagactccggaccctgattctcgcccctacgagagtggttgcggccgagatggaggaagctctgaaaggccttcccatccgctatcagacaaccgccaccaagtctgagcatacagggcgggaaattgtggacctgatgtgccacgctacctttacaatgagactgctcagccctgtccgcgtgccgaattacaacctgatcattatggatgaggcccatttcaccgaccccgcctccatcgctgcgcggggatatatctctacgagagttggcatgggggaagccgctgccatttttatgacagccacccctcccggaacagctgatgccttccctcagagcaatgcgcccatccaggacgaggagcgcgacattccggaacggtcctggaactctggcaatgagtggatcaccgattttgctgggaaaacggtgtggttcgtccctagcattaaggccggcaacgacatcgccaactgtcttcgcaaaaatggaaagaaggtgattcaactgtccagaaaaacctttgatacagaataccagaagaccaaactcaacgactgggatttcgtggtcacaaccgacatctctgagatgggcgctaattttaaggccgatcgggttatcgaccccagacggtgcctgaaacccgtgattctgacagatgggcctgagcgcgtgatcctcgcgggacccatgcctgtcaccgccgctagcgccgctcagagacggggccgcgtggggagaaacccgcagaaggaaaatgaccaatacattttcacgggacagccccttaacaatgatgaggaccacgcccactggacagaagctaagatgctgctggacaacatcaatacccctgagggcattatccccgccctcttcgaacctgagcgggagaaatccgcggccatcgatggggaatatagactgaagggcgagagccgcaaaacctttgttgaacttatgcggagaggagacctgcccgtgtggctcgctcataaggtcgcctctgagggcattaaatacacagatcgcaagtggtgcttcgacgggcagcggaacaatcagatcctggaagagaacatggatgtggagatttggaccaaagaaggagagaagaagaaactgagaccgcgctggctcgacgctcggacatattccgatcctcttgccctgaaggaatttaaagagttcgccgctggcagaaagagcatcgcgctggacctcgttacggaaattgggcgcgtgccctctcacctggcccatagaacccggaatgctcttgataacctggtcatgctccacacatccgagcacggaggccgcgcctacagacatgccgtggaggaactgcctgagaccatggaaacactgctccttctgggcctgatgatcctcctgaccgggggagctatgctttttctgatcagcggcaaagggattggaaagacgtccatcggcctcatttgtgtcatcgcctctagcgggatgctgtggatggcggagattcccctgcaatggatcgcctccgctattgtgctcgagttctttatgatggttcttctgatccctgaacccgagaagcagcggaccccgcaggacaatcaactggcctatgtggtgatcggcattctcacactggctgccatcattgcggccaacgaaatgggccttctggagaccacaaaacgcgatctcggcatgagcaaggaacctggggtcgtttctcccacctcctacctggacgtggatctgcaccccgctagcgcctggacgctctatgctgtggccacaaccgtcatcacacctatgcttagacataccattgaaaattctaccgctaacgtgagcctggccgcgatcgccaaccaggctgttgtgctgatgggactcgacaaaggctggccgatctccaagatggacctgggggtcccccttctggccctcggatgctactctcaggtgaatcctctgacactgacggctgccgtcctccttctgattacccactacgccatcattggccccgggctgcaggcgaaagctacacgggaggcccaaaagagaaccgctgccggaatcatgaagaaccctacagtggatggcattatgaccatcgacctcgatcccgttatctatgacagcaaattcgaaaagcagctgggccaggtgatgcttctggtcctctgtgtggttcagctgctgctcatgcgcacgtcctgggccctttgcgaggctctgacactggccaccgggcctattaccacactctgggaaggatctccgggcaaattttggaataccacaatcgcggtgagcatggccaacattttccgggggtcctacctggctggagccggccttgcttttagcatcatgaagtctgtcgggacgggaaaaagaggcaccggctcccaaggggagacactgggagaaaagtggaagaaaaagctcaatcagctgagccgcaaagatttcgacctgtataagaaatccggcattaccgaggtggatcggacagaggccaaggaagggctcaaaagaggagagatcacccatcacgcggtgtctcggggcagcgccaaacttcagtggtttgttgaacgcaacatggtcattcccgaggggagagtgatcgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatattggcgagtccagcccttctcccacagtcgaagagtccagaaccatccgggtgctcaagatggttgagccctggctgaagaacaatcagttctgtattaaagtgctgaacccttacatgcccacagtcatcgaacatctcgagcgccttcaaagaaagcacggcgggatgctggtgcggaatcctctgagccgcaactctacccatgaaatgtattggatttccaatggaacgggcaacatcgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcattggcgagagaatcaagcgcattaaagaagaacacaacagcacctggcactacgacgatgaaaatccctataagacatgggcttaccatgggtcctatgaggttaaggccaccggatctgcgagctccatgatcaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaattacagctgagtggctgtggcgcaccctcggccggaataaaaagcctagactgtgcacgcgcgaggagttcacaaagaaagttcggaccaacgccgctatgggggccgtgtttacagaggaaaatcagtgggattccgccaaggcggctgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggccatctggtatatgtggcttggggctcgctacctggagttcgaggccctcggatttctgaatgaggatcattggttctccagagaaaactcttacagcggcgtggagggggaaggactgcacaagctcggctatatcctgcgggacatttccaaaatccccgggggcgctatgtacgccgatgacaccgcgggatgggacacgagaattaccgaggatgaccttcacaatgaagagaagatcacacagcagatggatcctgagcatcggcaactggccaacgctatttttaaactcacctatcagaataaggtcgtgaaggtccagcgccccacaccgaccggcacagtgatggacatcatctctagaaaagatcagcgggggagcggacaagttggcacctacgggctgaacacgttcacaaatatggaagcccagcttattcgccagatggagggagaaggcgtgctgtccaaggctgacctcgagaaccctcatctgcccgagaagaagatcacccagtggctggagaccaaaggggtcgagagactcaagcggatggccattagcggcgatgactgcgtggtgaagcccatcgatgaccgctttgcgaacgccctgcttgctctgaatgatatgggaaaagttagaaaggacattcctcaatggcagccgtctaaaggctggcatgattggcaacaggtgcccttctgttcccaccacttccatgaactcatcatgaaggacgggcggaaactggtcgtgccttgccgcccccaagacgagcttattggacgggcccggatcagccagggcgctgggtggtctctgaaggaaacagcctgtctcggaaaggcttatgcccagatgtggtccctgatgtactttcaccgcagagatctgcggctcgcgagcaacgccatctgctctgctgttcctgtgcattgggtccccacctcccgcacaacgtggagcattcacgcccatcaccaatggatgaccacagaggacatgctgaccgtgtggaatagagtctggatcgaagataacccttggatggaggacaaaacacccgtgaccacgtgggagaatgttccgtatcttggcaagcgggaagatcagtggtgtgggtccctgattggcctcaccagcagagccacatgggctcagaacatccctaccgccattcagcaagtgcgctctctgatcggaaatgaggagttccttgactacatgcccagcatgaaacggtttagaaaggaggaggaatccgagggcgcgatctggtga

SEQ ID NO: 20550 - RNA, 9873 nt, synthetic construct
  misc_feature 1..9873: note = derived and/or modified CDS sequence (opt5) from DENV-3__JF937632__SS-prME
  source 1..9873: mol_type = other RNA
accagcctgtgcctcatgatgatcctgcccgccgctcttgccttccacctgacctcccgggacggagaacctcggatgattgtggggaagaacgaacgcggaaaatctctcctgtttaagacggcgagcggcatcaatatgtgtacccttattgctatggatctgggggaaatgtgcgacgatacggtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatattggagaagatggctgttggtacgggatggagatcagacccatttctgaaaaggaggagaatatggtgaaatccctggttagcgcgggatctggcaaggtggacaacttcacaatgggggtcctgtgcctcgctatcctgtttgaagaggtgatgcggggaaagttcggcaaaaagcacatgattgccggcgttttctttaccttcgtgcttctgctcagcgggcagatcacatggcgcgatatggcccataccctgattatgatcggatccaatgctagcgacagaatgggcatgggggtcacgtatctggcccttatcgcgacatttaaaattcagcccttcctggctctcggatttttcctgcggaagctcacctctagagaaaacctgcttctgggcgtggggctcgccatggccacaaccctgcaactgcctgaggatatcgaacagatggctaatggaattgcccttggcctgatggctctcaaactgatcacccagtttgagacataccagctctggacggccctgatttcccttacctgtagcaacacaatcttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttattttctctctcaaggataccctgaaaagacgcagctggccccttaatgagggagtcatggccgtgggcctggtttccatcctggcttctagcctcctgagaaacgacgtgcctatggcggggccccttgtcgccggaggcctgctcattgcttgttatgtgatcaccgggacatccgccgatctgaccgttgaacgggccgctgacattacatgggaggaagaggccgaacagacgggagtgagccacaacctcatgatcaccgtcgacgatgacggcacaatgcgcatcaaggatgacgagaccgagaatattctgacagtgcttctgaaaaccgcgctgctcatcgtctctggcatttttccgtactccatccctgctacgctgcttgtgtggcatacctggcagaagcagacacaaagaagcggggttctgtgggatgtgccctctcctcccgaaacccagaaagccgagctcgaagagggagtctaccggattaagcagcagggcatcttcgggaaaacacaagtgggagttggcgtgcagaaggagggggtctttcacaccatgtggcacgtgacacgcggagccgtgctgacgtataacggcaagagactcgaaccgaattgggcttccgttaaaaaggacctgattagctacggcgggggatggcggctttctgcccagtggcaaaaaggcgaggaagtccaggtgatcgcggtggagcctgggaagaaccccaaaaatttccagaccatgcctggaacattccagaccaccacaggcgaaatcggggctattgccctggattttaagcccggaacgtccggcagccccatcattaaccgcgagggcaaggtcgtggggctgtatggaaatggcgttgtgaccaaaaacgggggatacgtctccggcatcgcccaaacaaatgctgagcctgacgggccgacccccgaactcgaggaagagatgttcaagaaaagaaacctgacaattatggatcttcatcctggcagcggaaagacccggaaatatctgcccgccatcgtgcgcgaagctatcaagagacggctcagaacgctgattctcgcccctacacgcgttgtggcggccgagatggaggaagctctgaagggccttcccatccggtaccagaccaccgccacaaaatctgagcacaccgggagagaaattgtcgacctgatgtgccatgctacatttaccatgcgcctgctcagccctgtgcgggttccgaattataacctgatcattatggatgaggcccacttcacggaccccgcctccatcgctgcgagaggatacatctctacacgcgtgggcatgggggaagccgctgccatttttatgaccgccacacctcccggaaccgctgatgccttccctcagagcaatgcgcccatccaggacgaggagcgggacattccggaaagatcctggaactctggcaatgagtggatcacggattttgctgggaagaccgtctggttcgtgcctagcattaaagccggcaacgacatcgccaactgtcttcgcaagaatggcaaaaaggtgattcaactgtcccggaagacatttgataccgaataccagaaaacaaagctcaacgactgggatttcgtcgttaccacagacatctctgagatgggagctaattttaaagccgatagagtgatcgacccccggcgctgcctgaagcccgtgattctgaccgatgggcctgagagagtcatcctcgcgggacccatgcctgtgacggccgctagcgccgctcagcggcgcggcagagttgggcggaacccgcagaaagaaaatgaccaatatattttcacaggacagccccttaacaatgatgaggaccatgcccactggaccgaagctaagatgctgctggacaacatcaatacccctgagggcattatccccgccctcttcgaacctgagagagagaagtccgcggccatcgatggggaataccgcctgaaaggcgagagccggaagacatttgtggaacttatgagacgcggagacctgcccgtctggctcgctcacaaagtggcctctgagggcattaagtataccgatcggaaatggtgcttcgacgggcagagaaacaatcagatcctggaagagaacatggatgttgagatttggacaaaggaaggagagaaaaagaagctgcgcccgcggtggctcgacgctagaacgtactccgatcctcttgccctgaaagaatttaaggagttcgccgctggccgcaaaagcatcgcgctggacctcgtgaccgaaattgggagagtcccctctcatctggcccaccggacacgcaatgctcttgataacctggtgatgctccatacctccgagcacggaggcagagcctatcggcacgccgtcgaggaactgcctgagacaatggaaaccctgctccttctgggcctgatgatcctcctgacagggggagctatgctttttctgatcagcggcaaggggattggaaaaacctccatcggcctcatttgtgtgatcgcctctagcgggatgctgtggatggcggagattcccctgcaatggatcgcctccgctattgttctcgagttctttatgatggtgcttctgatccctgaacccgagaagcagcgcacaccgcaggacaatcaactggcctacgtggtcatcggcattctcaccctggctgccatcattgcggccaacgaaatgggccttctggagacaaccaagagagatctcggcatgagcaaagaacctggggttgtgtctcccacgtcctatctggacgtggatctgcatcccgctagcgcctggacactctacgctgtcgccaccacagtgatcacccctatgcttcggcacaccattgaaaattctacagctaacgttagcctggccgcgatcgccaaccaggctgtggtcctgatgggactcgacaagggctggccgatctccaaaatggacctgggggtgccccttctggccctcggatgctactctcaggtcaatcctctgacgctgaccgctgccgtgctccttctgattacacattatgccatcattggccccgggctgcaggcgaaggctaccagagaggcccaaaaacgcacagctgccggaatcatgaagaaccctaccgttgatggcattatgacgatcgacctcgatcccgtgatctacgacagcaagttcgaaaaacagctgggccaggtcatgcttctggtgctctgtgccgttcagctgctgctcatgcggacatcctgggctctttgcgaggccctgaccctggcgaccgggcctattacaaccctctgggaaggatctccgggcaagttttggaatacaacgatcgccgtgagcatggctaacattttcagagggtcctatctggccggagctggccttgcctttagcatcatgaaatctgtcgggaccggaaagcgcggcacaggcccccaaggggagaccctgggagaaaaatggaagaagaaactcaatcagctgtcccggaaggatttcgacctgtacaaaaagagcggcattacagaggtggatagaaccgaggcgaaagaagggctcaagcggggagagatcacgcaccatgccgtgtcccgcggctctgctaaacttcagtggtttgttgaaagaaacatggtcattcctgaggggcgggtgatcgacctgggatgtggccgcggcgggtggagctattactgcgccggactgaagaaggtgaccgaagtcagaggctatacaaaagggggacccggccacgaggagcctgttcccatgtccacctacgggtggaatatcgtgaagctcatgtctggaaaagatgtgttctacctgccgcctgaaaagtgtgacacacttctgtgcgatattggcgagagctcccccagccccaccgtcgaagagtctcggacaatccgcgtgctcaaaatggttgagccttggctgaagaacaatcagttctgtattaaggtgctgaacccctatatgcctaccgtcatcgaacacctcgagagacttcaacggaaacatggcgggatgctggtgcgcaatccgctgtccagaaacagcacgcacgaaatgtactggatttctaatggaacaggcaacatcgttgcttccgtgaatatggtcagccggctcctgcttaacagatttaccatgacccatcgccggcccacaatcgagaaggacgtggatctgggggccggaacgagacacgtgaacgctgaacctgagacccccaatatggacgtcattggcgagcgcatcaaacggattaaggaagaacacaactctacatggcattatgacgatgaaaatccttacaaaacctgggcctatcacgggagctacgaggttaaggcgacaggatccgcctctagcatgatcaacggcgtggtgaagctcctgaccaaaccctgggacgtcgtgccgatggttacacagatggctatgaccgatacgacccctttcggccagcaaagagtgtttaaggaaaaagtcgacacacgcacaccccggtccatgcctgggacaagacgcgtgatgggaattaccgccgagtggctgtggcggacgctcggcagaaataagaaaccccgcctgtgcacacgggaggagttcaccaagaaggttagaacaaacgctgccatgggggccgtgtttaccgaggaaaatcagtgggatagcgcgaaagctgccgtcgaggacgaagatttctggaaacttgtggaccgcgagagagagctgcataaactcggaaagtgtggctcctgcgtttataacatgatggggaaacgggaaaagaaactgggcgagtttggaaaggccaagggctctcgcgctatctggtacatgtggcttggggccagatacctggagttcgaggctctcggatttctgaatgaggatcactggttcagccgggaaaactcctattctggcgtggagggggaaggactgcatagactcggctacatcctgcgggacattagcaaaatccctgggggcgccatgtatgcggatgacacggccggatgggacacccgcattacagaggatgaccttcacaatgaagagaagatcacccagcagatggatcccgagcacagacaactggctaacgccatttttaaactcacataccagaataaggtcgtgaaagtccagcggccgacccctacaggcaccgtgatggacatcatctcccgcaaggatcagagagggtctggacaagttggcacgtatgggctgaacacattcaccaatatggaagctcagcttattcggcagatggagggagaaggcgtgctgagcaaggccgacctcgagaacccccatctgcccgagaagaagatcacccagtggctggagacaaaaggggtcgagcgcctcaagagaatggcgatttccggcgatgactgcgtggtgaaacctatcgatgaccggtttgccaacgctctgcttgccctgaatgatatgggaaaggttcgcaaggacattccgcaatggcagcccagcaaaggctggcacgattggcaacaggtgcctttctgttctcatcacttccacgaactcatcatgaaggacgggagaaaactggtcgtgccctgccggcctcaagacgagcttattggacgcgctagaatctcccagggcgccgggtggagcctgaaggaaaccgcttgtctcggaaaagcctacgcgcagatgtggtctctgatgtattttcatcggcgcgatctgagactcgcctccaacgctatctgcagcgccgttcccgtgcactgggtccctacatctcggacgacctggtccattcatgcccaccatcaatggatgacaaccgaggacatgctgacagtgtggaatagagtctggatcgaagataacccctggatggaggacaagaccccggtgacgacctgggagaatgttccttaccttggcaagcgcgaagatcagtggtgtgggagcctgattggcctcacatcccgggctacctgggcccagaacatccccacagcgattcagcaagtgagaagcctgatcggaaatgaggagttccttgactacatgccttctatgaaacgctttcggaaggaggaggaaagcgagggcgctatctggtga

SEQ ID NO: 20551 - RNA, 9873 nt, synthetic construct
  misc_feature 1..9873: note = derived and/or modified CDS sequence (opt5) from DENV-3__HM756281__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccaaggagctgaaatactcttggaagacctgggggaaggccaaaattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaagctgcgcgaagtgtacacacagctgtgtgaccaccggcttatgagcgcggccgtgaaagatgagagagctgtccacgccgacatggggtactggatcgagtcccagaagaacggatcttggaaactcgaaaaggccagcctgattgaggtgaagacctgcacctggcctaaatcccatacactgtggtctaatggcgttctcgaaagcgatatgatcattcccaagtccctggctgggcctatcagccagcacaaccatcgccccggatatcacacccaaacggccggcccttggcaccttgggaaactggagctcgactttaattactgcgagggaacaaccgtggtcattacagaaaactgtggcacccggggcccctctctgagaacaaccacggtgtccgggaagctgatccatgagtggtgctgtcgcagctgcacccttccgcctctccggtatatgggagaagatggctgttggtacgggatggagatcagacccatttctgaaaaagaggagaatatggttaagtccctggtgagcgcgggatctggcaaggtcgacaacttcacaatgggggtgctgtgcctcgctatcctgtttgaagaggttatgcggggaaaattcggcaagaaacacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaagatccagcccttcctggctctcggatttttcctgcggaaactcacctctagagaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacaatcttcaccctgacagtcgcgtggcgcaccgccacgctcattctggctggcgtttccctgcttccggtgtgccaatctagctccatgcggaagacagactggctgcccatggccgtggctgccatgggggtccctcccctccctctgtttatcttctctctcaaagataccctgaagagacgcagctggccccttaatgagggagtgatggccgttggcctggtgtccatcctggcttctagcctcctgagaaacgacgtccctatggcggggccccttgtggccggaggcctgctcattgcttgttatgttatcaccgggacatccgccgatctgaccgtggaaaaagccgctgacattacatgggaggaagaggccgaacagacgggagtcagccacaacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcatacctggcagaagcagacacaacgcagcggggtgctgtgggatgtcccctctcctcccgaaacccagaaagccgagctcgaagagggagtgtacagaattaagcagcagggcatcttcgggaagacacaagttggagtgggcgtccagaaagagggggtgtttcacaccatgtggcacgtgacacggggagccgttctgacgtataacggcaagcgcctcgaaccgaattgggcttccgtcaaaaaggacctgattagctacggcgggggatggagactttctgcccagtggcaaaaaggcgaggaagtgcaggtgatcgcggtcgagcctgggaagaaccccaagaatttccagaccatgcctggaacattccagaccaccacaggcgaaattggggctatcgccctggattttaaacccggaacgtccggcagccccatcattaaccgggagggcaaggtggttgggctgtatggaaatggcgtggtcaccaaaaacgggggatacgtgtccggcatcgcccaaacaaatgctgagcctgacgggccgacccccgaactcgaggaagagatgttcaagaaacgcaacctgacaattatggatcttcatcctggcagcggaaagaccagaaagtatctgcccgccatcgttcgggaagctattaaacgcagactccggacgctgatcctcgcccctacaagagtggtcgcggccgagatggaggaagctctgaagggccttcccatccgctaccagaccaccgccacaaaatctgagcacaccgggcgggaaattgtggacctgatgtgccatgctacatttaccatgagactgctcagccctgttcgcgtgccgaattataacctgatcattatggatgaggcccacttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaagaccgtgtggttcgtgcctagcattaaagccggcaacgacatcgccaactgtcttagaaagaatggaaagaaagtcattcaactgtcccgcaagacatttgataccgaataccagaaaacaaagctcaacgactgggatttcgttgtgaccacagacatctctgagatgggcgctaattttaaagccgatcgggtgattgaccccagacggtgcctgaagcccgtcatcctgaccgatgggcctgagcgcgtgatcctcgcgggacccatgcctgttacggccgctagcgccgctcagagacggggccgcgtggggagaaacccgcagaaggaaaatgaccaatatattttcacaggacagccccttaacaatgatgaggaccatgcccactggaccgaagctaaaatgctgctggacaacatcaatacccctgagggcattatccccgccctcttcgaacctgagcgggagaagtccgcggccattgatggggaatacagactgaaaggcgagagccgcaagacatttgtcgaacttatgcggagaggagacctgcccgtgtggctcgctcacaaagttgcctctgagggcatcaagtataccgatcgcaaatggtgcttcgacgggcagcggaacaatcagatcctggaagagaacatggatgtggagatttggacaaaggaaggagagaagaaaaagctgagaccgcgctggctcgacgctcggacgtactccgatcctcttgccctgaaagaatttaaggagttcgccgctggcagaaaaagcatcgcgctggacctcgtcaccgaaattgggcgcgtgccctctcatctggcccacagaacacggaatgctcttgataacctggtcatgctccatacctccgagcacggaggccgcgcctatagacacgccgtggaggaactgcctgagacaatggaaaccctgctccttctgggcctgatgatcctcctgacggggggagctatgctttttctgattagcggcaaggggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaaacagcggacaccgcaggacaatcaactggcctacgtcgttattggaatcctcaccctggctgccatcattgcggccaacgaaatgggccttctggagacaaccaagcgcgatctcggcatgagcaaagaacctggggtggtgtctcccacgtcctatctggacgtcgatctgcatcccgctagcgcctggacactctacgctgtggccaccacagttatcacccctatgcttagacacaccattgagaattctacagctaacgtgagcctggccgcgatcgccaaccaggctgtcgtgctgatgggactcgacaagggctggccgatttccaaaatggacctgggggtcccccttctggccctcggatgctactctcaggtgaatcctctgacgctgaccgctgccgttctccttctgatcacacattatgccatcattggccccgggctgcaggcgaaggctacccgggaggcccaaaagagaacagctgccggaatcatgaaaaaccctaccgtggatggcattatgacgatcgacctcgatcccgtcatttacgacagcaagttcgaaaaacagctgggccaggtgatgcttctggttctctgtgccgtgcagctgctgctcatgcgcacatcctgggctctttgcgaggccctgaccctggcgaccgggcctatcacaaccctctgggaaggatctccgggcaagttttggaatacaacgatcgccgtcagcatggctaacattttccgggggtcctatctggccggagctggccttgcctttagcatcatgaaatctgtggggaccggaaagagaggcacaggctcccaaggggagaccctgggagaaaagtggaaaaagaaactcaatcagctgagccgcaaggatttcgacctgtacaaaaagtccggcattacagaggtggatcggaccgaggcgaaagaagggctcaagagaggagagatcacgcaccatgccgtttctcggggcagcgctaagcttcagtggtttgtcgaacgcaacatggtgattcccgaggggagagtgatcgacctgggatgtggccggggcgggtggtcctattactgcgccggactgaaaaaggtcaccgaagttcgcggctatacaaaagggggacctggccacgaggagcccgtgcctatgtctacctacgggtggaatattgtgaagctcatgagcggaaaagatgtcttctacctgcccccggaaaagtgtgacacacttctgtgcgatatcggcgagtccagcccttctcccaccgtggaagagtccagaacaatccgggttctcaagatggtggagccctggctgaaaaacaatcagttctgtattaaggtcctgaacccttatatgcccaccgtgatcgaacacctcgagcgccttcaaagaaaacatggcgggatgctggttcggaatcctctgagccgcaactctacgcacgaaatgtactggatttccaatggaacaggcaacatcgtggctagcgtcaatatggtgtctagactcctgcttaaccggtttaccatgacccatagacgcccgacaattgagaaggacgtggatctgggggccggaacgcggcacgtcaacgctgaacccgagacccctaatatggacgttatcggcgagagaatcaaacgcattaaggaagagcacaacagcacatggcattatgacgatgaaaatccctacaagacctgggcctatcacgggtcctacgaggtgaaagcgacaggatctgccagctccatgatcaacggcgtggtcaagctcctgaccaaaccttgggacgtggttcccatggtgacacagatggctatgaccgatacgaccccgttcggccagcaacgggtctttagagaaaaggtggacacacgcacccctcggagcatgcccgggacaagacgcgttatgggaattaccgccgagtggctgtggcggacgctcggcagaaataaaaagcctcgcctgtgcacacgggaggaattcaccaagaaagtgagaacaaacgctgccatgggggccgtctttaccgaggaaaatcagtgggattccgcgaaggctgccgtggaggacgaagatttctggaaacttgttgaccgcgagagagagctgcataagctcggaaaatgtggctcttgcgtgtataacatgatggggaagcgggaaaaaaagctgggcgagtttggaaaggccaaaggcagccgcgctatctggtacatgtggcttggggccagatacctggaattcgaggctctcggatttctgaatgaggatcactggttctcccgggaaaactcttatagcggcgtcgagggggaaggactgcataagctcggctacattctgagagacatctccaaaatccccgggggcgccatgtatgcggatgacacggccggatgggacacccggattacagaggatgaccttcacaatgaagagaagatcacccagcagatggatcctgagcaccgccaactggctaacgccatttttaaactcacataccagaataaggtggtcaaggtgcagagacccaccccgacaggcaccgttatggacatcatttctcggaaagatcagcgcgggagcggacaagtgggcacgtatgggctgaacacattcaccaatatggaagctcagcttatcagacagatggagggagaaggcgtcctgtccaaggccgacctcgagaaccctcatctgcccgaaaaaaagatcacccagtggctggagacaaaaggggtggagcggctcaagcgcatggcgattagcggcgatgactgcgtggttaagcccatcgatgacagatttgccaacgctctgcttgccctgaatgatatgggaaaagtgcggaaggacattcctcaatggcagccgtctaaaggctggcacgattggcagcaggtccccttctgttcccatcacttccacgaactcatcatgaaggacgggcgcaaactggtggttccttgcagaccccaagacgagcttattggacgggctcgcatcagccagggcgccgggtggtctctgaaggaaaccgcttgtctcggaaaggcctacgcgcagatgtggtccctgatgtattttcatagacgggatctgcgcctcgccagcaacgctatttgctctgccgtgcctgtccactgggtgcccacatccagaacgacctggagcatccatgcccaccatcaatggatgacaaccgaggacatgctgacagtctggaatcgggtgtggatcgaagataacccttggatggaggacaaaacccccgttacgacctgggagaatgtgccgtaccttggcaagagagaagatcagtggtgtgggtccctgattggcctcacaagccgcgctacctgggcccagaacatccctacagcgattcagcaagtccggtctctgatcggaaatgaggaattccttgactacatgcccagcatgaaaagatttcgcaaggaggaggaatccgagggcgctatttggtga

SEQ ID NO: 20552 - RNA, 9873 nt, synthetic construct
  misc_feature 1..9873: note = derived and/or modified CDS sequence (opt5) from DENV-3__JF937643__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagaaagctgtgcacgccgacatggggtactggattgagtcccagaagaacggatcttggaaactcgaaaaggccagcctgatcgaggtcaagacctgcacctggcctaaatcccatacactgtggtctaatggcgtgctcgaaagcgatatgattatccccaagtccctggctgggcctattagccagcacaaccatagacccggatatcacacccaaacggccggcccttggcaccttgggaaactggagctcgactttaattactgcgagggaacaaccgttgtgatcacagaaaactgtggcacccgcggcccctctctgcggacaaccacggtctccgggaagctgatccatgagtggtgctgtagaagctgcacccttccgcctctccgctatatgggagaagatggctgttggtacgggatggagattcggcccatctctgaaaaagaggagaatatggtgaagtccctggttagcgcgggatctggcaaggtggacaacttcacaatgggggtcctgtgcctcgctattctgtttgaagaggtgatgagaggaaaattcggcaagaaacacatgatcgccggcgttttctttaccttcgtgcttctgctcagcgggcagattacatggcgggatatggcccataccctgatcatgattggatccaatgctagcgaccgcatgggcatgggggtcacgtatctggcccttatcgcgacatttaagatccagcccttcctggctctcggatttttcctgagaaaactcacctctcgggaaaacctgcttctgggcgtggggctcgccatggccacaaccctgcaactgcctgaggatattgaacagatggctaatggaatcgcccttggcctgatggctctcaagctgattgcccagtttgagacctaccagctctggacagcgctgatctcccttacgtgtagcaacaccattttcacactgaccgtggcctggagaacagctaccctcatcctggccggcgtctccctgcttccggtttgccaatctagctccatgcgcaagacggactggctgcccatggctgtggccgccatgggggtgcctcccctccctctgtttatcttctctctcaaagatacactgaagcggagaagctggccccttaatgagggagtcatggctgtgggcctggtttccattctggcgtctagcctcctgcgcaacgacgtgcctatggccgggccccttgtcgctggaggcctgctcatcgcctgttatgtgattaccgggacctccgccgatctgacagttgaaaaagctgccgacatcacctgggaggaagaggcggaacagacaggagtgagccacaacctcatgattgctgtcgacgatgacggcacgatgagaatcaaggatgacgagaccgagaatatcctgacagtgcttctgaaaaccgccctgctcattgtctctggcatctttccgtactccattcctgccacactgcttgtgtggcatacctggcagaagcagacgcaacggagcggggttctgtgggatgtgccctctcctcccgaaacccagaaagctgagctcgaagagggagtctaccgcatcaagcagcagggcattttcgggaagacacaagtgggagttggcgtgcagaaagagggggtctttcacaccatgtggcacgtgacaagaggagccgtgctgacctataacggcaagcggctcgaaccgaattgggcgtccgttaaaaaggacctgatcagctacggcgggggatggcgcctttctgctcagtggcaaaaaggcgaggaagtccaggtgattgccgtggagcctgggaagaaccccaagaatttccagacaatgcctggaacgttccagaccacaaccggcgaaatcggggccatcgctctggattttaaacccggaacctccggcagccccattatcaacagagagggcaaggtcgtggggctgtatggaaatggcgttgtgacaaaaaacgggggatacgtctccggcattgcccaaacgaatgctgagcctgacgggccgacccccgaactcgaggaagagatgttcaagaaacggaacctgacaatcatggatcttcatcctggcagcggaaagacccgcaagtatctgcccgccattgtgagagaagcgatcaaacggcgcctcagaacactgatcctcgcccctacccgggttgtggctgccgagatggaggaagctctgaagggccttcccattagataccagacgacagccaccaaatctgagcacaccgggcgcgaaatcgtcgacctgatgtgccatgccacatttaccatgcggctgctcagccctgtgagagttccgaattataacctgattatcatggatgaggctcacttcacagaccccgcgtccattgccgctcgcggatacatctctacccgggtgggcatgggggaagccgccgctatctttatgacggccacacctcccggaaccgcggatgctttccctcagagcaatgcccccattcaggacgaggagagagacatcccggaacgctcctggaactctggcaatgagtggattacagattttgccgggaagaccgtctggttcgtgcctagcatcaaagctggcaacgacattgccaactgtcttcggaagaatggaaagaaagtgatccaactgtccagaaagacgtttgataccgaataccagaaaacaaagctcaacgactgggatttcgtcgttaccacagacatttctgagatgggcgcgaattttaaagccgatcgcgtgatcgacccccggagatgcctgaagcccgtgatcctgaccgatgggcctgagcgggtcattctcgctggacccatgcctgtgacagccgctagcgccgctcagcgcagaggccgggttgggcgcaacccgcagaaggaaaatgaccaatatatcttcaccggacagccccttaacaatgatgaggaccatgcccactggacggaagcgaaaatgctgctggacaacattaatacacctgagggcatcattcccgccctcttcgaacctgagagagagaagtccgctgccatcgatggggaataccggctgaaaggcgagagcagaaagacctttgtggaacttatgcgccggggagacctgcccgtctggctcgctcacaaagtggcctctgagggcatcaagtataccgatagaaaatggtgcttcgacgggcagcgcaacaatcagattctggaagagaacatggatgttgagatctggacaaaggaaggagagaagaaaaagctgcggccgagatggctcgacgcccgcacctactccgatcctcttgctctgaaagaatttaaggagttcgcggccggccggaaaagcattgctctggacctcgtgacagaaatcgggagagtcccctctcatctggcccaccgcacgagaaatgcccttgataacctggtgatgctccatacctccgagcacggaggccgggcttatcgccacgccgtcgaggaactgcctgagacaatggaaaccctgctccttctgggcctgatgattctcctgacagggggagcgatgctttttctgatcagcggcaaggggatcggaaagacctccattggcctcatctgtgtgattgcctctagcgggatgctgtggatggctgagatccccctgcaatggattgcctccgctatcgttctcgagttctttatgatggtgcttctgattcctgaacccgagaaacagagaacgccgcaggacaatcaactggcctacgtggtcatcggaatcctcaccctggcggccgttattgctgccaacgaaatgggccttctggagacaaccaagcgggatctcggcatgagcaaagaacctggggtggtgtctcccacatcctatctggacgtcgatctgcatcccgctagcgcctggaccctctacgctgtggccacgacagttatcacccctatgcttcgccacacaattgagaattctaccgcgaacgtgagcctggccgctatcgccaaccaggctgtcgtgctgatgggactcgacaagggctggccgatttccaaaatggacctgggggtcccccttctggccctcggatgctactctcaggtgaatcctctgaccctgacagccgcggttctccttctgatcacgcattatgctatcattggccccgggctgcaggccaaggctaccagagaggcccaaaagcggacagccgctggaatcatgaaaaaccctaccgtggatggcattatgacaatcgacctcgatcccgtcatttacgacagcaagttcgaaaaacagctgggccaggtgatgcttctggttctctgtgccgtgcagctgctgctcatgagaacctcctgggcgctttgcgaggccctgacgctggctacagggcctatcaccaccctctgggaaggatctccgggcaagttttggaatacaaccatcgccgtcagcatggctaacattttccgcgggtcctatctggccggagcgggccttgcctttagcatcatgaaatctgtggggacaggaaagcggggcacgggctcccaaggggagaccctgggagaaaagtggaaaaagaaactcaatcagctgagcagaaaggatttcgacctgtacaaaaagtccggcattacagaggtggatcgcaccgaggctaaagaagggctcaagcggggagagatcacacaccatgccgtttctagaggcagcgctaagcttcagtggtttgtcgaacggaacatggtgattcccgaggggcgcgtgatcgacctgggatgtggcagaggcgggtggtcctattactgcgccggactgaaaaaggtcaccgaagttcggggctatacgaaagggggacctggccacgaggagcccgtgcctatgtctacctacgggtggaatattgtgaagctcatgagcggaaaagatgtcttctacctgcccccggaaaagtgtgacacacttctgtgcgatatcggcgagtccagcccttctcccaccgtggaagagtcccgcacaatcagagttctcaagatggtggagccctggctgaaaaacaatcagttctgtattaaggtcctgaacccttatatgcccaccgtgatcgaacacctcgagcggcttcaacgcaaacatggcgggatgctggttagaaatcctctgagccggaactctacacacgaaatgtactggatttccaatggaaccggcaacatcgtggctagcgtcaatatggtgtctcgcctcctgcttaacagatttacgatgacacatcggagaccgaccattgagaaggacgtggatctgggggccggaacccgccacgtcaacgcggaacccgagacacctaatatggacgttatcggcgagcggatcaaaagaattaaggaagagcacaacagcacgtggcattatgacgatgaaaatccctacaagacctgggcctatcacgggtcctacgaggtgaaagctacaggatctgccagctccatgatcaacggcgtggtcaagctcctgaccaaaccttgggacgtggttcccatggtgacacagatggctatgaccgatacaaccccgttcggccagcaacgcgtctttaaggaaaaagtggacacgcggacccctagaagcatgcccgggacacgccgggttatgggaattaccgccgagtggctgtggagaacactcggccgcaataagaagcctcggctgtgcaccagagaggaattcacgaaaaaggtgcgcacaaacgccgcgatgggggctgtctttaccgaggaaaatcagtgggattccgccaaagccgctgtggaggacgaagatttctggaagcttgttgaccgggagagagagctgcataaactcggaaagtgtggctcttgcgtgtataacatgatggggaaacgcgaaaagaagctgggcgagtttggaaaagccaagggcagcagagctatctggtacatgtggcttggggcccggtacctggaattcgaggcgctcggatttctgaatgaggatcactggttctcccgcgaaaactcttatagcggcgtcgagggggaaggactgcataaactcggctacattctgagagacatctccaagatccccgggggcgccatgtatgctgatgacacagccggatgggacacccggattacggaggatgaccttcacaatgaagagaaaatcacccagcagatggatcctgagcacagacaactggctaacgccatttttaagctcacataccagaataaggtggtcaaagtgcagcggcccaccccgacaggcaccgttatggacatcatttctcgcaaggatcagagagggagcggacaagtgggcacatatgggctgaacaccttcacgaatatggaagcgcagcttatccggcagatggagggagaaggcgtcctgtccaaagccgacctcgagaaccctcatctgcccgaaaagaaaatcacacagtggctggagaccaagggggtggagcgcctcaagagaatggctattagcggcgatgactgcgtggttaaacccatcgatgaccggtttgccaacgctctgcttgccctgaatgatatgggaaaggtgcgcaaagacattcctcaatggcagccgtctaagggctggcacgattggcagcaggtccccttctgttcccatcacttccacgaactcatcatgaaagacgggagaaagctggtggttccttgccggccccaagacgagcttattggacgcgctagaatcagccagggcgccgggtggtctctgaaggaaaccgcgtgtctcggaaaagcctacgctcagatgtggtccctgatgtattttcatcggcgcgatctgagactcgccagcaacgccatttgctctgctgtgcctgtccactgggtgcccacatcccggaccacatggagcatccatgcccaccatcaatggatgacgaccgacgatatgctgacagtctggaatcgcgtgtggatcgaggacaacccttggatggaagataagacccccgttacaacctgggagaatgtgccgtaccttggcaaaagagaggaccagtggtgtgggtccctgattggcctcacgagccgggcgacctgggctcagaacatccctacagccattcagcaagtcagatctctgatcggaaatgaagagttccttgattacatgcccagcatgaagcgctttcggaaagaagaggagtccgaaggcgccatttggtga

SEQ ID NO: 20553 - RNA, 9873 nt, synthetic construct
  misc_feature 1..9873: note = derived and/or modified CDS sequence (opt5) from DENV-3__HM181972__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggtgctcggatttttcctgcggaagctcacctctagagaaaacctgcttctgggcgtggggctcgctatggccacaaccctgcaactgcctgaggatattgaacagatggccaatggaatcgctcttggcctgatggccctcaaactgattacccagtttgagacataccagctctggacggctctgatctcccttacctgtagcaacacaattttcaccctgacagtcgcctggcgcaccgcgacgctcatcctggccggcgtttccctgcttccggtgtgccaatctagctccatgcggaagacagactggctgcccatggctgtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttatgttattaccgggacatccgctgatctgaccgtggaaaaggccgccgacatcacatgggaggaagaggctgaacagacgggagtcagccacaacctcatgattaccgtggacgatgacggcacaatgcggatcaaagatgacgagaccgagaatatcctgacagtccttctgaagaccgccctgctcattgtgtctggcatctttccgtactccattcctgcgacgctgcttgtttggcatacctggcagaaacagacacaacgcagcggggtgctgtgggatgtcccctctcctcccgaaacccagaaggctgagctcgaagagggagtgtacagaatcaaacagcagggcattttcgggaagacacaagttggagtgggcgtccagaaggagggggtgtttcacaccatgtggcacgtgacacggggagccgttctgacgtataacggcaaacgcctcgaaccgaattgggcctccgtcaagaaagacctgatcagctacggcgggggatggagactttctgctcagtggcaaaagggcgaggaagtccaggtgattgccgtcgagcctgggaaaaaccccaagaatttccagaccatgcctggaacattccagaccaccacaggcgaaatcggggcgatcgctctggattttaagcccggaacgtccggcagccccattatcaaccgggagggcaaagtggttgggctgtatggaaatggcgtggtcaccaagaacgggggatacgtgtccggcattgcccaaacaaatgccgagcctgacgggccgacccccgaactcgaggaagagatgttcaaaaagcgcaacctgacaatcatggatcttcatcctggcagcggaaaaaccagaaagtatctgcccgctattgttcgggaagccatcaagcgcagactccggacgctgatcctcgctcctacaagagtggtcgccgcggagatggaggaagccctgaaaggccttcccattcgctaccagaccaccgctacaaagtctgagcacaccgggcgggaaatcgtggacctgatgtgccatgccacatttaccatgagactgctcagccctgttcgcgtgccgaattataacctgattatcatggatgaggctcacttcacggaccccgcctccattgccgctcggggatacatctctacaagagtcggcatgggggaagcggccgctatctttatgaccgccacacctcccggaaccgccgatgctttccctcagagcaatgcccccattcaggacgaggagcgcgacatcccggaacggtcctggaactctggcaatgagtggattacggattttgcggggaaaaccgtgtggttcgtgcctagcatcaaggctggcaacgacattgccaactgtcttcgcaaaaatggaaagaaggtcatccaactgtccagaaaaacatttgataccgaataccagaagacaaaactcaacgactgggatttcgttgtgaccacagacatttctgagatgggcgccaattttaaggctgatcgggtgatcgaccccagacggtgcctgaaacccgtcatcctgaccgatgggcctgagcgcgtgattctcgccggacccatgcctgttacggcggccagcgctgcccagagacggggccgcgtggggagaaacccgcagaaggaaaatgaccaatatatcttcacaggacagccccttaacaatgatgaggaccatgctcactggaccgaagccaagatgctgctggacaacattaatacccctgagggcatcattcccgctctcttcgaacctgagcgggagaaatccgccgcgatcgatggggaatacagactgaagggcgagagccgcaaaacatttgtcgaacttatgcggagaggagacctgcccgtgtggctcgcccacaaggttgcttctgagggcatcaaatataccgatcgcaagtggtgcttcgacgggcagcggaacaatcagattctggaagagaacatggatgtggagatctggacaaaagaaggagagaagaagaaactgagaccgcgctggctcgacgcccggacgtactccgatcctcttgctctgaaggaatttaaagagttcgccgccggcagaaagagcattgctctggacctcgtcaccgaaatcgggcgcgtgccctctcatctggcgcacagaacacggaatgcccttgataacctggtcatgctccatacctccgagcacggaggccgcgcttatagacacgccgtggaggaactgcctgagacaatggaaaccctgctccttctgggcctgatgattctcctgacagggggagccatgctttttctgatcagcggcaaagggatcggaaagacctccattggcctcatctgtgttattgcttctagcgggatgctgtggatggccgagatccccctgcaatggattgcgtccgccatcgtgctcgagttctttatgatggtgcttctgattcctgaacccgagaagcagcggacaccgcaggacaatcaactggcttacgtcgttatcggaatcctcaccctggccgctattatcgccgcgaacgaaatgggccttctggagacaaccaaacgcgatctcggcatgagcaaggaacctggggtggtgtctcccacgtcctatctggacgtcgatctgcatcccgccagcgcttggacactctacgccgtggctaccacagttattacccctatgcttagacacaccatcgaaaattctacagccaacgtgagcctggctgccattgcgaaccaggccgtcgtgctgatgggactcgacaaaggctggccgatctccaagatggacctgggggtcccccttctggctctcggatgctactctcaggtgaatcctctgacgctgaccgccgctgttctccttctgatcacacattatgccattatcggccccgggctgcaggccaaagcgacccgggaggctcaaaagagaacagccgctggaattatgaagaaccctaccgtggatggcatcatgacgattgacctcgatcccgtcatctacgacagcaaattcgaaaagcagctgggccaggtgatgcttctggttctctgtgccgtgcagctgctgctcatgcgcacatcctgggccctttgcgaggctctgaccctggccaccgggcctatcacaaccctctgggaaggatctccgggcaaattttggaatacaacgattgcggtcagcatggccaacatcttccgggggtcctatctggctggagccggccttgcttttagcattatgaagtctgtggggaccggaaaaagaggcacaggctcccaaggggagaccctgggagaaaagtggaagaaaaagctcaatcagctgagccgcaaagatttcgacctgtacaagaaatccggcatcacagaggtggatcggaccgaggccaaggaagggctcaaaagaggagagattacgcaccatgcggtttctcggggcagcgccaaacttcagtggtttgtcgaacgcaacatggtgatccccgaggggagagtgattgacctgggatgtggccggggcgggtggtcctattactgcgctggactgaagaaagtcaccgaagttcgcggctatacaaaagggggacctggccacgaggagcccgtgcctatgtctacctacgggtggaatatcgtgaaactcatgagcggaaaggatgtcttctacctgcccccggaaaaatgtgacacacttctgtgcgatatcggcgagtccagcccttctcccaccgtggaagagtccagaacaattcgggttctcaagatggtggagccctggctgaagaacaatcagttctgtatcaaagtcctgaacccttatatgcccaccgtgattgaacacctcgagcgccttcaaagaaagcatggcgggatgctggttcggaatcctctgagccgcaactctacgcacgaaatgtactggatctccaatggaacaggcaacattgtggccagcgtcaatatggtgtctagactcctgcttaaccggtttaccatgacccatagacgcccgacaatcgagaaagacgtggatctgggggctggaacgcggcacgtcaacgccgaacccgagacccctaatatggacgttatcggcgagagaattaagcgcatcaaagaagaacacaacagcacatggcattatgacgatgaaaatccctacaagacctgggcttatcacgggtcctacgaggtgaaggccacaggatctgcgagctccatgattaacggcgtggtcaaactcctgaccaagccttgggacgtggttcccatggtgacacagatggccatgaccgatacgaccccgttcggccagcaacgggtctttaaagaaaaggtggacacaagaacccctcgcagcatgcccgggacacggagagttatgggaatcaccgctgagtggctgtggcgcacgctcggccggaataaaaagcctagactgtgcacacgcgaggagttcaccaagaaagtgcggacaaacgccgctatgggggccgtctttaccgaggaaaatcagtgggattccgccaaggcggctgtggaggacgaagatttctggaaacttgttgacagagagcgcgagctgcataagctcggaaaatgtggctcttgcgtgtataacatgatggggaagagagagaagaagctgggcgagtttggaaaggccaaaggcagccgggccatttggtacatgtggcttggggctcgctacctggagttcgaggccctcggatttctgaatgaggatcactggttctccagagaaaactcttatagcggcgtcgagggggaaggactgcataagctcggctacatcctgcgggacatctccaaaattcccgggggcgctatgtatgccgatgacacggcgggatgggacaccagaatcacagaggatgaccttcacaatgaagagaagattacccagcagatggatcctgagcaccggcaactggccaacgctatctttaaactcacataccagaataaggtggtcaaggtgcagcgccccaccccgacaggcaccgttatggacattatctctagaaaagatcagcgggggagcggacaagtgggcacgtatgggctgaacacattcaccaatatggaagcccagcttatccgccagatggagggagaaggcgtcctgtccaaggctgacctcgagaaccctcatctgcccgagaagaagattacccagtggctggagacaaaaggggtggagagactcaagcggatggccatcagcggcgatgactgcgtggttaagcccattgatgaccgctttgcgaacgccctgcttgctctgaatgatatgggaaaagtgagaaaggacatccctcaatggcagccgtctaaaggctggcacgattggcagcaggtccccttctgttcccatcacttccacgaactcattatgaaggacgggcggaaactggtggttccttgccgcccccaagacgagcttatcggacgggcccggattagccagggcgctgggtggtctctgaaggaaaccgcctgtctcggaaaggcttacgcccagatgtggtccctgatgtattttcatcgcagagatctgcggctcgcgagcaacgccatctgctctgctgtgcctgtccactgggtgcccacatcccgcacgacctggagcatccatgcccaccatcaatggatgacaaccgaggacatgctgacagtctggaatagagtgtggattgaagataacccttggatggaggacaaaacccccgttacgacctggggcaatgtgccgtaccttgggaagcgggaggatcagtggtgtggctccctgatcggactcacaagcagagccacctgggctcagaacattcctacagccatccagcaagtccgctctctgattggcaatgaagagttccttgactacatgcccagcatgaaacggtttagaaaggaagaggagtccgaaggggcgatctggtga

SEQ ID NO: 20554 - RNA, 9873 nt, synthetic construct
  misc_feature 1..9873: note = derived and/or modified CDS sequence (opt5) from DENV-3__HM631857__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgataccgcccatacgctgatcatgattggatccaatgctagcgacagaatgggcatgggggtcacatatctggcccttatcgcgacctttaaaatccagcccttcctggctctcggatttttcctgcggaagctcacatctagagaaaacctgcttctgggcgtggggctcgccatggccaccaccctgcaactgcctgaggatattgaacagatggctaatggaatcgcccttggcctgatggctctcaaactgattacacagtttgagacgtaccagctctggaccgccctgatctcccttacatgtagcaacaccattttcacactgaccgtggcgtggcgcacggccacactcatcctggctggcgtctccctgcttccggtttgccaatctagctccatgcggaagaccgactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattacaggaaccagcgccgatctgacagttgaaaaggccgctgacatcacgtgggaggaagaggccgaacagaccggcgtgtcccacaacctcatgattacagtcgacgatgacggcaccatgcggatcaaagatgacgagacagagaatatcctgaccgtgcttctgaagacggcgctgctcattgtcagcgggatctttccgtactctattcctgctaccctgcttgtgtggcatacatggcagaaacagacccaacgctccggagttctgtgggatgtgcccagccctcccgaaacacagaaggccgagctcgaagagggcgtctacagaatcaaacagcaggggattttcggaaagacccaagtgggcgttggggtgcagaaggagggagtctttcacacaatgtggcacgtgacgcggggcgccgtgctgacctataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagacaatgcctggcaccttccagaccacaacgggggaaatcggagctatcgccctggattttaagcccggcacctctggctcccccattatcaaccgggaggggaaagtcgtgggactgtatggcaatggggttgtgacaaagaacggaggctacgtcagcgggattgcccaaaccaatgctgagcctgacggcccgacacccgaactcgaggaagagatgttcaaaaagcgcaacctgaccatcatggatcttcatcctggatccggcaaaacgagaaagtatctgcccgccattgtgcgggaagctatcaagcgcagactccggacactgatcctcgcccctaccagagttgtggcggccgagatggaggaagctctgaaagggcttcccattcgctaccagaccacagccaccaagagcgagcacacaggacgggaaatcgctgacctgatgtgccatgccacctttacgatgagactgctctctcctgtccgcgtgccgaattataacctgattatcatggatgaggcccacttcacagaccccgctagcattgcggcccggggctacatctccaccagagttgggatgggagaagctgccgccatctttatgacagctacccctcccggcacggccgatgcgttccctcagtctaatgctcccattcaggacgaggagcgcgacatcccggaacggagctggaactccgggaatgagtggattaccgattttgccggcaaaacagtgtggttcgtcccttctatcaaggccggaaacgacattgctaactgtcttcgcaaaaatggcaagaaggtgatccaactgagcagaaaaacctttgatacagaataccagaagaccaaactcaacgactgggatttcgtggtcacaaccgacatttccgagatgggggccaattttaaggcggatcgggttatcgaccccagacggtgcctgaaacccgtgatcctgacggatggacctgagcgcgtgattctcgccggccccatgcctgtcacagctgcctctgctgcccagagacgggggcgcgtgggaagaaacccgcagaaggaaaatgaccaatatatcttcaccggccagccccttaacaatgatgaggaccatgctcactggaccgaagccaagatgctgctggacaacattaatacacctgaggggatcattcccgccctcttcgaacctgagcgggagaaaagcgccgctatcgatggcgaatacagactgaagggagagtcccgcaaaacctttgttgaacttatgcggagaggcgacctgcccgtgtggctcgcccacaaggtcgctagcgaggggatcaaatatacagatcgcaagtggtgcttcgacggacagcggaacaatcagattctggaagagaacatggatgtggagatctggacgaaagaaggcgagaagaagaaactgagaccgcgctggctcgacgcccggacctactctgatcctcttgccctgaaggaatttaaagagttcgctgcggggagaaagtccattgccctggacctcgttacagaaatcggacgcgtgcccagccatctggctcacagaacccggaatgcccttgataacctggtcatgctccatacatctgagcacggcggccgcgcctatagacacgctgtggaggaactgcctgagaccatggaaacgctgctccttctggggctgatgattctcctgaccggaggcgccatgctttttctgatctccgggaaaggaatcggcaagacaagcattgggctcatctgtgtcattgcgtcctctggaatgctgtggatggccgagatccccctgcaatggattgctagcgccatcgtgctcgagttctttatgatggttcttctgattcctgaacccgagaagcagcggaccccgcaggacaatcaactggcttacgtggtgatcggcatcctcacactggccgcggtcattgccgctaacgaaatgggccttctggagaccacgaaacgcgatctcgggatgtccaaggaacctggagttgtgagccccacatcttatctggacgtggatctgcatcccgcctccgcttggaccctctacgccgtcgctacaaccgtgatcacccctatgcttagacacacaattgagaatagcacggccaacgtttctctggcggccatcgctaaccaggccgtggtcctgatgggcctcgacaaagggtggccgattagcaagatggacctgggagtgccccttctggctctcggctgctactcccaggtcaatcctctgaccctgacagccgccgtgctccttctgatcacccattatgcgatcattgggcccggactgcaggctaaagccacacgggaggctcaaaagagaaccgccgccggcatcatgaagaaccctacggttgatggcattatgacaatcgacctcgatcccgtgatttacgactctaaattcgaaaagcagctggggcaggtcatgcttctggtgctctgtgctgttcagctgctgctcatgcgcaccagctgggccctttgcgaggcgctgaccctggccacaggacctatcaccacactctgggaaggctccccggggaaattttggaatacgaccatcgctgtgtctatggccaacattttccggggaagctatctggctggcgccgggcttgcgttttccatcatgaaaagcgtcggaacaggcaaaagaggcaccgggtctcaaggagagacactgggcgaaaagtggaagaaaaagctcaatcagctgtcccgcaaagatttcgacctgtacaagaaaagcgggattaccgaggtggatcggacggaggccaaggaaggactcaaaagaggcgagatcacccaccatgctgtgtcccgggggtctgccaaacttcagtggtttgttgaacgcaacatggtcattcccgagggaagagtgatcgacctgggctgtggcagagggggatggagctattactgcgctggcctgaagaaagtgacagaagtccgcgggtataccaagggaggccctgggcacgaggagcccgttcctatgtccacatacggatggaatattgtgaaactcatgtctggcaaggatgtgttctacctgcccccggaaaaatgtgacacccttctgtgcgatatcggcgagagctcccctagccccacagtcgaagagtctagaaccatccgggtgctcaagatggttgagccctggctgaagaacaatcagttctgtattaaagtgctgaacccttatatgcccacggtcatcgaacacctcgagcgccttcaaagaaagcatgggggaatgctggtgcggaatcctctgtcccgcaacagcacacacgaaatgtactggatttctaatggcaccgggaacatcgttgcctccgtgaatatggtcagcagactcctgcttaaccggtttaccatgacacatagacgcccgacgattgagaaagacgtggatctgggagctggcacccggcacgtgaacgtcgaacccgagacacctaatatggacgttatcggggagagaatcaagcgcattaaagaagaacacaactctacctggcattatgacgatgaaaatccctacaagacatgggcctatcacggaagctacgaggtgaaggcgaccggctccgcctctagcatgatcaacggcgtggtcaaactcctgacaaagccttgggacgtggttcccatggtgacccagatggctatgacggataccacaccgttcgggcagcaacgggtctttaaagaaaaggtggacaccagaacacctcgctccatgcccggaacccggagagttatgggcattacggccgagtggctgtggcgcacactcgggcggaataaaaagcctagactgtgcacccgcgaggagttcacaaagaaagtgcggaccaacgctgccatgggagccgtctttacggaggaaaatcagtgggatagcgcgaaggctgccgtggaggacgaagatttctggaaacttgttgacagagagcgcgagctgcataagctcggcaaatgtgggtcctgcgtgtataacatgatgggcaagagagagaagaagctgggagagtttggcaaggccaaagggtctcgggctatctggtacatgtggcttggagcccgctacctggagttcgaggctctcggctttctgaatgaggatcactggttcagcagagaaaactcctattctggggtcgagggagaaggcctgcataagctcgggtacattctgcgggacatcagcaaaatccccggcggagccatgtatgcggatgacaccgccggctgggacacaagaattaccgaggatgaccttcacaatgaagagaagatcacacagcagatggatcctgagcaccggcaactggctaacgccatttttaaactcacctaccagaataaggtggtcaaggtgcagcgccccacaccgaccgggacggttatggacatcatttccagaaaagatcagcggggatctggccaagtggggacatatggactgaacaccttcaccaatatggaagctcagcttatccgccagatggagggcgaaggggtcctgagcaaggccgacctcgagaaccctcatctgcccgagaaaaagatcacacagtggctggagaccaaaggcgtggagagactcaagcggatggcgatttccggagatgactgcgtggttaagcccatcgatgaccgctttgccaacgctctgcttgccctgaatgatatgggcaaagtgagaaaggacattcctcaatggcagccgagcaaagggtggcacgattggcagcaggtccccttctgttctcatcacttccacgaactcatcatgaaggacggacggaaactggtggttccttgccgcccccaagacgagcttattggcagagctcggatctcccagggggccggatggagcctgaaggaaacagcttgtctcggcaaggcctacgcgcagatgtggtctctgatgtattttcatcgcagagatctgcggctcgcctccaacgctatttgcagcgccgtgcctgtccactgggtgcccacgtctcgcaccacatggtccatccatgcccaccatcaatggatgaccacagaggacatgctgaccgtctggaatagagtgtggatcgaagataacccttggatggaggacaaaacgcccgttaccacatgggagaatgtgccgtaccttgggaagcgggaagatcagtggtgtggcagcctgattggactcacctccagagctacatgggcccagaacatccctaccgcgattcagcaagtccgcagcctgatcggcaatgaggagttccttgactacatgccctctatgaaacggtttagaaaggaggaggaaagcgagggggctatttggtga

SEQ ID NO: 20555 - RNA, 9873 nt, synthetic construct
  misc_feature 1..9873: note = derived and/or modified CDS sequence (opt5) from DENV-3__HM631860__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccaaggagctgaaatactcttggaagacctgggggaaggccaaaattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaagctgcgcgaagtgtacacacagctgtgtgaccaccggcttatgagcgcggccgtgaaagatgagagagctgtccacgccgacatggggtactggatcgagtcccagaagaacggatcttggaaactcgaaaaggccagcctgattgaggtgaagacctgcacctggcctaaatcccatacactgtggtctaatggcgttctcgaaagcgatatgatcattcccaagtccctggctgggcctatcagccagcacaaccatcgccccggatatcacacccaaacggccggcccttggcaccttgggaaactggagctcgactttaattactgcgagggaacaaccgtggtcattacagaaaactgtggcacccggggcccctctctgagaacaaccacggtgtccgggaagctgatccatgagtggtgctgtcgcagctgcacccttccgcctctccggtatatgggagaagatggctgttggtacgggatggagatcagacccatttctgaaaaagaggagaatatggttaagtccctggtgagcgcgggatctggcaaggtcgacaacttcacaatgggggtgctgtgcctcgctatcctgtttgaagaggttatgcggggaaaattcggcaagaaacacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaagatccagcccttcctggctctcggatttttcctgcggaaactcacctctagagaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacatatttcaccctgacagtcgcgtggcgcaccgccacgctcatcctggctggcgtttccctgcttccggtgtgccaatctagctccatgcggaagacagactggctgcccatggccgtggctgccatgggggtccctcccctccctctgtttattttctctctcaaagataccctgaagagacgcagctggccccttaatgagggagtgatggccgttggcctggtgtccatcctggcttctagcctcctgagaaacgacgtccctatggcggggccccttgtggccggaggcctgctcatcgcttgttacgttattaccgggacatccgccgatctgaccgtggaaaaagccgctgacatcacatgggaggaagaggccgaacagacgggagtcagccacaacctcatgattaccgtggacgatgacggcacaatgcggatcaaggatgacgagaccgagaatattctgacagtccttctgaaaaccgcgctgctcatcgtgtctggcatctttccgtactccattcctgctacgctgcttgtttggcatacctggcagaagcagacacaacgcagcggggtgctgtgggatgtcccctctcctcccgaaacccagaaagccgagctcgaagagggagtgtatagaatcaagcagcagggcattttcgggaagacacaagttggagtgggcgtccagaaagagggggtgtttcacaccatgtggcacgtgacacggggagccgttctgacgtacaacggcaagcgcctcgaaccgaattgggcttccgtcaaaaaggacctgatcagctatggcgggggatggagactttctgcccagtggcaaaaaggcgaggaagtgcaggtgattgcggtcgagcctgggaagaaccccaagaatttccagaccatgcctggaacattccagaccaccacaggcgaaatcggggctattgccctggattttaaacccggaacgtccggcagccccatcatcaaccgggagggcaaggtggttgggctgtacggaaatggcgtggtcaccaaaaacgggggatatgtgtccggcattgcccaaacaaatgctgagcctgacgggccgacccccgaactcgaggaagagatgttcaagaaacgcaacctgacaatcatggatcttcatcctggcagcggaaagaccagaaagtacctgcccgccattgttcgggaagctatcaaacgcagactccggacgctgattctcgcccctacaagagtggtcgcggccgagatggaggaagctctgaagggccttcccatccgctatcagaccaccgccacaaaatctgagcacaccgggcgggaaatcgtggacctgatgtgccatgctacatttaccatgagactgctcagccctgttcgcgtgccgaattacaacctgattatcatggatgaggcccacttcacggaccccgcctccattgctgcgcggggatacatctctacaagagtcggcatgggggaagccgctgccatttttatgaccgccacacctcccggaaccgctgatgccttccctcagagcaatgcgcccatccaggacgaggagcgcgacatcccggaacggtcctggaactctggcaatgagtggattacggattttgctgggaagaccgtgtggttcgtgcctagcatcaaagccggcaacgacattgccaactgtcttagaaagaatggaaagaaagtcatccaactgtcccgcaagacatttgataccgaatatcagaaaacaaagctcaacgactgggatttcgttgtgaccacagacatttctgagatgggcgctaattttaaagccgatcgggtgatcgaccccagacggtgcctgaagcccgtcattctgaccgatgggcctgagcgcgtgatcctcgcgggacccatgcctgttacggccgctagcgccgctcagagacggggccgcgtggggagaaacccgcagaaggaaaatgaccaatacatcttcacaggacagccccttaacaatgatgaggaccatgcccactggaccgaagctaaaatgctgctggacaacattaatacccctgagggcatcattcccgccctcttcgaacctgagcgggagaagtccgcggccatcgatggggaatatagactgaaaggcgagagccgcaagacatttgtcgaacttatgcggagaggagacctgcccgtgtggctcgctcacaaagttgcctctgagggcattaagtacaccgatcgcaaatggtgcttcgacgggcagcggaacaatcagatcctggaagagaacatggatgtggagatctggacaaaggaaggagagaagaaaaagctgagaccgcgctggctcgacgctcggacgtattccgatcctcttgccctgaaagaatttaaggagttcgccgctggcagaaaaagcattgcgctggacctcgtcaccgaaatcgggcgcgtgccctctcatctggcccacagaacacggaatgctcttgataacctggtcatgctccatacctccgagcacggaggccgcgcctacagacacgccgtggaggaactgcctgagacaatggaaaccctgctccttctgggcctgatgattctcctgacggggggagctatgctttttctgatcagcggcaaggggattggaaagacctccatcggcctcatctgtgttattgcctctagcgggatgctgtggatggcggagatccccctgcaatggattgcctccgctatcgtgctcgagttctttatgatggtgcttctgattcctgaacccgagaaacagcggacaccgcaggacaatcaactggcctatgtcgttatcggaattctcaccctggctgccatcatcgcggccaacgaaatgggccttctggagacaaccaagcgcgatctcggcatgagcaaagaacctggggtggtgtctcccacgtcctacctggacgtcgatctgcatcccgctagcgcctggacactctacgctgtggccaccacagttattacccctatgcttagacacaccatcgagaattctacagctaacgtgagcctggccgcgattgccaaccaggctgtcgtgctgatgggactcgacaagggctggccgatctccaaaatggacctgggggtcccccttctggccctcggatgctattctcaggtgaatcctctgacgctgaccgctgccgttctccttctgattacacattacgccatcatcggccccgggctgcaggcgaaggctacccgggaggcccaaaagagaacagctgccggaattatgaaaaaccctaccgtggatggcatcatgacgattgacctcgatcccgtcatctatgacagcaagttcgaaaaacagctgggccaggtgatgcttctggttctctgtgccgtgcagctgctgctcatgcgcacatcctgggctctttgcgaggccctgaccctggcgaccgggcctattacaaccctctgggaaggatctccgggcaagttttggaatacaacgatcgccgtcagcatggctaacatcttccgggggtcctacctggccggagctggccttgcctttagcattatgaaatctgtggggaccggaaagagaggcacaggctcccaaggggagaccctgggagaaaagtggaaaaagaaactcaatcagctgagccgcaaggatttcgacctgtataaaaagtccggcatcacagaggtggatcggaccgaggcgaaagaagggctcaagagaggagagattacgcaccatgccgtttctcggggcagcgctaagcttcagtggtttgtcgaacgcaacatggtgatccccgaggggagagtgattgacctgggatgtggccggggcgggtggtcctactattgcgccggactgaaaaaggtcaccgaagttcgcggctacacaaaagggggacctggccacgaggagcccgtgcctatgtctacctacgggtggaatatcgtgaagctcatgagcggaaaagatgtcttctatctgcccccggaaaagtgtgacacacttctgtgcgatattggcgagtccagcccttctcccaccgtggaagagtccagaacaatccgggttctcaagatggtggagccctggctgaaaaacaatcagttctgtatcaaggtcctgaacccttacatgcccaccgtgattgaacacctcgagcgccttcaaagaaaacatggcgggatgctggttcggaatcctctgagccgcaactctacgcacgaaatgtattggatctccaatggaacaggcaacattgtggctagcgtcaatatggtgtctagactcctgcttaaccggtttaccatgacccatagacgcccgacaatcgagaaggacgtggatctgggggccggaacgcggcacgtcaacgctgaacccgagacccctaatatggacgttattggcgagagaatcaaacgcatcaaggaagagcacaacagcacatggcattacgacgatgaaaatccctataagacctgggcctaccacgggtcctatgaggtgaaagcgacaggatctgccagctccatgattaacggcgtggtcaagctcctgaccaaaccttgggacgtggttcccatggtgacacagatggctatgaccgatacgaccccgttcggccagcaacgggtctttaaggaaaaagtggacacaagaacccctcgcagcatgcccgggacacggagagttatgggaatcaccgccgagtggctgtggcgcacgctcggccggaataagaagcctagactgtgcacacgcgaggaattcaccaaaaaggtgcggacaaacgctgccatgggggccgtctttaccgaggaaaatcagtgggattccgcgaaagctgccgtggaggacgaagatttctggaagcttgttgacagagagcgcgagctgcataaactcggaaagtgtggctcttgcgtgtacaacatgatggggaaaagagaaaagaagctgggcgagtttggaaaagccaagggcagccgggctatttggtacatgtggcttggggcccgctatctggaattcgaggctctcggatttctgaatgaggatcactggttctccagagaaaactcttacagcggcgtcgagggggaaggactgcataaactcggctatatcctgcgggacatttccaagatccccgggggcgccatgtacgcggatgacacggccggatgggacaccagaatcacagaggatgaccttcacaatgaagagaaaattacccagcagatggatcctgagcaccggcaactggctaacgccatctttaagctcacatatcagaataaggtggtcaaagtgcagcgccccaccccgacaggcaccgttatggacattatctctagaaaggatcagcgggggagcggacaagtgggcacgtacgggctgaacacattcaccaatatggaagctcagcttattcgccagatggagggagaaggcgtcctgtccaaagccgacctcgagaaccctcatctgcccgaaaagaaaatcacccagtggctggagacaaagggggtggagagactcaagcggatggcgatcagcggcgatgactgcgtggttaaacccattgatgaccgctttgccaacgctctgcttgccctgaatgatatgggaaaggtgagaaaagacatccctcaatggcagccgtctaagggctggcacgattggcagcaggtccccttctgttcccatcacttccacgaactcattatgaaagacgggcggaagctggtggttccttgccgcccccaagacgagcttatcggaagagctcggattagccagggcgccgggtggtctctgaaggaaaccgcttgtctcggaaaagcctatgcgcagatgtggtccctgatgtactttcatcgcagagatctgcggctcgccagcaacgctatctgctctgccgtgcctgtccactgggtgcccacatcccgcacgacctggagcattcatgcccaccatcaatggatgacaaccgaggacatgctgacagtctggaatagagtgtggatcgaagataacccttggatggaggacaagacccccgttacgacctgggagaatgtgccgtaccttggcaaacgggaagatcagtggtgtgggtccctgatcggcctcacaagcagagctacctgggcccagaacattcctacagcgatccagcaagtccgctctctgattggaaatgaggaattccttgactatatgcccagcatgaagcggtttagaaaagaggaggaatccgagggcgctatctggtga

SEQ ID NO: 20556 - RNA, 9873 nt, synthetic construct
  misc_feature 1..9873: note = derived and/or modified CDS sequence (opt5) from DENV-3__HM181977__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccaaggagctgaaatactcttggaagacctgggggaaggccaaaattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaagctgcgcgaagtgtacacacagctgtgtgaccaccggcttatgagcgcggccgtgaaagatgagagagctgtccacgccgacatggggtactggatcgagtcccagaagaacggatcttggaaactcgaaaaggccagcctgattgaggtgaagacctgcacctggcctaaatcccatacactgtggtctaatggcgttctcgaaagcgatatgatcattcccaagtccctggctgggcctatcagccagcacaaccatcgccccggatatcacacccaaacggccggcccttggcaccttgggaaactggagctcgactttaattactgcgagggaacaaccgtggtcattacagaaaactgtggcacccggggcccctctctgagaacaaccacggtgtccgggaagctgatccatgagtggtgctgtcgcagctgcacccttccgcctctccggtatatgggagaagatggctgttggtacgggatggagatcagacccatttctgaaaaagaggagaatatggttaagtccctggtgagcgcgggatctggcaaggtcgacaacttcacaatgggggtgctgtgcctcgctatcctgtttgaagaggttatgcggggaaaattcggcaagaaacacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaagatccagcccttcctggctctcggatttttcctgcggaaactcacctctagagaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacaatcttcaccctgacagtcgcgtggcgcaccgccacgctcattctggctggcgtttccctgcttccggtgtgccaatctagctccatgcggaagacagactggctgcccatggccgtggctgccatgggggtccctcccctccctctgtttatcttctctctcaaagataccctgaagagacgcagctggccccttaatgagggagtgatggccgttggcctggtgtccatcctggcttctagcctcctgagaaacgacgtccctatggcggggccccttgtggccggaggcctgctcattgcttgttatgttatcaccgggacatccgccgatctgaccgtggaaaaagccgctgacattacatgggaggaagaggccgaacagacgggagtcagccacaacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcatacctggcagaagcagacacaacgcagcggggtgctgtgggatgtcccctctcctcccgaaacccagaaagccgagctcgaagagggagtgtacagaattaagcagcagggcatcttcgggaagacacaagttggagtgggcgtccagaaagagggggtgtttcacaccatgtggcacgtgacacggggagccgttctgacgtataacggcaagcgcctcgaaccgaattgggcttccgtcaaaaaggacctgattagctacggcgggggatggagactttctgcccagtggcaaaaaggcgaggaagtgcaggtgatcgcggtcgagcctgggaagaaccccaagaatttccagaccatgcctggaacattccagaccaccacaggcgaaattggggctatcgccctggattttaaacccggaacgtccggcagccccatcattaaccgggagggcaaggtggttgggctgtatggaaatggcgtggtcaccaaaaacgggggatacgtgtccggcatcgcccaaacaaatgctgagcctgacgggccgacccccgaactcgaggaagagatgttcaagaaacgcaacctgacaattatggatcttcatcctggcagcggaaagaccagaaagtatctgcccgccatcgttcgggaagctattaaacgcagactccggacgctgatcctcgcccctacaagagtggtcgcggccgagatggaggaagctctgaagggccttcccatccgctaccagaccaccgccacaaaatctgagcacaccgggcgggaaattgtggacctgatgtgccatgctacatttaccatgagactgctcagccctgttcgcgtgccgaattataacctgatcattatggatgaggcccacttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaagaccgtgtggttcgtgcctagcattaaagccggcaacgacatcgccaactgtcttagaaagaatggaaagaaagtcattcaactgtcccgcaagacatttgataccgaataccagaaaacaaagctcaacgactgggatttcgttgtgaccacagacatctctgagatgggcgctaattttaaagccgatcgggtgattgaccccagacggtgcctgaagcccgtcatcctgaccgatgggcctgagcgcgtgatcctcgcgggacccatgcctgttacggccgctagcgccgctcagagacggggccgcgtggggagaaacccgcagaaggaaaatgaccaatatattttcacaggacagccccttaacaatgatgaggaccatgcccactggaccgaagctaaaatgctgctggacaacatcaatacccctgagggcattatccccgccctcttcgaacctgagcgggagaagtccgcggccattgatggggaatacagactgaaaggcgagagccgcaagacatttgtcgaacttatgcggagaggagacctgcccgtgtggctcgctcacaaagttgcctctgagggcatcaagtataccgatcgcaaatggtgcttcgacgggcagcggaacaatcagatcctggaagagaacatggatgtggagatttggacaaaggaaggagagaagaaaaagctgagaccgcgctggctcgacgctcggacgtactccgatcctcttgccctgaaagaatttaaggagttcgccgctggcagaaaaagcatcgcgctggacctcgtcaccgaaattgggcgcgtgccctctcatctggcccacagaacacggaatgctcttgataacctggtcatgctccatacctccgagcacggaggccgcgcctatagacacgccgtggaggaactgcctgagacaatggaaaccctgctccttctgggcctgatgatcctcctgacggggggagctatgctttttctgattagcggcaaggggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaaacagcggacaccgcaggacaatcaactggcctacgtcgttattggaatcctcaccctggctgccatcattgcggccaacgaaatgggccttctggagacaaccaagcgcgatctcggcatgagcaaagaacctggggtggtgtctcccacgtcctatctggacgtcgatctgcatcccgctagcgcctggacactctacgctgtggccaccacagttatcacccctatgcttagacacaccattgagaattctacagctaacgtgagcctggccgcgatcgccaaccaggctgtcgtgctgatgggactcgacaagggctggccgatttccaaaatggacctgggggtcccccttctggccctcggatgctactctcaggtgaatcctctgacgctgaccgctgccgttctccttctgatcacacattatgccatcattggccccgggctgcaggcgaaggctacccgggaggcccaaaagagaacagctgccggaatcatgaaaaaccctaccgtggatggcattatgacgatcgacctcgatcccgtcatttacgacagcaagttcgaaaaacagctgggccaggtgatgcttctggttctctgtgccgtgcagctgctgctcatgcgcacatcctgggctctttgcgaggccctgaccctggcgaccgggcctatcacaaccctctgggaaggatctccgggcaagttttggaatacaacgatcgccgtcagcatggctaacattttccgggggtcctatctggccggagctggccttgcctttagcatcatgaaatctgtggggaccggaaagagaggcacaggctcccaaggggagaccctgggagaaaagtggaaaaagaaactcaatcagctgagccgcaaggatttcgacctgtacaaaaagtccggcattacagaggtggatcggaccgaggcgaaagaagggctcaagagaggagagatcacgcaccatgccgtttctcggggcagcgctaagcttcagtggtttgtcgaacgcaacatggtgattcccgaggggagagtgatcgacctgggatgtggccggggcgggtggtcctattactgcgccggactgaaaaaggtcaccgaagttcgcggctatacaaaagggggacctggccacgaggagcccgtgcctatgtctacctacgggtggaatattgtgaagctcatgagcggaaaagatgtcttctacctgcccccggaaaagtgtgacacacttctgtgcgatatcggcgagtccagcccttctcccaccgtggaagagtccagaacaatccgggttctcaagatggtggagccctggctgaaaaacaatcagttctgtattaaggtcctgaacccttatatgcccaccgtgatcgaacacctcgagcgccttcaaagaaaacatggcgggatgctggttcggaatcctctgagccgcaactctacgcacgaaatgtactggatttccaatggaacaggcaacatcgtggctagcgtcaatatggtgtctagactcctgcttaaccggtttaccatgacccatagacgcccgacaattgagaaggacgtggatctgggggccggaacgcggcacgtcaacgctgaacccgagacccctaatatggacgttatcggcgagagaatcaaacgcattaaggaagagcacaacagcacatggcattatgacgatgaaaatccctacaagacctgggcctatcacgggtcctacgaggtgaaagcgacaggatctgccagctccatgatcaacggcgtggtcaagctcctgaccaaaccttgggacgtggttcccatggtgacacagatggctatgaccgatacgaccccgttcggccagcaacgggtctttaaggaaaaagtggacacaagaacccctcgcagcatgcccgggacacggagagttatgggaattaccgccgagtggctgtggcgcacgctcggccggaataagaagcctagactgtgcacacgcgaggaattcaccaaaaaggtgcggacaaacgctgccatgggggccgtctttaccgaggaaaatcagtgggattccgcgaaagctgccgtggaggacgaagatttctggaagcttgttgacagagagcgcgagctgcataaactcggaaagtgtggctcttgcgtgtataacatgatggggaaaagagaaaagaagctgggcgagtttggaaaagccaagggcagccgggctatctggtacatgtggcttggggcccgctacctggaattcgaggctctcggatttctgaatgaggatcactggttctccagagaaaactcttatagcggcgtcgagggggaaggactgcataaactcggctacattctgcgggacatctccaagatccccgggggcgccatgtatgcggatgacacggccggatgggacaccagaattacagaggatgaccttcacaatgaagagaaaatcacccagcagatggatcctgagcaccggcaactggctaacgccatttttaagctcacataccagaataaggtggtcaaagtgcagcgccccaccccgacaggcaccgttatggacatcatttctagaaaggatcagcgggggagcggacaagtgggcacgtatgggctgaacacattcaccaatatggaagctcagcttatccgccagatggagggagaaggcgtcctgtccaaagccgacctcgagaaccctcatctgcccgaaaagaaaatcacccagtggctggagacaaagggggtggagagactcaagcggatggcgattagcggcgatgactgcgtggttaaacccatcgatgaccgctttgccaacgctctgcttgccctgaatgatatgggaaaggtgagaaaagacattcctcaatggcagccgtctaagggctggcacgattggcagcaggtccccttctgttcccatcacttccacgaactcatcatgaaagacgggcggaagctggtggttccttgccgcccccaagacgagcttattggaagagctcggatcagccagggcgccgggtggtctctgaaggaaaccgcttgtctcggaaaagcctacgcgcagatgtggtccctgatgtattttcatcgcagagatctgcggctcgccagcaacgctatttgctctgccgtgcctgtccactgggtgcccacatcccgcacgacctggagcatccatgcccaccatcaatggatgacaaccgaggacatgctgacagtctggaatagagtgtggatcgaagataacccttggatggaggacaagacccccgttacgacctgggagaatgtgccgtaccttggcaaacgggaagatcagtggtgtgggtccctgattggcctcacaagcagagctacctgggcccagaacatccctacagcgattcagcaagtccgctctctgatcggaaatgaggaattccttgactacatgcccagcatgaagcggtttagaaaagaggaggaatccgagggcgctatttggtga

SEQ ID NO: 20557 - RNA, 9873 nt, synthetic construct
  misc_feature 1..9873: note = derived and/or modified CDS sequence (opt5) from DENV-3__HM181978__SS-prME
  source 1..9873: mol_type = other RNA
accagcctgtgcctcatgatgatcctgcccgccgctcttgccttccacctgacatcccgggacggagaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccagcgcttctgacagaatgggcatgggggtcacgtatctggcccttatcgcgacatttaaaatccagcccttcctggctctcggatttttcctgcggaagctcacctccagagaaaatctgcttctgggcgtggggctcgccatggccacaaccctgcaactgcctgaggatattgaacagatggctaacggaatcgcccttggcctgatggctctcaaactgattacccagtttgagacataccagctctggacggccctgatcagccttacctgttccaatacaattttcaccctgacagtggcgtggcgcaccgccacgctcatcctggctggcgtctctctgcttccggtttgccaaagctcctctatgcggaagacagactggctgcccatggccgtggctgccatgggggtgcctcccctccctctgtttatcttcggactcaaggataccctgaaaagacgcagctggccccttaacgagggcgtcatggccgtggggctggtttccattctggcttctagcctcctgagaaatgacgtgcctatggcgggaccccttgtcgccggcgggctgctcatcgcttgttatgtgattaccggaacatccgccgatctgaccgttgaaaaggccgctgacatcacatgggaggaagaggccgaacagacgggcgtgagccacaacctcatgattaccgtcgacgatgacggcacaatgcggatcaaagatgacgagaccgagaacatcctgacagtgcttctgaagaccgcgctgctcattgtctctgggatctttccgtactccattcctgctacgctgcttgtgtggcatacctggcagaaacagacacaacgcagcggagttctgtgggatgtgccctctcctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataatggcaaacgcctcgaaccgaactgggcttccgttaagaaagacctgatcagctacgggggaggctggagactttctgcccagtggcaaaagggggaggaagtccaggtgattgcggtggagcctggcaagaatcccaagaacttccagaccatgcctggcacattccagaccaccacaggggaaatcggagctatcgccctggattttaagcccggcacgtccggcagccccattatcaatcgggaggggaaagtcgtgggactgtatggcaacggggttgtgaccaagaatggaggctacgtctccgggattgcccaaacaaacgctgagcctgacggcccgacccccgaactcgaggaagagatgttcaaaaagcgcaatctgacaatcatggatcttcatcctggaagcggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagtctgagcacaccggacgggaaatcgtcgacctgatgtgccatgctacatttaccatgagactgctcagccctgtgcgcgttccgaactataatctgattatcatggatgaggcccacttcacggaccccgcctccattgctgcgcggggctacatctctacaagagtggggatgggagaagccgctgccatctttatgaccgccacacctcccggcaccgctgatgccttccctcagagcaacgcgcccattcaggacgaggagcgcgacatcccggaacggtcctggaactctgggaacgagtggattacggattttgctggcaaaaccgtctggttcgtgcctagcatcaaggccggaaatgacattgccaactgtcttcgcaaaaacggcaagaaggtgatccaactgtccagaaaaacatttgataccgaataccagaagacaaaactcaatgactgggatttcgtcgttaccacagacatttctgagatgggggctaactttaaggccgatcgggtgatcgaccccagacggtgcctgaaacccgtgatcctgaccgatggacctgagcgcgtcattctcgcgggccccatgcctgtgacggccgctagcgccgctcagagacgggggcgcgttggaagaaatccgcagaaggaaaacgaccaatatatcttcacaggccagccccttaataacgatgaggaccatgcccactggaccgaagctaagatgctgctggacaatattaacacccctgaggggatcattcccgccctcttcgaacctgagcgggagaaatccgcggccatcgatggcgaatacagactgaagggagagagccgcaaaacatttgtggaacttatgcggagaggcgacctgcccgtctggctcgctcacaaggtggcctctgaggggatcaaatataccgatcgcaagtggtgcttcgacggacagcggaataaccagattctggaagagaatatggatgttgagatctggacaaaagaaggcgagaagaagaaactgagaccgcgctggctcgacgctcggacgtactccgatcctcttgccctgaaggaatttaaagagttcgccgctgggagaaagagcattgcgctggacctcgtgaccgaaatcggacgcgtcccctctcatctggcccacagaacacggaacgctcttgataatctggtgatgctccatacctccgagcacggcggccgcgcctatagacacgccgtcgaggaactgcctgagacaatggaaaccctgctccttctggggctgatgattctcctgacgggaggcgctatgctttttctgatcagcgggaaaggaatcggcaagacctccattgggctcatctgtgtgattgcctctagcggaatgctgtggatggcggagatccccctgcaatggattgcctccgctatcgttctcgagttctttatgatggtgcttctgattcctgaacccgagaagcagcggacaccgcaggacaaccaactggcctacgtggtcatcggcatcctcaccctggctgccattatcgcggccaatgaaatgggccttctggagacaaccaaacgcgatctcgggatgagcaaggaacctggagttgtgtctcccacgtcctatctggacgtggatctgcatcccgctagcgcctggacactctacgctgtcgccaccacagtgattacccctatgcttagacacaccatcgagaactctacagctaatgttagcctggccgcgattgccaaccaggctgtggtcctgatgggcctcgacaaagggtggccgatctccaagatggacctgggagtgccccttctggccctcggctgctactctcaggtcaaccctctgacgctgaccgctgccgtgctccttctgatcacacattatgccattatcgggcccggactgcaggcgaaagctacccgggaggcccaaaagagaacagctgccggcattatgaagaatcctaccgttgatggcatcatgacgattgacctcgatcccgtgatctacgacagcaaattcgaaaagcagctggggcaggtcatgcttctggtgctctgtgccgttcagctgctgctcatgcgcacatcctgggctctttgcgaggccctgaccctggcgaccggacctatcacaaccctctgggaaggctctccggggaaattttggaacacaacgattgccgtgagcatggctaatatcttccggggatcctatctggccggcgctgggcttgcctttagcattatgaagtctgtcggaaccggcaaaagaggcacagggtcccaaggagagaccctgggcgaaaagtggaagaaaaagctcaaccagctgagccgcaaagatttcgacctgtacaagaaatccgggatcacagaggtggatcggaccgaggcgaaggaaggactcaaaagaggcgagattacgcaccatgccgtgtctcgggggagcgctaaacttcagtggtttgttgaacgcaatatggtcatccccgagggaagagtgattgacctgggctgtggcagagggggatggtcctattactgcgccggcctgaagaaagtgaccgaagtccgcgggtatacaaagggaggccctgggcacgaggagcccgttcctatgtctacctacggatggaacatcgtgaaactcatgagcggcaaggatgtgttctacctgcccccggaaaaatgtgacacacttctgtgcgatatcggcgagtccagcccttctcccaccgtcgaagagtccagaacaattcgggtgctcaagatggttgagccctggctgaagaataaccagttctgtatcaaagtgctgaatccttatatgcccaccgtcattgaacacctcgagcgccttcaaagaaagcatgggggaatgctggtgcggaaccctctgagccgcaattctacgcacgaaatgtactggatctccaacggcacagggaatattgttgctagcgtgaacatggtctctagactcctgcttaatcggtttaccatgacccatagacgcccgacaatcgagaaagacgtggatctgggagccggcacgcggcacgtgaacgctgaacccgagacccctaacatggacgtcatcggggagagaattaagcgcatcaaagaagaacacaatagcacatggcattatgacgatgaaaacccctacaagacctgggcctatcacggatcctacgaggttaaggcgacaggctctgccagctccatgattaatggcgtggtgaaactcctgaccaagccttgggacgtcgtgcccatggttacacagatggctatgaccgatacgaccccgttcgggcagcaacgggtgtttaaagaaaaggtcgacacaagaacccctcgcagcatgcccggaacacggagagtgatgggcatcaccgccgagtggctgtggcgcacgctcgggcggaacaaaaagcctagactgtgcacacgcgaggagttcaccaagaaagttcggacaaatgctgccatgggagccgtgtttaccgaggaaaaccagtgggattccgcgaaggctgccgtcgaggacgaagatttctggaaacttgtggacagagagcgcgagctgcataagctcggcaaatgtgggtcttgcgtttataatatgatgggcaagagagagaaaaagctgggagagtttggcaaggccaaagggagccgggctatttggtacatgtggcttggagcccgctacctggagttcgaggctctcggctttctgaacgaggatcactggttctccagagaaaattcttatagcggggtggagggagaaggcctgcataagctcgggtacatcctgcgggacatctccaaaattcccggcggagccatgtatgcggatgacacggccggctgggacaccagaatcacagaggatgaccttcacaacgaagagaagattacccagcagatggatcctgagcaccggcaactggctaatgccatctttaaactcacataccagaacaaggtcgtgaaggtccagcgccccaccccgacagggaccgtgatggacattatctctagaaaagatcagcggggaagcggccaagttgggacgtatggactgaatacattcaccaacatggaagctcagcttatccgccagatggagggcgaaggggtgctgtccaaggccgacctcgagaatcctcatctgcccgagaaaaagattacccagtggctggagacaaaaggcgtcgagagactcaagcggatggcgatcagcggagatgactgcgtggtgaagcccattgatgaccgctttgccaacgctctgcttgccctgaacgatatgggcaaagttagaaaggacatccctcaatggcagccgtctaaagggtggcacgattggcaacaggtgcccttctgttcccatcacttccacgaactcattatgaaggacggacggaaactggtcgtgccttgccgcccccaagacgagcttatcggcagagctcggattagccagggggccggatggtctctgaaggaaaccgcttgtctcggcaaggcctacgcgcagatgtggtccctgatgtattttcatcgcagagatctgcggctcgccagcaatgctatctgctctgccgttcctgtgcactgggtccccacatcccgcacgacctggagcatccatgcccaccatcaatggatgacaaccgaggacatgctgacagtgtggaacagagtctggattgaagataatccttggatggaggacaaaacccccgtgacgacctgggagaacgttccgtaccttgggaagcgggaagatcagtggtgtggctccctgatcggactcacaagcagagctacctgggcccagaatattcctacagcgatccagcaagtgcgctctctgattggcaacgaggagttccttgactacatgcccagcatgaaacggtttagaaaggaggaggaatccgagggggctatctggtga

SEQ ID NO: 20558 - RNA, 9873 nt, synthetic construct
  misc_feature 1..9873: note = derived and/or modified CDS sequence (opt5) from DENV-3__JN183884__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgaaaatgaagaacaaagcctggatggtgcatagacagtggtttttcgatctccccctgccgtggacaagcggcgccaccacagaaacccctacgtggaatcggaaggagcttctggtcacatttaaaaacgctcacgcgaagaagcaagaagtggtcgtgctcgggtctcaggagggagccatgcacaccgctctgacaggcgccaccgaaatccagaattccgggggcaccagcattttcgccggacatctgaaatgtcgcctcaagatggacaaactggagcttaagggcatgtcttacgctatgtgcacaaacacgtttgttctgaaaaaggaggtgtccgaaacccagcacgggacaatcctcatcaaggtcgagtacaaaggagaagatgtgccctgtaagattcctttcagcaccgaggacggccaagggaaagcccataacggaagactgatcacagcgaatcccgttgtgaccaagaaagaggaacccgtcaacattgaggctgaacctccgttcggcgagtccaatatcgtgattgggatcggcgataacgccctgaagatcaattggtataagaaaggatctagcattggcaagatgtttgaagccacggctcggggggccagacgcatggctatccttggagacacagcctgggatttcggctccgtggggggagttctcaacagcctgggcaaaatggtccaccagatttttgggtctgcgtacaccgccctgttctccggcgtgagctgggtgatgaagatcggaattggcgtcctcctgacctggatcgggcttaattctaaaaacacaagcatgtccttttcttgcattgctatcggaatcattaccctgtatctcggcgccgtggttcaggctgacatggggtgtgtgatcaattggaagggaaaggagctgaaatgcggcagcgggattttcgtcacaaacgaggtgcatacgtggaccgaacagtacaagtttcaagccgattcccccaaacggctggcgacagccatcgctggcgcctgggagaatggagtttgtggcattagaagcaccacacgcatggaaaaccttctctggaagcagatcgctaatgagctgaactatatcctgtgggaaaataacattaaactcaccgtggtcgtgggggacatcattggagttctggagcagggcaagcggacgcttacccctcagcccatggagctgaaatactcttggaagacatgggggaaggccaaaatcgtgaccgccgaaacacaaaactccagcttcattatcgatggacctaatacccccgagtgcccgtctgtctccagagcttggaacgtgtgggaagtggaggactatggctttggcgtcttcacaaccaatatctggctcaagctgcgcgaagtttacacgcagctgtgtgaccaccggcttatgagcgcggccgtgaaagatgagagagctgtgcacgccgacatggggtactggattgagtcccagaagaacggatcttggaaactcgaaaaggccagcctgatcgaggtcaagacatgcacctggcctaaatcccataccctgtggtctaatggcgtgctcgaaagcgatatgattatccccaagtccctggctgggcctattagccagcacaaccatcgccccggatatcacacacaaaccgccggcccttggcaccttgggaaactggagctcgactttaattactgcgagggaacgacagttgtgatcaccgaaaactgtggcacacggggcccctctctgagaaccacaaccgtctccgggaagctgatccatgagtggtgctgtcgcagctgcacgcttccgcctctccggtatatgggagaagatggctgttggtacgggatggagattagacccatctctgaaaaagaggagaatatggtgaagtccctggttagcgcgggatctggcaaggtggacaacttcaccatgggggtcctgtgcctcgctattctgtttgaagaggtgatgcggggaaaattcggcaagaaacacatgatcgccggcgttttctttacattcgtgcttctgctcagcgggcagattacctggcgcgatatggcccatacactgatcatgattggatccaatgctagcgacagaatgggcatgggggtcacctatctggcccttatcgcgacgtttaagatccagcccttcctggctctcggatttttcctgcggaaactcacatctagagaaaacctgcttctgggcgtggggctcgccatggccaccacactgcaactgcctgaggatattgaacagatggctaatggaatcgcccttggcctgatggctctcaagctgattacccagtttgagacctaccagctctggacagccctgatctcccttacgtgtagcaacaccattttcacactgaccgtggcgtggcgcacagccaccctcatcctggctggcgtctccctgcttccggtttgccaatctagctccatgcggaagacggactggctgcccatggccgtggctgccatgggggtgcctcccctccctctgtttatcttcggactcaaagatacactgaagagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaaccagcgccgatctgacagttgaaaaagccgctgacatcacctgggaggaagaggccgaacagacaggcgtgtcccacaacctcatgattacggtcgacgatgacggcaccatgcggatcaaggatgacgagacagagaatatcctgaccgtgcttctgaaaacagcgctgctcattgtcagcgggatctttccgtactctattcctgctaccctgcttgtgtggcatacgtggcagaagcagacccaacgctccggagttctgtgggatgtgcccagccctcccgaaacacagaaagccgagctcgaagagggcgtctacagaatcaagcagcaggggattttcggaaagacccaagtgggcgttggggtgcagaaagagggagtctttcacacaatgtggcacgtgacccggggcgccgtgctgacatataacggcaagcgcctcgaaccgaattgggcttctgttaaaaaggacctgatctcctacgggggaggctggagacttagcgcccagtggcaaaaaggggaggaagtccaggtgattgcggtggagcctggaaagaaccccaagaatttccagacgatgcctggcaccttccagacaaccaccggggaaatcggagctatcgccctggattttaaacccggcacatctggctcccccattatcaaccgggaggggaaggtcgtgggactgtatggcaatggggttgtgacgaaaaacggaggctacgtcagcgggattgcccaaaccaatgctgagcctgacggcccgacacccgaactcgaggaagagatgttcaagaaacgcaacctgaccatcatggatcttcatcctggatccggcaagacaagaaagtatctgcccgccattgtgcgggaagctatcaaacgcagactccggaccctgatcctcgcccctacgagagttgtggcggccgagatggaggaagctctgaaggggcttcccattcgctaccagacaaccgccaccaaaagcgagcacacaggacgggaaatcgtcgacctgatgtgccatgctacctttacaatgagactgctctctcctgtgcgcgttccgaattataacctgattatcatggatgaggcccacttcaccgaccccgccagcattgctgcgcggggctacatctccacgagagtggggatgggagaagccgctgccatctttatgacagccacccctcccggcacagctgatgccttccctcagtctaatgcgcccattcaggacgaggagcgcgacatcccggaacggagctggaactccgggaatgagtggattaccgattttgctggcaagacggtctggttcgtgccttctatcaaagccggaaacgacattgccaactgtcttagaaagaatggcaagaaagtgatccaactgagccgcaagacctttgatacagaataccagaaaaccaagctcaacgactgggatttcgtcgttacaaccgacatttccgagatgggggctaattttaaagccgatcgggtgatcgaccccagacggtgcctgaagcccgtgatcctgacagatggacctgagcgcgtcattctcgcgggccccatgcctgtgaccgccgcttctgccgctcagagacgggggcgcgttggaagaaacccgcagaaggaaaatgaccaatatatcttcacgggccagccccttaacaatgatgaggaccatgcccactggacagaagctaaaatgctgctggacaacattaatacccctgaggggatcattcccgccctcttcgaacctgagcgggagaagagcgcggccatcgatggcgaatacagactgaaaggagagtcccgcaagacctttgtggaacttatgcggagaggcgacctgcccgtctggctcgctcacaaagtggccagcgaggggatcaagtatacagatcgcaaatggtgcttcgacggacagcggaacaatcagattctggaagagaacatggatgttgagatctggaccaaggaaggcgagaagaaaaagctgagaccgcgctggctcgacgctcggacatactctgatcctcttgccctgaaagaatttaaggagttcgccgctgggagaaaatccattgcgctggacctcgtgacggaaatcggacgcgtccccagccatctggcccacagaacccggaatgctcttgataacctggtgatgctccatacatctgagcacggcggccgcgcctatagacacgccgtcgaggaactgcctgagaccatggaaacactgctccttctggggctgatgattctcctgaccggaggcgctatgctttttctgatctccgggaagggaatcggcaagacgagcattgggctcatctgtgtgattgcctcctctggaatgctgtggatggcggagatccccctgcaatggattgccagcgctatcgttctcgagttctttatgatggtgcttctgattcctgaacccgagaaacagcggaccccgcaggacaatcaactggcctacgtggtcatcggcatcctcacactggctgccattatcgcggccaacgaaatgggccttctggagaccacaaagcgcgatctcgggatgtccaaagaacctggagttgtgagccccacctcttatctggacgtggatctgcatcccgcttccgcctggacgctctacgctgtcgccacaaccgtgattacacctatgcttagacacaccatcgagaatagcaccgctaacgtttctctggccgcgattgccaaccaggctgtggtcctgatgggcctcgacaaggggtggccgatcagcaaaatggacctgggagtgccccttctggccctcggctgctactcccaggtcaatcctctgacactgacggctgccgtgctccttctgatcacccattatgccattatcgggcccggactgcaggcgaaggctacacgggaggcccaaaagagaaccgctgccggcattatgaaaaaccctacagttgatggcatcatgaccattgacctcgatcccgtgatctacgactctaagttcgaaaaacagctggggcaggtcatgcttctggtgctctgtgccgttcagctgctgctcatgcgcacgagctgggctctttgcgaggccctgacactggcgaccggacctatcaccacactctgggaaggctccccggggaagttttggaataccacaattgccgtgtctatggctaacatcttccggggaagctatctggccggcgctgggcttgccttttccattatgaaaagcgtcggaacgggcaagagaggcaccgggtctcaaggagagacactgggcgaaaagtggaaaaagaaactcaatcagctgtcccgcaaggatttcgacctgtacaaaaagagcgggatcaccgaggtggatcggacagaggcgaaagaaggactcaagagaggcgagattacccaccatgccgtgtcccgggggtctgctaagcttcagtggtttgttgaacgcaacatggtcatccccgagggaagagtgattgacctgggctgtggccgggggggatggagctattactgcgccggcctgaaaaaggtgacggaagtccgcgggtataccaaaggaggccctgggcacgaggagcccgttcctatgtccacatacggatggaatatcgtgaagctcatgtctggcaaagatgtgttctacctgcccccggaaaagtgtgacacccttctgtgcgatatcggcgagagctcccctagccccacagtcgaagagtctagaaccattcgggtgctcaagatggttgagccctggctgaaaaacaatcagttctgtatcaaggtgctgaacccttatatgcccacagtcattgaacacctcgagcgccttcaaagaaaacatgggggaatgctggtgcggaatcctctgtcccgcaacagcacccacgaaatgtactggatctctaatggcacggggaacattgttgcttccgtgaatatggtcagcagactcctgcttaaccggtttacaatgacccatagacgcccgaccatcgagaaggacgtggatctgggagccggcacacggcacgtgaacgctgaacccgagacgcctaatatggacgtcatcggggagagaattaaacgcatcaaggaagagcacaactctacctggcattatgacgatgaaaatccctacaagacatgggcctatcacggaagctacgaggttaaagcgaccggctccgcctctagcatgattaacggcgtggtgaagctcctgacaaaaccttgggacgtcgtgcccatggttacccagatggctatgacagataccacgccgttcgggcagcaacgggtgtttaaggaaaaagtcgacaccagaacacctcgctccatgcccggaacccggagagtgatgggcatcacagccgagtggctgtggcgcaccctcgggcggaataagaagcctagactgtgcacgcgcgaggaattcacaaaaaaggttcggaccaacgctgccatgggagccgtgtttacagaggaaaatcagtgggatagcgcgaaagctgccgtcgaggacgaagatttctggaagcttgtggacagagagcgcgagctgcataaactcggcaagtgtgggtcctgcgtttataacatgatgggcaaaagagaaaagaagctgggagagtttggcaaagccaaggggtctcgggctatttggtacatgtggcttggagcccgctacctggaattcgaggctctcggctttctgaatgaggatcactggttcagcagagaaaactcctattctggggtggagggagaaggcctgcataaactcgggtacatcctgcgggacatcagcaagattcccggcggagccatgtatgcggatgacaccgccggctgggacacgagaatcaccgaggatgaccttcacaatgaagagaaaattacacagcagatggatcctgagcaccggcaactggctaacgccatctttaagctcacctaccagaataaggtcgtgaaagtccagcgccccacaccgaccgggacagtgatggacattatctccagaaaggatcagcggggatctggccaagttgggacctatggactgaacacgttcacaaatatggaagctcagcttatccgccagatggagggcgaaggggtgctgagcaaagccgacctcgagaaccctcatctgcccgaaaagaaaattacccagtggctggagaccaagggcgtcgagagactcaagcggatggcgatctccggagatgactgcgtggtgaaacccattgatgaccgctttgccaacgctctgcttgccctgaatgatatgggcaaggttagaaaagacatccctcaatggcagccgagcaaggggtggcacgattggcagcaggtgcccttctgttctcatcacttccacgaactcattatgaaagacggacggaagctggtcgtgccttgccgcccccaagacgagcttatcggcagagctcggatttcccagggggccggatggagcctgaaggaaacagcttgtctcggcaaagcctacgcgcagatgtggtctctgatgtattttcatcgcagagatctgcggctcgcctccaacgctatctgcagcgccgttcctgtgcactgggtccccacctctcgcacaacgtggtccatccatgcccaccatcaatggatgaccacagaggacatgctgaccgtgtggaatagagtctggattgaagataacccttggatggaggacaagacacccgtgaccacgtgggagaatgttccgtaccttgggaaacgggaagatcagtggtgtggcagcctgatcggactcacctccagagctacatgggcccagaacattcctaccgcgatccagcaagtgcgcagcctgattggcaatgaggaattccttgactacatgccctctatgaagcggtttagaaaagaggaggaaagcgagggggctatctggtga

SEQ ID NO: 20559 - RNA, 9873 nt, synthetic construct
  misc_feature 1..9873: note = derived and/or modified CDS sequence (opt5) from DENV-3__HQ541785__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctgacatcacatgggaggaagaggccgaacagacgggagtgagccacaacctcatgattgcggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacatataacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtatggaaatggcgttgtgacgaagaacgggggatacgtctccggcattgctcaaaccaatgccgagcctgacgggccgacacccgaactcgaggaagagatgttcaaaaagcgcaacctgaccatcatggatcttcatcctggcagcggaaaaacaagaaagtatctgcccgctattgtgcgggaagccatcaagcgcagactccggaccctgatcctcgcgcctacgagagttgtggccgctgagatggaggaagccctgaaaggccttcccattcgctaccagacaaccgctaccaagtctgagcacacagggcgggaaatcgtcgacctgatgtgccatgccacctttacaatgagactgctcagccctgtgcgcgttccgaattataacctgattatcatggatgaggcccacttcaccgaccccgcttccattgcggcccggggatacatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatatatcttcacgggacagccccttaacaatgatgaggaccatgctcactggacagaagccaagatgctgctggacaacattaatacccctgagggcatcattcccgccctcttcgaacctgagcgggagaaatccgccgctatcgatggggaatacagactgaagggcgagagccgcaaaacctttgtggaacttatgcggagaggagacctgcccgtctggctcgcccacaaggtggcttctgagggcatcaaatatacagatcgcaagtggtgcttcgacgggcagcggaacaatcagattctggaagagaacatggatgttgagatctggaccaaagaaggagagaagaagaaactgagaccgcgctggctcgacgcccggacatactccgatcctcttgccctgaaggaatttaaagagttcgctgcgggcagaaagagcattgccctggacctcgtgacggaaatcgggcgcgtcccctctcatctggctcacagaacccggaatgcccttgataacctggtgatgctccatacatccgagcacggaggccgcgcctatagacacgctgtcgaggaactgcctgagaccatggaaacactgctccttctgggcctgatgattctcctgaccgggggagccatgctttttctgatcagcggcaaagggatcggaaagacgtccattggcctcatctgtgtgattacctctagcgggatgctgtggatggcggagatccccctgcaatggattgcctccgctatcgttctcgagttctttatgatggtgcttctgattcctgaacccgagaagcagcggacaccgcaggacaatcaactggcctacgtggtcatcggaatcctcaccctggctgccattatcgcggccaacgaaatgggccttctggagacaaccaaacgcgatctcggcatgagcaaggaacctggggttgtgtctcccacgtcctatctggacgtggatctgcatcccgctagcgcctggacactctacgctgtcgccaccacagtgattacccctatgcttagacacaccatcgaaaattctacagctaacgttagcctggccgcgattgccaaccaggctgtggtcctgatgggactcgacaaaggctggccgatctccaagatggacctgggggtgccccttctggccctcggatgctactctcaggtcaatcctctgacgctgaccgctgccgtgctccttctgatcacacattatgccattatcggccccgggctgcaggcgaaagctacccgggaggcccaaaagagaacagctgccggaattatgaagaaccctaccgttgatggcatcatgacgattgacctcgatcccgtgatctacgacagcaaattcgaaaagcagctgggccaggtcatgcttctggtgctctgtgccgttcagctgctgctcatgcgcacatcctgggctctttgcgaggccctgaccctggcgaccgggcctatcacaaccctctgggaaggatctccgggcaaattttggaatacaacgattgccgtgagcatggctaacatcttccgggggtcctatctggccggagctggccttgcctttagcattatgaagtctgtcgggaccggaaaaagaggcacaggctcccaaggggagaccctgggagaaaagtggaagaaaaagctcaatcagctgagccgcaaagatttcgacctgtacaagaaatccggcatcacagaggtggatcggaccgaggcgaaggaagggctcaaaagaggagagattacgcaccatgccgtgtctcggggcagcgctaaacttcagtggtttgttgaacgcaacatggtcatccccgaggggagagtgattgacctgggatgtggccggggcgggtggtcctattactgcgccggactgaagaaagtgaccgaagtccgcggctatacaaaagggggacctggccacgaggagcccgttcctatgtctacctacgggtggaatatcgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttatatgcccaccgtcattgaacacctcgagcgccttcaaagaaagcatggcgggatgctggtgcggaatcctctgagccgcaactctacgcacgaaatgtactggatctccaatggaacaggcaacattgttgctagcgtgaatatggtctctagactcctgcttaaccggtttaccatgacccatagacgcccgacaatcgagaaagacgtggatctgggggccggaacgcggcacgtgaacgctgaacccgagacccctaatatggacgtcatcggcgagagaattaagcgcatcaaagaagaacacaacagcacatggcattatgacgatgaaaatccctacaagacctgggcctatcacgggtcctacgaggttaaggcgacaggatctgccagctccatgattaacggcgtggtgaaactcctgaccaagccttgggacgtcgtgcccatggttacacagatggctatgaccgatacgaccccgttcggccagcaacgggtgtttaaagaaaaggtcgacacaagaacccctcgcagcatgcccgggacacggagagtgatgggaatcaccgccgagtggctgtggcgcacgctcggccggaataaaaagcctagactgtgcacacgcgaggagttcaccaagaaagttcggacaaacgctgccatgggggccgtgtttaccgaggaaaatcagtgggattccgcgaaggctgccgtcgaggacgaagatttctggaaacttgtggacagagagcgcgagctgcataagctcggaaaatgtggctcttgcgtttataacatgatggggaagagagagaagaagctgggcgagtttggaaaggccaaaggcagccgggctatttggtacatgtggcttggggcccgctacctggagttcgaggctctcggatttctgaatgaggatcactggttctccagagaaaactcttatagcggcgtggagggggaaggactgcataagctcggctacatcctgcgggacatctccaaaattcccgggggcgccatgtatgcggatgacacggccggatgggacaccagaatcacagaggatgaccttcacaatgaagagaagattacccagcagatggatcctgagcaccggcaactggctaacgccatctttaaactcacataccagaataaggtcgtgaaggtccagcgccccaccccgacaggcaccgtgatggacattatctctagaaaagatcagcgggggagcggacaagttggcacgtatgggctgaacacattcaccaatatggaagctcagcttatccgccagatggagggagaaggcgtgctgtccaaggccgacctcgagaaccctcatctgcccgagaagaagattacccagtggctggagacaaaaggggtcgagagactcaagcggatggcgatcagcggcgatgactgcgtggtgaagcccattgatgaccgctttgccaacgctctgcttgccctgaatgatatgggaaaagttagaaaggacatccctcaatggcagccgtctaaaggctggcacgattggcaacaggtgcccttctgttcccatcacttccacgaactcattatgaaggacgggcggaaactggtcgtgccttgccgcccccaagacgagcttatcggacgggctcggattagccagggcgccgggtggtctctgaaggaaaccgcttgtctcggaaaggcctacgcgcagatgtggtccctgatgtattttcatcgcagagatctgcggctcgccagcaacgctatctgctctgccgttcctgtgcactgggtccccacatcccgcacgacctggagcatccatgcccaccatcaatggatgacaaccgacgatatgctgacagtgtggaatagagtctggattgaggacaacccttggatggaagataaaacccccgtgacgacctgggagaatgttccgtaccttggcaagcgggaggaccagtggtgtgggtccctgatcggcctcacaagcagagctacctgggcccagaacattcctacagcgatccagcaagtgcgctctctgattggaaatgaagagttccttgattacatgcccagcatgaaacggtttagaaaggaagaggagtccgaaggcgctatctggtga

SEQ ID NO: 20560 - RNA, 9873 nt, synthetic construct
  misc_feature 1..9873: note = derived and/or modified CDS sequence (opt5) from DENV-3__HM181975__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcgtgctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacaactggccacccttcgcaaactgtgtattgagggaaagatcacaaacattaccacggattccagatgccctacacagggcgaagcgaccctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagcatgaaaatctcaagtataccgtcattatcacagtgcacacgggggaccagcatcaggttggaaacgagacccaaggcgtgacagctgaaatcacccctcaggcctctacaaccgaggctattctgcccgaatacggcacgctggggctcgagtgctcccctcgcaccggactggacttcaatgagatgatccttctgacaatgaaaaacaaggcctggatggtccacagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcatacagctctgaccggcgccaccgaaattcaaaattccgggggcacaagcatcttcgccggacacctgaagtgtcgcctcaaaatggacaagctggagcttaaaggcatgtcttatgctatgtgcacgaacacctttgtgctgaagaaagaggtctccgaaacacagcatgggaccattctcatcaaggtggagtacaagggagaagatgttccctgtaaaatccctttcagcacagaggacggccaagggaaggcccacaacggaagactgattaccgcgaatcccgtggtcacgaaaaaggaggaacccgtgaacatcgaggctgaacctccgttcggcgagtccaatattgtgatcgggattggcgataacgccctgaaaatcaattggtacaagaagggatctagcatcggcaaaatgtttgaagccacagctagaggggccagacgcatggctattcttggagacaccgcctgggatttcggctccgttgggggagtcctcaacagcctgggcaagatggtgcatcagatctttgggtctgcgtataccgccctgttctccggcgtgagctgggtcatgaaaattggaatcggcgtgctcctgacatggattgggcttaattctaagaacaccagcatgtccttttcttgcatcgctattggaatcatcacactgtacctcggcgccgttgtgcaggctgacatggggtgtgtcattaattggaaaggaaaggagctgaagtgcggcagcgggatcttcgtgacgaacgaggttcacacctggacagaacagtataaatttcaagccgattcccccaagcggctggcgaccgccattgctggcgcctgggagaatggagtgtgtggcatcagaagcacaacccgcatggaaaaccttctctggaaacagattgctaatgagctgaactacatcctgtgggaaaataacatcaagctcacggtcgtggttggggacattatcggagtgctggagcagggcaaacggacccttacacctcagcccatggagctgaagtattcttggaaaacctgggggaaggccaagattgtcacagccgaaacccaaaactccagcttcatcattgatggacctaatacacccgagtgcccgtctgtgtccagagcttggaacgtgtgggaagtcgaggactacggctttggcgttttcaccacgaatatctggctcaaactgcgcgaagtgtatacacagctgtgtgaccaccggcttatgagcgcggccgtgaaggatgagagagctgtccatgccgacatggggtactggatcgagtcccagaaaaacggatcttggaagctcgaaaaagccagcctgattgaggtgaagacctgcacctggcctaagtcccacacactgtggtctaatggcgttctcgaaagcgatatgatcattcccaaatccctggctgggcctatcagccagcataaccaccgccccggataccacacccaaacggccggcccttggcatcttgggaagctggagctcgactttaattattgcgagggaacaaccgtggtcattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggttaaatccctggtgagcgcgggatctggcaaggtcgacaacttcacaatgggggtgctgtgcctcgctatcctgtttgaagaggttatgcggggaaagttcggcaaaaagcatatgattgccggcgtgttctttaccttcgtccttctgctcagcgggcagatcacatggcgcgatatggcccacaccctgattatgatcggatccaatgctagcgacagaatgggcatgggggtgacgtacctggcccttattgcgacatttaaaatccagcccttcctggctctcggatttttcctgcggaagctcacctctagagaaaacctgcttctgggcgtggggctcgccatggccacaaccctgcaactgcctgaggatatcgaacagatggctaatggaattgcccttggcctgatggctctcaaactgatcacccagtttgagatttatcagctctggacagccctgatctcccttacgtgtagcaacaccattttcacactgaccgtcgcgtggcgcacagccaccctcatcctggctggcgtttccctgcttccgatgtgccaatctagctccatgcggaagacggactggctgcccatggccgtggctgccatgggggtgcctcccctccctctgtttatcttctctctcaaggatacactgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacctccgccgatctgacagttgaaaaggccgctgacatcacctgggaggaagaggccgaacagacaggagtgagccataacctcatgattacggtcgacgatgacggcaccatgcggatcaaagatgacgagacagagaatatcctgaccgtgcttctgaagacagcgctgctcattgtctctggcatctttccgtattccattcctgctaccctgcttgtgtggcacacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcatgtgacccggggagccgtgctgacatacaacggcaaacgcctcgaaccgaattgggcttccgttaagaaagacctgatcagctatggcgggggatggagactttctgcccagtggcaaaagggcgaggaagtccaggtgattgcggtggagcctgggaaaaaccccaagaatttccagacgatgcctggaaccttccagacaaccaccggcgaaatcggggctatcgccctggattttaagcccggaacatccggcagccccattatcaaccgggagggcaaagtcgtggggctgtacggaaatggcgttgtgacgaagaacgggggatatgtctccggcattgcccaaaccaatgctgagcctgacgggccgacacccgaactcgaggaagagatgttcaaaaagcgcaacctgaccatcatggatcttcaccctggcagcggaaaaacaagaaagtacctgcccgccattgtgcgggaagctatcaagcgcagactccggaccctgatcctcgcccctacgagagttgtggcggccgagatggaggaagctctgaaaggccttcccattcgctatcagacaaccgccaccaagtctgagcatacagggcgggaaatcgtcgacctgatgtgccacgctacctttacaatgagactgctcagccctgtgcgcgttccgaattacaacctgattatcatggatgaggcccatttcaccgaccccgcctccattgctgcgcggggatatatctctacgagagtgggcatgggggaagccgctgccatctttatgacagccacccctcccggaacagctgatgccttccctcagagcaatgcgcccattcaggacgaggagcgcgacatcccggaacggtcctggaactctggcaatgagtggattaccgattttgctgggaaaacggtctggttcgtgcctagcatcaaggccggcaacgacattgccaactgtcttcgcaaaaatggaaagaaggtgatccaactgtccagaaaaacctttgatacagaataccagaagaccaaactcaacgactgggatttcgtcgttacaaccgacatttctgagatgggcgctaattttaaggccgatcgggtgatcgaccccagacggtgcctgaaacccgtgatcctgacagatgggcctgagcgcgtcattctcgcgggacccatgcctgtgaccgccgctagcgccgctcagagacggggccgcgttgggagaaacccgcagaaggaaaatgaccaatacatcttcacgggacagccccttaacaatgatgaggaccacgcccactggacagaagctaagatgctgctggacaacattaatacccctgagggcatcattcccgccctcttcgaacctgagcgggagaaatccgcggccatcgatggggaatatagactgaagggcgagagccgcaaaacctttgtggaacttatgcggagaggagacctgcccgtctggctcgctcataaggtggcctctgagggcatcaaatacacagatcgcaagtggtgcttcgacgggcagcggaacaatcagattctggaagagaacatggatgttgagatctggaccaaagaaggagagaagaagaaactgagaccgcgctggctcgacgctcggacatattccgatcctcttgccctgaaggaatttaaagagttcgccgctggcagaaagagcattgcgctggacctcgtgacggaaatcgggcgcgtcccctctcacctggcccatagaacccggaatgctcttgataacctggtgatgctccacacatccgagcacggaggccgcgcctacagacatgccgtcgaggaactgcctgagaccatggaaacactgctccttctgggcctgatgattctcctgaccgggggagctatgctttttctgatcagcggcaaagggatcggaaagacgtccattggcctcatctgtgtgattgcctctagcgggatgctgtggatggcggagatccccctgcaatggattgcctccgctatcgttctcgagttctttatgatggtgcttctgattcctgaacccgagaagcagcggaccccgcaggacaatcaactggcctatgtggtcatcggaatcctcacactggctgccattatcgcggccaacgaaatgggccttctggagaccacaaaacgcgatctcggcatgagcaaggaacctggggttgtgtctcccacctcctacctggacgtggatctgcaccccgctagcgcctggacgctctatgctgtcgccacaaccgtgattacacctatgcttagacataccatcgaaaattctaccgctaacgttagcctggccgcgattgccaaccaggctgtggtcctgatgggactcgacaaaggctggccgatctccaagatggacctgggggtgccccttctggccctcggatgctactctcaggtcaatcctctgacactgacggctgccgtgctccttctgatcacccactacgccattatcggccccgggctgcaggcgaaagctacacgggaggcccaaaagagaaccgctgccggaattatgaagaaccctacagttgatggcatcatgaccattgacctcgatcccgtgatctatgacagcaaattcgaaaagcagctgggccaggtcatgcttctggtgctctgtgttgtgcagctgctgctcatgcgcacgtcctgggccctttgcgaggctctgacactggccaccgggcctatcaccacactctgggaaggatctccgggcaaattttggaataccacaattgcggtcagcatggccaacatcttccgggggtcctacctggctggagccggccttgcttttagcattatgaagtctgtggggacgggaaaaagaggcaccggctcccaaggggagacactgggagaaaagtggaagaaaaagctcaatcagctgagccgcaaagatttcgacctgtataagaaatccggcatcaccgaggtggatcggacagaggccaaggaagggctcaaaagaggagagattacccatcacgcggtttctcggggcagcgccaaacttcagtggtttgtcgaacgcaacatggtgatccccgaggggagagtgattgacctgggatgtggccggggcgggtggtcctactattgcgctggactgaagaaagtcacggaagttcgcggctacaccaaagggggacctggccacgaggagcccgtgcctatgtctacatatgggtggaatatcgtgaaactcatgagcggaaaggatgtcttctacctgcccccggaaaaatgtgacacccttctgtgcgatatcggcgagtccagcccttctcccacagtggaagagtccagaaccattcgggttctcaagatggtggagccctggctgaagaacaatcagttctgtatcaaagtcctgaacccttacatgcccacagtgattgaacatctcgagcgccttcaaagaaagcacggcgggatgctggttcggaatcctctgagccgcaactctacccatgaaatgtattggatctccaatggaacgggcaacattgtggccagcgtcaatatggtgtctagactcctgcttaaccggtttacaatgatccacagacgcccgaccatcgagaaagacgtggatctgggggctggaacccggcacgtcaacgccgaacccgagacacctaatatggacgttattggcgagagaatcaagcgcattaaagaagaacacaacagcacgtggcactacgacgatgaaaatccctataagacctgggcttaccatgggtcctatgaggtgaaggccacaggatctgcgagctccatgatcaacggcgtggtcaaactcctgaccaagccttgggacgtggttcccatggtgacacagatggccatgaccgatacaaccccgttcggccagcaacgggtctttaaagaaaaggtggacacgagaacccctcgcagcatgcccgggacacggagagttatgggaattaccgctgagtggctgtggcgcacactcggccggaataaaaagcctagactgtgcacccgcgaggagttcacgaagaaagtgcggacaaacgccgctatgggggccgtctttaccgaggaaaatcagtgggattccgccaaggcggctgtggaggacgaagatttctggaaacttgttgacagagagcgcgagctgcacaagctcggaaaatgtggctcttgcgtgtacaacatgatggggaagagagagaagaagctgggcgagtttggaaaggccaaaggcagccgggccatctggtatatgtggcttggggctcgctacctggagttcgaggccctcggatttctgaatgaggatcattggttctccagagaaaactcttacagcggcgtcgagggggaaggactgcacaagctcggctatatcctgcgggacatttccaaaatccccgggggcgctatgtacgccgatgacacagcgggatgggacaccagaattacggaggatgaccttcacaatgaagagaagatcacccagcagatggatcctgagcatcggcaactggccaacgctatttttaaactcacatatcagaataaggtggtcaaggtgcagcgccccaccccgacaggcaccgttatggacatcatctctagaaaagatcagcgggggagcggacaagtgggcacatacgggctgaacaccttcacgaatatggaagcccagcttattcgccagatggagggagaaggcgtcctgtccaaggctgacctcgagaaccctcatctgcccgagaagaagatcacacagtggctggagaccaaaggggtggagagactcaagcggatggccattagcggcgatgactgcgtggttaagcccatcgatgaccgctttgcgaacgccctgcttgctctgaatgatatgggaaaagtgagaaaggacattcctcaatggcagccgtctaaaggctggcatgattggcagcaggtccccttctgttcccaccacttccatgaactcatcatgaaggacgggcggaaactggtggttccttgccgcccccaagacgagcttattggacgggcccggatcagccagggcgctgggtggtctctgaaggaaaccgcctgtctcggaaaggcttatgcccagatgtggtccctgatgtactttcaccgcagagatctgcggctcgcgagcaacgccatctgctctgctgtgcctgtccattgggtgcccacatcccgcaccacatggagcattcacgcccatcaccaatggatgacgaccgaggacatgctgacagtctggaatagagtgtggatcgaagataacccttggatggaggacaaaacccccgttacaacctgggagaatgtgccgtatcttggcaagcgggaagatcagtggtgtgggtccctgattggcctcacgagcagagccacctgggctcagaacatccctacagccattcagcaagtccgctctctgatcggaaatgaggagttccttgactacatgcccagcatgaaacggtttagaaaggaggaggaatccgagggcgcgatctggtga

SEQ ID NO: 20561 - RNA, 9873 nt, synthetic construct
  misc_feature 1..9873: note = derived and/or modified CDS sequence (opt5) from DENV-3__HM631864__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagaaagctgtgcacgccgacatggggtactggattgagtcccagaagaacggatcttggaaactcgaaaaggccagcctgatcgaggtcaagacctgcacctggcctaaatcccatacactgtggtctaatggcgtgctcgaaagcgatatgattatccccaagtccctggctgggcctattagccagcacaaccatagacccggatatcacacccaaacggccggcccttggcaccttgggaaactggagctcgactttaattactgcgagggaacaaccgttgtgatcacagaaaactgtggcacccgcggcccctctctgcggacaaccacggtctccgggaagctgatccatgagtggtgctgtagaagctgcacccttccgcctctccgctatatgggagaagatggctgttggtacgggatggagattcggcccatctctgaaaaagaggagaatatggtgaagtccctggttagcgcgggatctggcaaggtggacaacagcacaatgggggtcctgtgcctcgctattctgttcgaagaggtgatgagaggaaaatttggcaagaaacacatgatcgccggcgttttcttcacctttgtgcttctgctctccgggcagattacatggcgggatatggcccataccctgatcatgattggaagcaatgcttctgaccgcatgggcatgggggtcacgtatctggcccttatcgcgacattcaagatccagccctttctggctctcggattctttctgagaaaactcacctcccgggaaaacctgcttctgggcgtggggctcgccatggccacaaccctgcaactgcctgaggatattgaacagatggctaatggaatcgcccttggcctgatggctctcaagctgattacccagttcgagacataccagctctggacggccctgatcagccttacctgttccaacacaatttttaccctgacagtggcgtggagaaccgccacgctcatcctggctggcgtctctctgcttccggtttgccaaagctcctctatgcgcaagacagactggctgcccatggccgtggctgccatgggggtgcctcccctccctctgttcatctttagcctcaaagataccctgaagcggagatcctggccccttaatgagggagtcatggccgtgggcctggtttctattctggctagctccctcctgcgcaacgacgtgcctatggcggggccccttgtcgccggaggcctgctcatcgcttgttatgtgattaccgggacaagcgccgatctgaccgttgaaaaagccgctgacatcacatgggaggaagaggccgaacagacgggagtgtctcacaacctcatgattgcggtcgacgatgacggcaccatgagaatcaaggatgacgagacagagaatatcctgaccgtgcttctgaaaacagctctgctcattgtctccggcatcttcccgtacagcattcctgccaccctgcttgtgtggcatacgtggcagaagcagacccaacggtctggggttctgtgggatgtgccctcccctcccgaaacacagaaagccgagctcgaagagggagtctaccgcatcaagcagcagggcatttttgggaagacccaagtgggagttggcgtgcagaaagagggggtcttccacacaatgtggcacgtgaccagaggagctgtgctgacatataacggcaagcggctcgaaccgaattgggccagcgttaaaaaggacctgatctcttacggcgggggatggcgcctttccgcgcagtggcaaaaaggcgaggaagtccaggtgattgctgtggagcctgggaagaaccccaagaattttcagacgatgcctggaaccttccagacaaccaccggcgaaatcggggccatcgccctggatttcaaacccggaacaagcggctcccccattatcaacagagagggcaaggtcgtggggctgtatggaaatggcgttgtgacgaaaaacgggggatacgtcagcggcattgctcaaaccaatgccgagcctgacgggccgacacccgaactcgaggaagagatgtttaagaaacggaacctgaccatcatggatcttcatcctggctctggaaagacacgcaagtatctgcccgctattgtgagagaagccatcaaacggcgcctcagaaccctgatcctcgcgcctacgcgggttgtggccgctgagatggaggaagccctgaagggccttcccattagataccagacaaccgctaccaaaagcgagcacacagggcgcgaaatcgtcgacctgatgtgccatgccaccttcacaatgcggctgctctcccctgtgagagttccgaattataacctgattatcatggatgaggcccactttaccgaccccgcttctattgcggcccgcggatacatcagcacgcgggtgggcatgggggaagctgccgccatcttcatgacagctacccctcccggaacagccgatgcgtttcctcagtccaatgctcccattcaggacgaggagagagacatcccggaacgctcttggaacagcggcaatgagtggattaccgatttcgccgggaagacggtctggtttgtgccttccatcaaagccggcaacgacattgctaactgtcttcggaagaatggaaagaaagtgatccaactgtctagaaagaccttcgatacagaataccagaaaaccaagctcaacgactgggattttgtcgttacaaccgacattagcgagatgggcgccaatttcaaagcggatcgcgtgatcgacccccggagatgcctgaagcccgtgatcctgacagatgggcctgagcgggtcattctcgccggacccatgcctgtgaccgctgcctccgctgcccagcgcagaggccgggttgggcgcaacccgcagaaggaaaatgaccaatatatctttacgggacagccccttaacaatgatgaggaccatgctcactggacagaagccaaaatgctgctggacaacattaatacccctgagggcatcattcccgcgctcttcgaacctgagagagagaagagcgccgctatcgatggggaataccggctgaaaggcgagtctagaaagaccttcgtggaacttatgcgccggggagacctgcccgtctggctcgcccacaaagtggcttccgagggcatcaagtatacagatagaaaatggtgctttgacgggcagcgcaacaatcagattctggaagagaacatggatgttgagatctggaccaaggaaggagagaagaaaaagctgcggccgagatggctcgacgcccgcacatacagcgatcctcttgccctgaaagaattcaaggagtttgctgcgggccggaaatctattgccctggacctcgtgacggaaatcgggagagtcccctcccatctggctcaccgcaccagaaatgcccttgataacctggtgatgctccatacaagcgagcacggaggccgggcctatcgccacgctgtcgaggaactgcctgagaccatggaaacactgctccttctgggcctgatgattctcctgaccgggggagccatgcttttcctgatctccggcaaggggatcggaaagacgtctattggcctcatctgtgtgattgcgagctccgggatgctgtggatggccgagatccccctgcaatggattgctagcgccatcgttctcgagtttttcatgatggtgcttctgattcctgaacccgagaaacagagaaccccgcaggacaatcaactggcttacgtggtcatcggaatcctcacactggccgcggttattgccgctaacgaaatgggccttctggagaccacaaagcgggatctcggcatgtctaaagaacctggggtggtgtcccccaccagctatctggacgtcgatctgcatcccgcctctgcttggacgctctacgccgtggctacaaccgttatcacacctatgcttcgccacaccattgagaatagcaccgccaacgtgtccctggcggccatcgctaaccaggccgtcgtgctgatgggactcgacaagggctggccgatttctaaaatggacctgggggtcccccttctggctctcggatgctacagccaggtgaatcctctgacactgacggccgccgttctccttctgatcacccattatgcgatcattggccccgggctgcaggctaaggccacaagagaggctcaaaagcggaccgccgccggaatcatgaaaaaccctacagtggatggcattatgaccatcgacctcgatcccgtcatttacgactccaagtttgaaaaacagctgggccaggtgatgcttctggttctctgtgctgtgcagctgctgctcatgagaacgtcttgggccctttgcgaggcgctgacactggccaccgggcctatcaccacactctgggaaggaagcccgggcaagttctggaataccacaatcgctgtctccatggccaacatttttcgcgggagctatctggctggagccggccttgcgttctctatcatgaaatccgtggggacgggaaagcggggcaccggcagccaaggggagacactgggagaaaagtggaaaaagaaactcaatcagctgtccagaaaggattttgacctgtacaaaaagtctggcattaccgaggtggatcgcacagaggccaaagaagggctcaagcggggagagatcacccaccatgctgttagcagaggctccgccaagcttcagtggttcgtcgaacggaacatggtgattcccgaggggcgcgtgatcgacctgggatgtggcagaggcgggtggtcttattactgcgctggactgaaaaaggtcacggaagttcggggctataccaaagggggacctggccacgaggagcccgtgcctatgagcacatacgggtggaatattgtgaagctcatgtccggaaaagatgtcttttacctgcccccggaaaagtgtgacacccttctgtgcgatatcggcgagagctctccttcccccacagtggaagagagccgcaccatcagagttctcaagatggtggagccctggctgaaaaacaatcagttctgtattaaggtcctgaacccttatatgcccacagtgatcgaacacctcgagcggcttcaacgcaaacatggcgggatgctggttagaaatcctctgtctcggaactccacccacgaaatgtactggattagcaatggaacgggcaacatcgtggcctctgtcaatatggtgagccgcctcctgcttaacagattcacaatgacccatcggagaccgaccattgagaaggacgtggatctgggggctggaacacgccacgtcaacgccgaacccgagacgcctaatatggacgttatcggcgagcggatcaaaagaattaaggaagagcacaactccacctggcattatgacgatgaaaatccctacaagacatgggcgtatcacgggtcttacgaggtgaaagccaccggaagcgcttccagcatgatcaacggcgtggtcaagctcctgacaaaaccttgggacgtggttcccatggtgacccagatggccatgacagataccacgccgtttggccagcaacgcgtcttcaaggaaaaagtggacacccggacacctagatccatgcccgggacccgccgggttatgggaattacagctgagtggctgtggagaaccctcggccgcaataagaagcctcggctgtgcacgagagaggaatttacaaaaaaggtgcgcaccaacgccgccatgggggcggtcttcacagaggaaaatcagtgggattctgctaaagccgccgtggaggacgaagatttttggaagcttgttgaccgggagagagagctgcataaactcggaaagtgtggcagctgcgtgtataacatgatggggaaacgcgaaaagaagctgggcgagttcggaaaagctaagggctccagagccatctggtacatgtggcttggggctcggtacctggaatttgaggccctcggattcctgaatgaggatcactggttttctcgcgaaaacagctattccggcgtcgagggggaaggactgcataaactcggctacattctgagagacatctctaagatccccgggggcgcgatgtatgccgatgacaccgctggatgggacacgcggattaccgaggatgaccttcacaatgaagagaaaatcacacagcagatggatcctgagcacagacaactggccaacgctattttcaagctcacctaccagaataaggtggtcaaagtgcagcggcccacaccgaccggcacagttatggacatcattagccgcaaggatcagagagggtccggacaagtgggcacctatgggctgaacacgtttacaaatatggaagcccagcttatccggcagatggagggagaaggcgtcctgagcaaagcggacctcgagaaccctcatctgcccgaaaagaaaatcacccagtggctggagaccaagggggtggagcgcctcaagagaatggccatttctggcgatgactgcgtggttaaacccatcgatgaccggttcgctaacgccctgcttgctctgaatgatatgggaaaggtgcgcaaagacattcctcaatggcagccgtccaagggctggcacgattggcagcaggtccccttttgtagccatcacttccacgaactcatcatgaaagacgggagaaagctggtggttccttgccggccccaagacgagcttattggacgcgccagaatctctcagggcgctgggtggtccctgaaggaaacagcctgtctcggaaaagcgtacgcccagatgtggagcctgatgtatttccatcggcgcgatctgagactcgcttctaacgccatttgctccgccgtgcctgtccactgggtgcccaccagccggacaacgtggtccatccatgctcaccatcaatggatgaccacagacgatatgctgaccgtctggaatcgcgtgtggatcgaggacaacccttggatggaagataagacacccgttaccacgtgggagaatgtgccgtaccttggcaaaagagaggaccagtggtgtgggagcctgattggcctcacctctcgggccacatgggcgcagaacatccctaccgctattcagcaagtcagaagcctgatcggaaatgaagagtttcttgattacatgccctccatgaagcgcttccggaaagaagaggagtctgaaggcgccatttggtga

SEQ ID NO: 20562 - RNA, 9873 nt, synthetic construct
  misc_feature 1..9873: note = derived and/or modified CDS sequence (opt5) from DENV-3__HM631859__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggactggctgcccatggccgttgctgccatgggggtgcctcccctccctctgtttattttctctctcaaggatacactgaaaagacgcagctggccccttaatgagggagtgatggccgtcggcctggtgtccatcctggcttctagcctcctgagaaacgacgttcctatggcggggccccttgtggccggaggcctgctcattgcttgttacgtcatcaccgggacctccgccgatctgacagtggaaaaggccgctgacattacctgggaggaagaggccgaacagacaggagttagccataacctcatgatcacggtggacgatgacggcaccatgcggatcaaagatgacgagacagagaatattctgaccgtccttctgaagacagcgctgctcatcgtgtctggcatttttccgtattccatccctgctaccctgcttgtctggcacacgtggcagaaacagacccaacgcagcggggtgctgtgggatgttccctctcctcccgaaacacagaaggccgagctcgaagagggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgaaccgaattgggcttccgtgaagaaagacctgattagctatggcgggggatggagactttctgcccagtggcaaaagggcgaggaagttcaggtcatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtggtcgggctgtacggaaatggcgtggttacgaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtccgggaagctatcaagcgcagactccggaccctgattctcgcccctacgagagtggttgcggccgagatggaggaagctctgaaaggccttcccatccgctatcagacaaccgccaccaagtctgagcatacagggcgggaaattgtggacctgatgtgccacgctacctttacaatgagactgctcagccctgtccgcgtgccgaattacaacctgatcattatggatgaggcccatttcaccgaccccgcctccatcgctgcgcggggatatatctctacgagagttggcatgggggaagccgctgccatttttatgacagccacccctcccggaacagctgatgccttccctcagagcaatgcgcccatccaggacgaggagcgcgacattccggaacggtcctggaactctggcaatgagtggatcaccgattttgctgggaaaacggtgtggttcgtccctagcattaaggccggcaacgacatcgccaactgtcttcgcaaaaatggaaagaaggtgattcaactgtccagaaaaacctttgatacagaataccagaagaccaaactcaacgactgggatttcgtggtcacaaccgacatctctgagatgggcgctaattttaaggccgatcgggttatcgaccccagacggtgcctgaaacccgtgattctgacagatgggcctgagcgcgtgatcctcgcgggacccatgcctgtcaccgccgctagcgccgctcagagacggggccgcgtggggagaaacccgcagaaggaaaatgaccaatacattttcacgggacagccccttaacaatgatgaggaccacgcccactggacagaagctaagatgctgctggacaacatcaatacccctgagggcattatccccgccctcttcgaacctgagcgggagaaatccgcggccatcgatggggaatatagactgaagggcgagagccgcaaaacctttgttgaacttatgcggagaggagacctgcccgtgtggctcgctcataaggtcgcctctgagggcattaaatacacagatcgcaagtggtgcttcgacgggcagcggaacaatcagatcctggaagagaacatggatgtggagatttggaccaaagaaggagagaagaagaaactgagaccgcgctggctcgacgctcggacatattccgatcctcttgccctgaaggaatttaaagagttcgccgctggcagaaagagcatcgcgctggacctcgttacggaaattgggcgcgtgccctctcacctggcccatagaacccggaatgctcttgataacctggtcatgctccacacatccgagcacggaggccgcgcctacagacatgccgtggaggaactgcctgagaccatggaaacactgctccttctgggcctgatgatcctcctgaccgggggagctatgctttttctgatcagcggcaaagggattggaaagacgtccatcggcctcatttgtgtcatcgcctctagcgggatgctgtggatggcggagattcccctgcaatggatcgcctccgctattgtgctcgagttctttatgatggttcttctgatccctgaacccgagaagcagcggaccccgcaggacaatcaactggcctatgtggtgatcggcattctcacactggctgccatcattgcggccaacgaaatgggccttctggagaccacaaaacgcgatctcggcatgagcaaggaacctggggtcgtttctcccacctcctacctggacgtggatctgcaccccgctagcgcctggacgctctatgctgtggccacaaccgtcatcacacctatgcttagacataccattgaaaattctaccgctaacgtgagcctggccgcgatcgccaaccaggctgttgtgctgatgggactcgacaaaggctggccgatctccaagatggacctgggggtcccccttctggccctcggatgctactctcaggtgaatcctctgacactgacggctgccgtcctccttctgattacccactacgccatcattggccccgggctgcaggcgaaagctacacgggaggcccaaaagagaaccgctgccggaatcatgaagaaccctacagtggatggcattatgaccatcgacctcgatcccgttatctatgacagcaaattcgaaaagcagctgggccaggtgatgcttctggtcctctgtgtggttcagctgctgctcatgcgcacgtcctgggccctttgcgaggctctgacactggccaccgggcctattaccacactctgggaaggatctccgggcaaattttggaataccacaatcgcggtgagcatggccaacattttccgggggtcctacctggctggagccggccttgcttttagcatcatgaagtctgtcgggacgggaaaaagaggcaccggctcccaaggggagacactgggagaaaagtggaagaaaaagctcaatcagctgagccgcaaagatttcgacctgtataagaaatccggcattaccgaggtggatcggacagaggccaaggaagggctcaaaagaggagagatcacccatcacgcggtgtctcggggcagcgccaaacttcagtggtttgttgaacgcaacatggtcattcccgaggggagagtgatcgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatattggcgagtccagcccttctcccacagtcgaagagtccagaaccatccgggtgctcaagatggttgagccctggctgaagaacaatcagttctgtattaaagtgctgaacccttacatgcccacagtcatcgaacatctcgagcgccttcaaagaaagcacggcgggatgctggtgcggaatcctctgagccgcaactctacccatgaaatgtattggatttccaatggaacgggcaacatcgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcattggcgagagaatcaagcgcattaaagaggaacacaacagcacctggcactacgacgatgaaaatccctataagacatgggcttaccatgggtcctatgaggttaaggccaccggatctgcgagctccatgatcaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaattacagctgagtggctgtggcgcaccctcggccggaataaaaagcctagactgtgcacgcgcgaggagttcacaaagaaagttcggaccaacgccgctatgggggccgtgtttacagaggaaaatcagtgggattccgccaaggcggctgtcgaggacgaagatttctggagacttgtggaccgcgagagagagctgcacaaactcggaaagtgtggctcttgcgtttacaacatgatggggaaacgggaaaagaaactgggcgagtttggaaaggccaagggcagccgcgccatctggtatatgtggcttggggctagatacctggagttcgaggccctcggatttctgaatgaggatcattggttctcccgggaaaactcttacagcggcgtggagggggaaggactgcacaaactcggctatatcctgagagacatttccaagatccccgggggcgctatgtacgccgatgacaccgcgggatgggacacgcggattaccgaggatgaccttcacaatgaagagaaaatcacacagcagatggatcctgagcatcgccaactggccaacgctatttttaagctcacctatcagaataaagtcgtgaaggtccagagacccacaccgaccggcacagtgatggacatcatctctcggaaggatcagcgcgggagcggacaagttggcacctacgggctgaacacgttcacaaatatggaagcccagcttattagacagatggagggagaaggcgtgctgtccaaagctgacctcgagaaccctcatctgcccgaaaagaaaatcacccagtggctggagaccaagggggtcgagcggctcaaacgcatggccattagcggcgatgactgcgtggtgaagcccatcgatgacagatttgcgaacgccctgcttgctctgaatgatatgggaaaggttcggaaagacattcctcaatggcagccgtctaagggctggcatgattggcaacaggtgcccttctgttcccaccacttccatgaactcatcatgaaagacgggcgcaagctggtcgtgccttgcagaccccaagacgagcttattggacgggcccgcatcagccagggcgctgggtggtctctgaaagaaacagcctgtctcggaaaggcttatgcccagatgtggtccctgatgtactttcacagacgggatctgcgcctcgcgagcaacgccatctgctctgctgttcctgtgcattgggtccccacctccagaacaacgtggagcattcacgcccatcaccaatggatgaccacagaggacatgctgaccgtgtggaatcgggtctggatcgaagataacccttggatggaggacaagacacccgtgaccacgtgggagaatgttccgtatcttggcaaaagagaagatcagtggtgtgggtccctgattggcctcaccagccgcgccacatgggctcagaacatccctaccgccattcagcaagtgcggtctctgatcggaaatgaggagttccttgactacatgcccagcatgaagagatttcgcaaagaggaggaatccgagggcgcgatctggtga

SEQ ID NO: 20563 - RNA, 9870 nt, synthetic construct
  misc_feature 1..9870: note = derived and/or modified CDS sequence (opt5) from DENV-3__HM631856__SS-prME
  source 1..9870: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccaaggagctgaaatactcttggaagacctgggggaaggccaaaattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaagctgcgcgaagtgtacacacagctgtgtgaccaccggcttatgagcgcggccgtgaaagatgagagagctgtccacgccgacatggggtactggatcgagtcccagaagaacggatcttggaaactcgaaaaggccagcctgattgaggtgaagacctgcacctggcctaaatcccatacactgtggtctaatggcgttctcgaaagcgatatgatcattcccaagtccctggctgggcctatcagccagcacaaccatcgccccggatatcacacccaaacggccggcccttggcaccttgggaaactggagctcgactttaattactgcgagggaacaaccgtggtcattacagaaaactgtggcacccggggcccctctctgagaacaaccacggtgtccgggaagctgatccatgagtggtgctgtcgcagctgcacccttccgcctctccggtatatgggagaagatggctgttggtacgggatggagatcagacccatttctgaaaaagaggagaatatggttaagtccctggtgagcgcgggatctggcaaggtcgacaacttcacaatgggggtgctgtgcctcgctatcctgtttgaagaggttatgcggggaaaattcggcaagaaacacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaagatccagcccttcctggctctcggatttttcctgcggaaactcacctctagagaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacaatcttcaccctgacagtcgcgtggcgcaccgccacgctcattctggctggcgtttccctgcttccggtgtgccaatctagctccatgcggaagacagactggctgcccatggccgtggctgccatgggggtccctcccctccctctgtttatcttctctctcaaagataccctgaagagacgcagctggccccttaatgagggagtgatggccgttggcctggtgtccatcctggcttctagcctcctgagaaacgacgtccctatggcggggccccttgtggccggaggcctgctcattgcttgttatgttatcaccgggacatccgccgatctgaccgtggaaaaagccgctgacattacatgggaggaagaggccgaacagacgggagtcagccacaacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcatacctggcagaagcagacacaacgcagcggggtgctgtgggatgtcccctctcctcccgaaacccagaaagccgagctcgaagagggagtgtacagaattaagcagcagggcatcttcgggaagacacaagttggagtgggcgtccagaaagagggggtgtttcacaccatgtggcacgtgacacggggagccgttctgacgtataacggcaagcgcctcgaaccgaattgggcttccgtcaaaaaggacctgattagctacggcgggggatggagactttctgcccagtggcaaaaaggcgaggaagtgcaggtgatcgcggtcgagcctgggaagaaccccaagaatttccagaccatgcctggaacattccagaccaccacaggcgaaattggggctatcgccctggattttaaacccggaacgtccggcagccccatcattaaccgggagggcaaggtggttgggctgtatggaaatggcgtggtcaccaaaaacgggggatacgtgtccggcatcgcccaaacaaatgctgagcctgacgggccgacccccgaactcgaggaagagatgttccgcaagagaaacctgacaattatggatcttcatcctggcagcggaaaaacccggaagtatctgcccgccatcgttcgcgaagctattaagagacggctcagaacgctgatcctcgcccctacacgcgtggtcgcggccgagatggaggaagctctgaaaggccttcccatccggtaccagaccaccgccacaaagtctgagcacaccgggagagaaattgtggacctgatgtgccatgctacatttaccatgcgcctgctcagccctgttcgggtgccgaattataacctgatcattatggatgaggcccacttcacggaccccgcctccatcgctgcgagaggatacatttctacacgcgtcggcatgggggaagccgctgccatctttatgaccgccacacctcccggaaccgctgatgccttccctcagagcaatgcgcccatccaggacgaggagcgggacattccggaaagatcctggaactctggcaatgagtggatcacggattttgctgggaaaaccgtgtggttcgtgcctagcattaaggccggcaacgacatcgccaactgtcttcgcaaaaatggaaagaaggtcattcaactgtcccggaaaacatttgataccgaataccagaagacaaaactcaacgactgggatttcgttgtgaccacagacatctctgagatgggcgctaattttaaggccgatagagtgattgacccccggcgctgcctgaaacccgtcatcctgaccgatgggcctgagagagtgatcctcgcgggacccatgcctgttacggccgctagcgccgctcagcggcgcggcagagtggggcggaacccgcagaaggaaaatgaccaatatattttcacaggacagccccttaacaatgatgaggaccatgcccactggaccgaagctaagatgctgctggacaacatcaatacccctgagggcattatccccgccctcttcgaacctgagagagagaaatccgcggccattgatggggaataccgcctgaagggcgagagccggaaaacatttgtcgaacttatgagacgcggagacctgcccgtgtggctcgctcacaaggttgcctctgagggcatcaaatataccgatcggaagtggtgcttcgacgggcagagaaacaatcagatcctggaagagaacatggatgtggagatttggacaaaagaaggagagaagaagaaactgcgcccgcggtggctcgacgctagaacgtactccgatcctcttgccctgaaggaatttaaagagttcgccgctggccgcaagagcatcgcgctggacctcgtcaccgaaattgggagagtgccctctcatctggcccaccggacacgcaatgctcttgataacctggtcatgctccatacctccgagcacggaggcagagcctatcggcacgccgtggaggaactgcctgagacaatggaaaccctgctccttctgggcctgatgatcctcctgacggggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagcgcacaccgcaggacaatcaactggcctacgtcgttattggaatcctcaccctggctgccatcattgcggccaacgaaatgggccttctggagacaaccaaaagagatctcggcatgagcaaggaacctggggtggtgtctcccacgtcctatctggacgtcgatctgcatcccgctagcgcctggacactctacgctgtggccaccacagttatcacccctatgcttcggcacaccattgagaattctacagctaacgtgagcctggccgcgatcgccaaccaggctgtcgtgctgatgggactcgacaaaggctggccgatttccaagatggacctgggggtcccccttctggccctcggatgctactctcaggtgaatcctctgacgctgaccgctgccgttctccttctgatcacacattatgccatcattggccccgggctgcaggcgaaagctaccagagaggcccaaaagcgcacagctgccggaatcatgaagaaccctaccgtggatggcattatgacgatcgacctcgatcccgtcatttacgacagcaaattcgaaaagcagctgggccaggtgatgcttctggttctctgtgccgtgcagctgctgctcatgcggacatcctgggctctttgcgaggccctgaccctggcgaccgggcctatcacaaccctctgggaaggatctccgggcaaattttggaatacaacgatcgccgtcagcatggctaacattttcagagggtcctatctggccggagctggccttgcctttagcatcatgaagtctgtggggaccggaaaacgcggcacaggctcccaaggggagaccctgggagaaaagtggaagaaaaagctcaatcagctgagccggaaagatttcgacctgtacaagaaatccggcattacagaggtggatagaaccgaggcgaaggaagggctcaaacggggagagatcacgcaccatgccgtttctcgcggcagcgctaagcttcagtggtttgtcgaaagaaacatggtgattcccgaggggcgggtgatcgacctgggatgtggccgcggcgggtggtcctattactgcgccggactgaagaaagtcaccgaagttagaggctatacaaaggggggacctggccacgaggagcccgtgcctatgtctacctacgggtggaatattgtgaaactcatgagcggaaaggatgtcttctacctgcccccggaaaaatgtgacacacttctgtgcgatatcggcgagtccagcccttctcccaccgtggaagagtcccggacaatccgcgttctcaagatggtggagccctggctgaagaacaatcagttctgtattaaagtcctgaacccttatatgcccaccgtgatcgaacacctcgagagacttcaacggaagcatggcgggatgctggttcgcaatcctctgagcagaaactctacgcacgaaatgtactggatttccaatggaacaggcaacatcgtggctagcgtcaatatggtgtctcggctcctgcttaacagatttaccatgacccatcgccggccgacaattgagaaagacgtggatctgggggccggaacgagacacgtcaacgctgaacccgagacccctaatatggacgttatcggcgagcgcatcaagcggattaaagaagagcacaacagcacatggcattatgacgatgaaaatccctacaagacctgggcctatcacgggtcctacgaggtgaaggcgacaggatctgccagctccatgatcaacggcgtggtcaaactcctgaccaagccttgggacgtggttcccatggtgacacagatggctatgaccgatacgaccccgttcggccagcaaagagtctttaaagaaaaggtggacacacgcacccctcggagcatgcccgggacaagacgcgttatgggaattaccgccgagtggctgtggcggacgctcggcagaaataaacctcgcctgtgcacacgggaggaattcaccaagaaggtgagaacaaacgctgccatgggggccgtctttaccgaggaaaatcagtgggattccgcgaaagctgccgtggaggacgaagatttctggaagcttgttgaccgcgagagagagctgcataaactcggaaagtgtggctcttgcgtgtataacatgatggggaaacgggaaaagaaactgggcgagtttggaaaggccaagggcagccgcgctatctggtacatgtggcttggggccagatacctggaattcgaggctctcggatttctgaatgaggatcactggttctcccgggaaaactcttatagcggcgtcgagggggaaggactgcataaactcggctacattctgagagacatctccaagatccccgggggcgccatgtatgcggatgacacggccggatgggacacccggattacagaggatgaccttcacaatgaagagaaaatcacccagcagatggatcctgagcaccgccaactggctaacgccatttttaagctcacataccagaataaagtggtcaaggtgcagagacccaccccgacaggcaccgttatggacatcatttctcggaaggatcagcgcgggagcggacaagtgggcacgtatgggctgaacacattcaccaatatggaagctcagcttatcagacagatggagggagaaggcgtcctgtccaaagccgacctcgagaaccctcatctgcccgaaaagaaaatcacccagtggctggagacaaagggggtggagcggctcaaacgcatggcgattagcggcgatgactgcgtggttaagcccatcgatgacagatttgccaacgctctgcttgccctgaatgatatgggaaaggtgcggaaagacattcctcaatggcagccgtctaagggctggcacgattggcagcaggtccccttctgttcccatcacttccacgaactcatcatgaaagacgggcgcaagctggtggttccttgcagaccccaagacgagcttattggacgggctcgcatcagccagggcgccgggtggtctctgaaagaaaccgcttgtctcggaaaggcctacgcgcagatgtggtccctgatgtattttcatagacgggatctgcgcctcgccagcaacgctatttgctctgccgtgcctgtccactgggtgcccacatccagaacgacctggagcatccatgcccaccatcaatggatgacaaccgaggacatgctgacagtctggaatcgggtgtggatcgaagataacccttggatggaggacaagacccccgttacgacctgggagaatgtgccgtaccttggcaaaagagaagatcagtggtgtgggtccctgattggcctcacaagccgcgctacctgggcccagaacatccctacagcgattcagcaagtccggtctctgatcggaaatgaggaattccttgactacatgcccagcatgaagagatttcgcaaagaggaggaatccgagggcgctatttggtga

SEQ ID NO: 20564 - RNA, 9873 nt, synthetic construct
  misc_feature 1..9873: note = derived and/or modified CDS sequence (opt5) from DENV-3__HM756276__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaaactgcgcgaagtgtacacacagctgtgtgaccaccggcttatgagcgcggccgtgaaggatgagagagctgtccacgccgacatggggtactggatcgagtcccagaaaaacggatcttggaagctcgaaaaagccagcctgattgaggtgaagacctgcacctggcctaagtcccatacactgtggtctaatggcgttctcgaaagcgatatgatcattcccaaatccctggctgggcctatcagccagcacaaccatcgccccggatatcacacccaaacggccggcccttggcaccttgggaagctggagctcgactttaattactgcgagggaacaaccgtggtcattacagaaaactgtggcacccggggcccctctctgagaacaaccacggtgtccgggaaactgatccatgagtggtgctgtcgcagctgcacccttccgcctctccggtatatgggagaagatggctgttggtacgggatggagatcagacccatttctgaaaaggaggagaatatggttaaatccctggtgagcgcgggatctggcaaggtcgacaacttcacaatgggggtgctgtgcctcgctatcctgtttgaagaggttatgcggggaaagttcggcaaaaagcacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaaaatccagcccttcctggctctcggatttttcctgcggaagctcacctctagagaaaacctgcttctgggcgtggggctcgccatggccacaaccctgcaactgcctgaggatatcgaacagatggctaatggaattgcccttggcctgatggctctcaaactgatcacccagtttgagacataccagctctggacggccctgatttcccttacctgtagcaacacaatcttcaccctgacagtcgcgtggcgcaccgccacgctcattctggctggcgtttccctgcttccggtgtgccaatctagctccatgcggaagacagactggctgcccatggccgtggctgccatgggggtccctcccctccctctgtttatcttctctctcaaggataccctgaaaagacgcagctggccccttaatgagggagtgatggccgttggcctggtgtccatcctggcttctagcctcctgagaaacgacgtccctatggcggggccccttgtggccggaggcctgctcattgcttgttatgttatcaccgggacatccgccgatctgaccgtggaaaaggccgctgacattacatgggaggaagaggccgaacagacgggagtcagccacaacctcatgatcaccgtggacgatgacggcacaatgcggattaaagatgacgagaccgagaatatcctgacagtccttctgaagaccgcgctgctcatcgtgtctggcatttttccgtactccatccctgctacgctgcttgtttggcatacctggcagaaacagacacaacgcagcggggtgctgtgggatgtcccctctcctcccgaaacccagaaggccgagctcgaagagggagtgtacagaattaaacagcagggcatcttcgggaagacacaagttggagtgggcgtccagaaggagggggtgtttcacaccatgtggcacgtgacacggggagccgttctgacgtataacggcaaacgcctcgaaccgaattgggcttccgtcaagaaagacctgattagctacggcgggggatggagactttctgcccagtggcaaaagggcgaggaagtccaggtgatcgcggtcgagcctgggaaaaaccccaagaatttccagaccatgcctggaacattccagaccaccacaggcgaaattggggctatcgccctggattttaagcccggaacgtccggcagccccatcattaaccgggagggcaaagtggttgggctgtatggaaatggcgtggtcaccaagaacgggggatacgtgtccggcatcgcccaaacaaatgctgagcctgacgggccgacccccgaactcgaggaagagatgttcaaaaagcgcaacctgacaattatggatcttcatcctggcagcggaaaaaccagaaagtatctgcccgccatcgttcgggaagctattaagcgcagactccggacgctgatcctcgcccctacaagagtggtcgcggccgagatggaggaagctctgaaaggccttcccatccgctaccagaccaccgccacaaagtctgagcacaccgggcgggaaattgtggacctgatgtgccatgctacatttaccatgagactgctcagccctgttcgcgtgccgaattataacctgatcattatggatgaggcccacttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaaaaccgtgtggttcgtgcctagcattaaggccggcaacgacatcgccaactgtcttcgcaaaaatggaaagaaggtcattcaactgtccagaaaaacatttgataccgaataccagaagacaaaactcaacgactgggatttcgttgtgaccacagacatctctgagatgggcgctaattttaaggccgatcgggtgattgaccccagacggtgcctgaaacccgtcatcctgaccgatgggcctgagcgcgtgatcctcgcgggacccatgcctgttacggccgctagcgccgctcagagacggggccgcgtggggagaaacccgcagaaggaaaatgaccaatatattttcacaggacagccccttaacaatgatgaggaccatgcccactggaccgaagctaagatgctgctggacaacatcaatacccctgagggcattatccccgccctcttcgaacctgagcgggagaaatccgcggccattgatggggaatacagactgaagggcgagagccgcaaaacatttgtcgaacttatgcggagaggagacctgcccgtgtggctcgctcacaaggttgcctctgagggcatcaaatataccgatcgcaagtggtgcttcgacgggcagcggaacaatcagatcctggaagagaacatggatgtggagatttggacaaaagaaggagagaagaagaaactgagaccgcgctggctcgacgctcggacgtactccgatcctcttgccctgaaggaatttaaagagttcgccgctggcagaaagagcatcgcgctggacctcgtcaccgaaattgggcgcgtgccctctcatctggcccacagaacacggaatgctcttgataacctggtcatgctccatacctccgagcacggaggccgcgcctatagacacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagcggacaccgcaggacaatcaactggcctacgtcgttattggaatcctcaccctggctgccatcattgcggccaacgaaatgggccttctggagacaaccaaacgcgatctcggcatgagcaaggaacctggggtggtgtctcccacgtcctatctggacgtcgatctgcatcccgctagcgcctggacactctacgctgtggccaccacagttatcacccctatgcttagacacaccattgaaaattctacagctaacgtgagcctggccgcgatcgccaaccaggctgtcgtgctgatgggactcgacaaaggctggccgatttccaagatggacctgggggtcccccttctggccctcggatgctactctcaggtgaatcctctgacgctgaccgctgccgttctccttctgatcacacattatgccatcattggccccgggctgcaggcgaaagctacccgggaggcccaaaagagaacagctgccggaatcatgaagaaccctaccgtggatggcattatgacgatcgacctcgatcccgtcatttacgacagcaaattcgaaaagcagctgggccaggtgatgcttctggttctctgtgccgtgcagctgctgctcatgcgcacatcctgggctctttgcgaggccctgaccctggcgaccgggcctatcacaaccctctgggaaggatctccgggcaaattttggaatacaacgatcgccgtcagcatggctaacattttccgggggtcctatctggccggagctggccttgcctttagcatcatgaagtctgtggggaccggaaaaagaggcacaggctcccaaggggagaccctgggagaaaagtggaagaaaaagctcaatcagctgagccgcaaagatttcgacctgtacaagaaatccggcattacagaggtggatcggaccgaggcgaaggaagggctcaaaagaggagagatcacgcaccatgccgtttctcggggcagcgctaaacttcagtggtttgtcgaacgcaacatggtgattcccgaggggagagtgatcgacctgggatgtggccggggcgggtggtcctattactgcgccggactgaagaaagtcaccgaagttcgcggctatacaaaagggggacctggccacgaggagcccgtgcctatgtctacctacgggtggaatattgtgaaactcatgagcggaaaggatgtcttctacctgcccccggaaaaatgtgacacacttctgtgcgatatcggcgagtccagcccttctcccaccgtggaagagtccagaacaatccgggttctcaagatggtggagccctggctgaagaacaatcagttctgtattaaagtcctgaacccttatatgcccaccgtgatcgaacacctcgagcgccttcaaagaaagcatggcgggatgctggttcggaatcctctgagccgcaactctacgcacgaaatgtactggatttccaatggaacaggcaacatcgtggctagcgtcaatatggtgtctagactcctgcttaaccggtttaccatgacccatagacgcccgacaattgagaaagacgtggatctgggggccggaacgcggcacgtcaacgctgaacccgagacccctaatatggacgttatcggcgagagaatcaagcgcattaaagaagaacacaacagcacatggcattatgacgatgaaaatccctacaagacctgggcctatcacgggtcctacgaggtgaaggcgacaggatctgccagctccatgatcaacggcgtggtcaaactcctgaccaagccttgggacgtggttcccatggtgacacagatggctatgaccgatacgaccccgttcggccagcaacgggtctttaaagaaaaggtggacacaagaacccctcgcagcatgcccgggacacggagagttatgggaattaccgccgagtggctgtggcgcacgctcggccggaataaaaagcctagactgtgcacacgcgaggagttcaccaagaaagtgcggacaaacgctgccatgggggccgtctttaccgaggaaaatcagtgggattccgcgaaggctgccgtggaggacgaagatttctggaaacttgttgacagagagcgcgagctgcataagctcggaaaatgtggctcttgcgtgtataacatgatggggaagagagagaagaagctgggcgagtttggaaaggccaaaggcagccgggctatctggtacatgtggcttggggcccgctacctggagttcgaggctctcggatttctgaatgaggatcactggttctccagagaaaactcttatagcggcgtcgagggggaaggactgcataagctcggctacattctgcgggacatctccaaaatccccgggggcgccatgtatgcggatgacacggccggatgggacaccagaattacagaggatgaccttcacaatgaagagaagatcacccagcagatggatcctgagcaccggcaactggctaacgccatttttaaactcacataccagaataaggtggtcaaggtgcagcgccccaccccgacaggcaccgttatggacatcatttctagaaaagatcagcgggggagcggacaagtgggcacgtatgggctgaacacattcaccaatatggaagctcagcttatccgccagatggagggagaaggcgtcctgtccaaggccgacctcgagaaccctcatctgcccgagaagaagatcacccagtggctggagacaaaaggggtggagagactcaagcggatggcgattagcggcgatgactgcgtggttaagcccatcgatgaccgctttgccaacgctctgcttgccctgaatgatatgggaaaagtgagaaaggacattcctcaatggcagccgtctaaaggctggcacgattggcagcaggtccccttctgttcccatcacttccacgaactcatcatgaaggacgggcggaaactggtggttccttgccgcccccaagacgagcttattggacgggctcggatcagccagggcgccgggtggtctctgaaggaaaccgcttgtctcggaaaggcctacgcgcagatgtggtccctgatgtattttcatcgcagagatctgcggctcgccagcaacgctatttgctctgccgtgcctgtccactgggtgcccacatcccgcacgacctggagcatccatgcccaccatcaatggatgacaaccgaggacatgctgacagtctggaatagagtgtggatcgaagataacccttggatggaggacaaaacccccgttacgacctgggagaatgtgccgtaccttggcaagcgggaagatcagtggtgtgggtccctgattggcctcacaagcagagctacctgggcccagaacatccctacagcgattcagcaagtccgctctctgatcggaaatgaggagttccttgactacatgcccagcatgaaacggtttagaaaggaggaggaatccgagggcgctatttggtga

SEQ ID NO: 20565 - RNA, 9873 nt, synthetic construct
  misc_feature 1..9873: note = derived and/or modified CDS sequence (opt5) from DENV-3__HM756279__SS-prME
  source 1..9873: mol_type = other RNA
acaagcctgtgcctcatgatgatcctgcccgccgctcttgccttccacctgacatccagagacggagaacctcggatgattgtggggaagaatgaacgcggaaaatctctcctgtttaagacggcgagcggaatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatacagtgatcgggattggcgataacgccctgaaaatcaattggtataagaagggatctagcatcggcaaaatgtttgaagccaccgctagaggggccagacgcatggctattcttggagacaccgcctgggatttcggctccgtcgggggagttctcaacagcctgggcaagatggtccaccagatctttgggtctgcgtacacagccctgttctccggcgtgagctgggtgatgaaaattggaatcggcgtcctcctgacctggattgggcttaattctaagaacacaagcatgtccttttcttgcatcgctattggaatcatcacgctgtatctcggcgccgtggttcaggctgacatggggtgtgtgattaattggaaaggaaaggagctgaagtgcggcagcgggatcttcgtcaccaacgaggtgcatacatggaccgaacagtacaaatttcaagccgattcccccaagcggctggcgacagccattgctggcgcctgggagaatggagtttgtggcatcagaagcaccacgcgcatggaaaaccttctctggaaacagattgctaatgagctgaactatatcctgtgggaaaataacatcaagctcaccgtggtcgtgggggacattatcggagttctggagcagggcaaacggacacttacccctcagcccatggagctgaagtactcttggaaaacatgggggaaggccaagattgtgaccgccgaaacacaaaactccagcttcatcattgatggacctaatacccccgagtgcccgtctgtctccagagcttggaacgtgtgggaagtggaggactatggctttggcgtcttcacgacaaatatctggctcaaactgcgcgaagtttacacccagctgtgtgaccaccggcttatgagcgcggccgtgaaggatgagagagctgtgcacgccgacatggggtactggatcgagtcccagaaaaacggatcttggaagctcgaaaaagccagcctgattgaggtcaagacctgcacatggcctaagtcccataccctgtggtctaatggcgtgctcgaaagcgatatgatcattcccaaatccctggctgggcctatcagccagcacaaccatcgccccggatatcacacgcaaacagccggcccttggcaccttgggaagctggagctcgactttaattactgcgagggaaccacagttgtgattaccgaaaactgtggcacacggggcccctctctgagaaccacgaccgtctccgggaaactgatccatgagtggtgctgtcgcagctgcacacttccgcctctccggtatatgggagaagatggctgttggtacgggatggagatcagacccatttctgaaaaggaggagaatatggtgaaatccctggttagcgcgggatctggcaaggtggacaacttcaccatgggggtcctgtgcctcgctatcctgtttgaagaggtgatgcggggaaagttcggcaaaaagcacatgattgccggcgttttctttacattcgtgcttctgctcagcgggcagatcacctggcgcgatatggcccatacgctgattatgatcggatccaatgctagcgacagaatgggcatgggggtcacatatctggcccttattgcgacctttaaaatccagcccttcctggctctcggatttttcctgcggaagctcacatctagagaaaacctgcttctgggcgtggggctcgccatggccaccaccctgcaactgcctgaggatatcgaacagatggctaatggaattgcccttggcctgatggctctcaaactgatcacacagtttgagacgtaccagctctggaccgccctgatttcccttacatgtagcaacaccatcttcacactgaccgtggcgtggcgcacggccacactcattctggctggcgtctccctgcttccggtttgccaatctagctccatgcggaagaccgactggctgcccatggccgtggctgccatgggggtgcctcccctccctctgtttatcttcggactcaaggataccctgaaaagacgctcttggccccttaatgagggcgtcatggccgtggggctggttagcatcctggcttcctctctcctgagaaacgacgtgcctatggcgggaccccttgtcgccggcgggctgctcattgcttgttatgtgatcacaggaaccagcgccgatctgacagttgaaaaggccgctgacattacgtgggaggaagaggccgaacagaccggcgtgtcccacaacctcatgatcacagtcgacgatgacggcaccatgcggattaaagatgacgagacagagaatatcctgaccgtgcttctgaagacggcgctgctcatcgtcagcgggatttttccgtactctatccctgctaccctgcttgtgtggcatacatggcagaaacagacccaacgctccggagttctgtgggatgtgcccagccctcccgaaacacagaaggccgagctcgaagagggcgtctacagaattaaacagcaggggaacttctgggagacccaagtgggagttggcgtgcagaaggaaggggtctttcacacaatgtggcacgtgacgcggggagccgtgctgacctataatggcaagcgcctcgagccgaactgggcttctgttaaaaaggacctgatctcctacggcgggggatggagacttagcgcccagtggcaaaaaggcgaagaggtccaggtgattgcggtggaacctgggaagaatcccaaaaacttccagacaatgcctggaaccttccagaccacaacgggcgagatcggggctattgccctggattttaagcccggaacctctggctcccccatcatcaatcgggagggcaaggtcgtggggctgtatggaaacggcgttgtgaccaagaatgggggatacgtcagcggcattgcccaaaccaacgctgaacctgacgggccgacacccgagctcgaagaggaaatgttcaagaaacgcaatctgaccatcatggatcttcatcctggctccggaaagacgagaaaatatctgcccgccattgtgcgggaggctatcaagcgcagactccggacactgattctcgcccctaccagagttgtggcggccgagatggaagaggctctgaagggccttcccatccgctaccagaccacagccaccaaaagcgaacacacagggcgggagatcgtcgacctgatgtgccatgctacctttacgatgagactgctctctcctgtgcgcgttccgaactataatctgattatcatggatgaagcccacttcacagaccccgccagcattgctgcgcggggatacatctccaccagagtgggcatgggggaggccgctgccatttttatgacagccacccctcccggaacggctgatgccttccctcagtctaacgcgcccatccaggacgaggaacgcgacatcccggagcggagctggaactccggcaacgaatggattaccgattttgctgggaagacagtctggttcgtgccttctatcaaagccggcaacgacattgccaattgtcttagaaagaacggcaaaaaggtgatccaactgagccgcaagacctttgatacagagtaccagaaaaccaagctcaatgactgggatttcgtcgttacaaccgacatttccgagatgggagctaactttaaagccgatcgggtgatcgaccccagacggtgcctgaagcccgtgattctgacggatgggcctgaacgcgtcatcctcgcgggacccatgcctgtgacagccgcttctgccgctcagagacggggccgcgttgggagaaatccgcagaaagagaacgaccaatatatcttcaccggacagccccttaataacgatgaagaccatgcccactggaccgaggctaagatgctgctggacaatattaacacacctgaaggcatcattcccgccctcttcgagcctgagcgggaaaagagcgcggccatcgatggggagtacagactgaaaggcgaatcccgcaagacctttgtggagcttatgcggagaggagacctgacagtctggctcgctcacaaagtggccagcgaaggcattaagtatacggatcgcaaatggtgcttcgacgggcagcggaataaccagatcctggaggagaatatggatgttgaaatctggaccaaggagggagagaaaaagaagctgagaccccgctggctcgacgctcggacatactctgatccgcttgccctgaaagagtttaaggagttcgccgctggcagaaaatccattgcgctggacctcgtgaccgagatcgggcgcgtccctagccatctggcccacagaacacggaacgctcttgataatctggtgatgctccatacctctgagcacggaggccgcgcctatagacacgccgtcgaagaactgcccgaaacgatggagaccctgctccttctgggcctgatgattctcctgacagggggagctatgctttttctgatctccggcaaggggattggaaaaaccagcatcggcctcatctgtgtgattgcctcctctgggatgctgtggatggcggagatccctctgcaatggattgccagcgctatcgttctcgagttctttatgatggtgcttctgattcccgagcctgaaaagcagcggacaccccaggacaaccaactggcctacgtggtcatcggcattctcaccctggctgccatcatcgcggccaatgagatgggccttctggaaacgacaaagcgcgatctcggcatgtccaaagagccgggggttgtgagccctacctcttatctggacgtggatctgcatcccgcttccgcctggacactctacgctgtcgccaccaccgtgattacacccatgcttagacacacgatcgagaacagcaccgctaacgtttctctggccgcgattgccaatcaggctgtggtcctgatgggactcgacaagggctggcctatcagcaaaatggacctgggggtgccgcttctggccctcggatgctactcccaggtcaaccccctgacactgaccgctgccgtgctccttctgattacacattatgccatcatcggccctgggctgcaggcgaaggctacccgggaagcccagaaacggacggctgccggaattatgaagaatcccacagttgatggcatcatgaccattgacctcgatcctgtgatctacgactctaagttcgagaaacagctgggccaggtcatgcttctggtgctctgtgccgttcagctgctgctcatgcgcaccagctgggctctttgcgaagccctgacactggcgaccgggcccattacaacgctctgggagggatcccctggcaagttttggaacaccacaatcgccgtgtctatggctaatatcttccgggggagctatctggccggagctggccttgccttttccattatgaaaagcgtcgggaccggaaagagaggcacaggctctcaaggggaaaccctgggagagaaatggaagaagaaactcaaccagctgtcccgcaaggatttcgacctgtacaaaaagagcggcatcacggaggtggatcggaccgaagcgaaagaggggctcaagagaggagaaattacacaccatgccgtgtcccggggctctgctaaacttcagtggtttgttgagcgcaatatggtcatcccggaagggagagtgattgacctgggatgtggccggggcgggtggagctattactgcgccggactgaagaaggtgaccgaggtccgcggctatacaaaagggggacccggccacgaggaacctgttcccatgtccacctacgggtggaacatcgtgaagctcatgtctggaaaagatgtgttctacctgcctcccgagaagtgtgacacacttctgtgcgatattggcgaaagctccccgagccctaccgtcgaggagtctagaacgatccgggtgctcaaaatggttgaaccctggctgaagaataaccagttctgtatcaaggtgctgaatccctatatgcctacagtcattgagcacctcgaacgccttcaaagaaaacatggcgggatgctggtgcggaaccccctgtcccgcaatagcacccacgagatgtactggatctctaacggaaccggcaatattgttgcttccgtgaacatggtcagcagactcctgcttaaccggtttacaatgacgcatagacgccctaccatcgaaaaggacgtggatctgggggccggaacacggcacgtgaatgctgagccggagacccccaacatggacgtcattggcgaaagaatcaaacgcatcaaggaggaacacaattctacatggcattatgacgatgagaacccttacaaaacctgggcctatcacgggagctacgaagttaaggcgacaggatccgcctctagcatgattaatggcgtggtgaagctcctgaccaaaccctgggacgtcgtgcctatggttacgcagatggctatgaccgatacaacccccttcggccagcaacgggtgtttaaggagaaagtcgacacaagaaccccgcgctccatgcctgggacgcggagagtgatgggaatcacagccgagtggctgtggcgcaccctcggccggaacaagaaacccagactgtgcacacgcgaagagttcaccaagaaggttcggacgaatgctgccatgggggccgtgtttaccgaagagaaccagtgggatagcgcgaaagctgccgtcgaagacgaggatttctggaaacttgtggacagagagcgcgaactgcataaactcggaaagtgtggctcctgcgtttataatatgatggggaaaagagagaagaaactgggcgaatttggaaaggccaagggctctcgggctatttggtacatgtggcttggggcccgctacctggagttcgaggctctcggatttctgaacgaagatcactggttcagcagagaaaattcctattctggcgtggaaggggagggactgcataaactcggctacatcctgcgggacattagcaagatccctgggggcgccatgtatgcggatgacacagccggatgggacaccagaatcacagaagatgaccttcacaacgaggagaaaattacccagcagatggatcccgaacaccggcaactggctaatgccatctttaagctcacataccagaacaaagtcgtgaaggtccagcgccctacccccacgggcacagtgatggacattatctccagaaaggatcagcgggggtctggacaagttggcacctatgggctgaataccttcacaaacatggaggctcagcttattcgccagatggaaggagagggcgtgctgagcaaagccgacctcgaaaacccgcatctgcctgagaagaaaatcacccagtggctggagacaaagggggtcgaaagactcaaacggatggcgatctccggcgatgactgcgtggtgaagcccattgatgaccgctttgccaatgctctgcttgccctgaacgatatgggaaaggttagaaaagacatcccccaatggcagcctagcaagggctggcacgattggcaacaggtgccgttctgttctcatcacttccacgagctcattatgaaagacgggcggaagctggtcgtgccctgccgccctcaagacgaacttatcggcagagctcggatttcccagggcgccgggtggagcctgaaagagacggcttgtctcggaaaggcctacgcgcagatgtggtctctgatgtattttcatcgcagagatctgcggctcgcctccaatgctatctgcagcgccgttcccgtgcactgggtccctacctctcgcacaacctggtccattcatgcccaccatcaatggatgacaaccgaagacatgctgacggtgtggaacagagtctggatcgaggataatccctggatggaggacaagacccctgtgacaacctgggaaaacgttccctaccttggcaaacgggaggatcagtggtgtgggagcctgatcggcctcacatccagagctacctgggcccagaatattccgacggcgatccagcaagtgcgcagcctgattggaaacgaagagttccttgactacatgccttctatgaagcggtttagaaaagaggaagagagcgaaggcgctatctggtga

SEQ ID NO: 20566 - RNA, 9873 nt, synthetic construct
  misc_feature 1..9873: note = derived and/or modified CDS sequence (opt5) from DENV-3__HQ891025__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattgcgctggacctcgtgaccgaaatcggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgattctcctgacgggaggcgctatgctttttctgatctccgggaaaggaatcggcaagaccagcattgggctcatctgtgtgattgcctcctctggaatgctgtggatggcggagatccccctgcaatggattgccagcgctatcgttctcgagttctttatgatggtgcttctgattcctgaacccgagaagcagcggacaccgcaggacaatcaactggcctacgtggtcatcggcatcctcaccctggctgccattatcgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgattacccctatgcttagacacaccatcgagaatagcacagctaacgtttctctggccgcgattgccaaccaggctgtggtcctgatgggcctcgacaaagggtggccgatcagcaagatggacctgggagtgccccttctggccctcggctgctactcccaggtcaatcctctgacgctgaccgctgccgtgctccttctgatcacacattatgccattatcgggcccggactgcaggcgaaagctacccgggaggcccaaaagagaacagctgccggcattatgaagaaccctaccgttgatggcatcatgacgattgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctatcacaaccctctgggaaggctccccggggaaattttggaatacaacgattgccgtgtctatggctaacatcttccggggaagctatctggccggcgctgggcttgccttttccattatgaaaagcgtcggaaccggcaaaagaggcacagggtctcaaggagagaccctgggcgaaaagtggaagaaaaagctcaatcagctgtcccgcaaagatttcgacctgtacaagaaaagcgggatcacagaggtggatcggaccgaggcgaaggaaggactcaaaagaggcgagattacgcaccatgccgtgtcccgggggtctgctaaacttcagtggtttgttgaacgcaacatggtcatccccgagggaagagtgattgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatatcggcgagagctcccctagccccaccgtcgaagagtctagaacaattcgggtgctcaagatggttgagccctggctgaagaacaatcagttctgtatcaaagtgctgaacccttatatgcccaccgtcattgaacacctcgagcgccttcaaagaaagcatgggggaatgctggtgcggaatcctctgtcccgcaacagcacgcacgaaatgtactggatctctaatggcacagggaacattgttgcttccgtgaatatggtcagcagactcctgcttaaccggtttaccatgacccatagacgcccgacaatcgagaaagacgtggatctgggagccggcacgcggcacgtgaacgctgaacccgagacccctaatatggacgtcatcggggagagaattaagcgcatcaaagaagaacacaactctacatggcattatgacgatgaaaatccctacaagacctgggcctatcacggaagctacgaggttaaggcgacaggctccgcctctagcatgattaacggcgtggtgaaactcctgaccaagccttgggacgtcgtgcccatggttacacagatggctatgaccgatacgaccccgttcgggcagcaacgggtgtttaaagaaaaggtcgacacaagaacccctcgctccatgcccggaacacggagagtgatgggcatcaccgccgagtggctgtggcgcacgctcgggcggaataaaaagcctagactgtgcacacgcgaggagttcaccaagaaagttcggacaaacgctgccatgggagccgtgtttaccgaggaaaatcagtgggatagcgcgaaggctgccgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggctatttggtacatgtggcttggagcccgctacctggagttcgaggctctcggctttctgaatgaggatcactggttcagcagagaaaactcctattctggggtggagggagaaggcctgcataagctcgggtacatcctgcgggacatcagcaaaattcccggcggagccatgtatgcggatgacacggccggctgggacaccagaatcacagaggatgaccttcacaatgaagagaagattacccagcagatggatcctgagcaccggcaactggctaacgccatctttaaactcacataccagaataaggtcgtgaaggtccagcgccccaccccgacagggaccgtgatggacattatctccagaaaagatcagcggggatctggccaagttgggacgtatggactgaacacattcaccaatatggaagctcagcttatccgccagatggagggcgaaggggtgctgagcaaggccgacctcgagaaccctcatctgcccgagaaaaagattacccagtggctggagacaaaaggcgtcgagagactcaagcggatggcgatctccggagatgactgcgtggtgaagcccattgatgaccgctttgccaacgctctgcttgccctgaatgatatgggcaaagttagaaaggacatccctcaatggcagccgagcaaagggtggcacgattggcaacaggtgcccttctgttctcatcacttccacgaactcattatgaaggacggacggaaactggtcgtgccttgccgcccccaagacgagcttatcggcagagctcggatttcccagggggccggatggagcctgaaggaaaccgcttgtctcggcaaggcctacgcgcagatgtggtctctgatgaactttcatcgcagagatctgcggctcgcctccaatgctatctgcagcgccgttcctgtgcactgggtccccacatctcgcacgacctggtccatccatgcccaccatcaatggatgacaaccgaggacatgctgacagtgtggaacagagtctggattgaagataatccttggatggaggacaaaacccccgtgacgacctgggagaacgttccgtatcttgggaagcgggaagatcagtggtgtggcagcctgatcggactcacatccagagctacctgggcccagaatattcctacagcgatccagcaagtgcgcagcctgattggcaacgaggagttccttgactacatgccctctatgaaacggtttagaaaggaggaggaaagcgagggggctatctggtga

SEQ ID NO: 20567 - RNA, 9873 nt, synthetic construct
  misc_feature 1..9873: note = derived and/or modified CDS sequence (opt5) from DENV-3__HQ705617__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttcggatccagcccttcctggctctcggatttttcctgagaaaactcacctctcgcgaaaacctgcttctgggcgtggggctcgccatggccacaaccctgcaactgcctgaggatattgaacagatggctaatggaatcgcccttggcctgatggctctcaagctgattacccagtttgagacataccagctctggacggccctgatctcccttacctgtagcaacacaattttcaccctgacagtggcgtggcggaccgccacgctcatcctggctggcgtctccctgcttccggtttgccaatctagctccatgagaaaaacagactggctgcccatggccgtggctgccatgggggtgcctcccctccctctgtttatcttcggactcaaggataccctgaagcgcagatcttggccccttaatgagggcgtcatggccgtggggctggttagcattctggcttcctctctcctgcggaacgacgtgcctatggcgggaccccttgtcgccggcgggctgctcatcgcttgttatgtgattaccggaacaagcgccgatctgaccgttgaaaaagccgctgacatcacatgggaggaagaggccgaacagacgggcgtgtcccacaacctcatgattaccgtcgacgatgacggcacaatgcgcatcaaggatgacgagaccgagaatatcctgacagtgcttctgaaaaccgcgctgctcattgtcagcgggatctttccgtactctattcctgctacgctgcttgtgtggcatacctggcagaagcagacacaaagatccggagttctgtgggatgtgcccagccctcccgaaacccagaaagccgagctcgaagagggcgtctaccggatcaagcagcaggggattttcggaaaaacacaagtgggcgttggggtgcagaaggagggagtctttcacaccatgtggcacgtgacacgcggcgccgtgctgacgtataacggcaagagactcgaaccgaattgggcttctgttaaaaaggacctgatctcctacgggggaggctggcggcttagcgcccagtggcaaaaaggggaggaagtccaggtgattgcggtggagcctggaaagaaccccaaaaatttccagaccatgcctggcacattccagaccaccacaggggaaatcggagctatcgccctggattttaagcccggcacgtctggctcccccattatcaaccgcgaggggaaggtcgtgggactgtatggcaatggggttgtgaccaaaaacggaggctacgtcagcgggattgcccaaacaaatgctgagcctgacggcccgacccccgaactcgaggaagagatgttcaagaaaagaaacctgacaatcatggatcttcatcctggatccggcaagacccggaaatatctgcccgccattgtgcgcgaagctatcaagagacggctcagaacgctgatcctcgcccctacacgcgttgtggcggccgagatggaggaagctctgaaggggcttcccattcggtaccagaccaccgccacaaaaagcgagcacaccggaagagaaatcgtcgacctgatgtgccatgctacatttaccatgcgcctgctctctcctgtgcgggttccgaattataacctgattatcatggatgaggcccacttcacggaccccgccagcattgctgcgagaggctacatctccacacgcgtggggatgggagaagccgctgccatctttatgaccgccacacctcccggcaccgctgatgccttccctcagtctaatgcgcccattcaggacgaggagcgggacatcccggaaagaagctggaactccgggaatgagtggattacggattttgctggcaagaccgtctggttcgtgccttctatcaaagccggaaacgacattgccaactgtcttcgcaagaatggcaaaaaggtgatccaactgagccggaagacatttgataccgaataccagaaaacaaagctcaacgactgggatttcgtcgttaccacagacatttccgagatgggggctaattttaaagccgatagagtgatcgacccccggcgctgcctgaagcccgtgatcctgaccgatggacctgagagagtcattctcgcgggccccatgcctgtgacggccgcttctgccgctcagcggcgcgggagagttggacggaacccgcagaaagaaaatgaccaatatatcttcacaggccagccccttaacaatgatgaggaccatgcccactggaccgaagctaagatgctgctggacaacattaatacccctgaggggatcattcccgccctcttcgaacctgagagagagaagagcgcggccatcgatggcgaataccgcctgaaaggagagtcccggaagacatttgtggaacttatgagacgcggcgacctgcccgtctggctcgctcacaaagtggccagcgaggggatcaagtataccgatcggaaatggtgcttcgacggacagagaaacaatcagattctggaagagaacatggatgttgagatctggacaaaggaaggcgagaaaaagaagctgcgcccgcggtggctcgacgctagaacgtactctgatcctcttgccctgaaagaatttaaggagttcgccgctgggcgcaaatccattgcgctggacctcgtgaccgaaatcggaagagtccccagccatctggcccaccggacacgcaatgctcttgataacctggtgatgctccatacctctgagcacggcggcagagcctatcggcacgccgtcgaggaactgcctgagacaatggaaaccctgctccttctggggctgatgattctcctgacgggaggcgctatgctttttctgatctccgggaagggaatcggcaaaaccagcattgggctcatctgtgtgattgcctcctctggaatgctgtggatggcggagatccccctgcaatggattgccagcgctatcgttctcgagttctttatgatggtgcttctgattcctgaacccgagaagcagcgcacaccgcaggacaatcaactggcctacgtggtcatcggcatcctcaccctggctgccattatcgcggccaacgaaatgggccttctggagacaaccaagagagatctcgggatgtccaaagaacctggagttgtgagccccacgtcttatctggacgtggatctgcatcccgcttccgcctggacactctacgctgtcgccaccacagtgattacccctatgcttcggcacaccatcgagaatagcacagctaacgtttctctggccgcgattgccaaccaggctgtggtcctgatgggcctcgacaaggggtggccgatcagcaaaatggacctgggagtgccccttctggccctcggctgctactcccaggtcaatcctctgacgctgaccgctgccgtgctccttctgatcacacattatgccattatcgggcccggactgcaggcgaaggctaccagagaggcccaaaaacgcacagctgccggcattatgaagaaccctaccgttgatggcatcatgacgattgacctcgatcccgtgatctacgactctaagttcgaaaaacagctggggcaggtcatgcttctggtgctctgtgccgttcagctgctgctcatgcggacaagctgggctctttgcgaggccctgaccctggcgaccggacctatcacaaccctctgggaaggctccccggggaagttttggaatacaacgattgccgtgtctatggctaacatcttcagaggaagctatctggccggcgctgggcttgccttttccattatgaaaagcgtcggaaccggcaagcgcggcacagggtctcaaggagagaccctgggcgaaaaatggaagaagaaactcaatcagctgtcccggaaggatttcgacctgtacaaaaagagcgggatcacagaggtggatagaaccgaggcgaaagaaggactcaagcggggcgagattacgcaccatgccgtgtcccgcgggtctgctaaacttcagtggtttgttgaaagaaacatggtcatccccgagggacgggtgattgacctgggctgtggccgcgggggatggagctattactgcgccggcctgaagaaggtgaccgaagtcagagggtatacaaaaggaggccctgggcacgaggagcccgttcctatgtccacctacggatggaatatcgtgaagctcatgtctggcaaagatgtgttctacctgcccccggaaaagtgtgacacacttctgtgcgatatcggcgagagctcccctagccccaccgtcgaagagtctcggacaattcgcgtgctcaaaatggttgagccctggctgaagaacaatcagttctgtatcaaggtgctgaacccttatatgcccaccgtcattgaacacctcgagagacttcaacggaaacatgggggaatgctggtgcgcaatcctctgtccagaaacagcacgcacgaaatgtactggatctctaatggcacagggaacattgttgcttccgtgaatatggtcagccggctcctgcttaacagatttaccatgacccatcgccggccgacaatcgagaaggacgtggatctgggagccggcacgagacacgtgaacgctgaacccgagacccctaatatggacgtcatcggggagcgcattaaacggatcaaggaagagcacaactctacatggcattatgacgatgaaaatccctacaaaacctgggcctatcacggaagctacgaggttaaggcgacaggctccgcctctagcatgattaacggcgtggtgaagctcctgaccaaaccttgggacgtcgtgcccatggttacacagatggctatgaccgatacgaccccgttcgggcagcaaagagtgtttaaggaaaaagtcgacacacgcacccctcggtccatgcccggaacaagacgcgtgatgggcatcaccgccgagtggctgtggcggacgctcgggagaaataagaaacctcgcctgtgcacacgggaggaattcaccaagaaggttagaacaaacgctgccatgggagccgtgtttaccgaggaaaatcagtgggatagcgcgaaagctgccgtcgaggacgaagatttctggaagcttgtggaccgcgagagagagctgcataaactcggcaagtgtgggtcctgcgtttataacatgatgggcaaacgggaaaagaaactgggagagtttggcaaggccaaggggtctcgcgctatttggtacatgtggcttggagccagatacctggaattcgaggctctcggctttctgaatgaggatcactggttcagccgggaaaactcctattctggggtggagggagaaggcctgcataaactcgggtacatcctgagagacatcagcaagattcccggcggagccatgtatgcggatgacacggccggctgggacacccggatcacagaggatgaccttcacaatgaagagaaaattacccagcagatggatcctgagcaccgccaactggctaacgccatctttaagctcacataccagaataaagtcgtgaaggtccagagacccaccccgacagggaccgtgatggacattatctcccggaaggatcagcgcggatctggccaagttgggacgtatggactgaacacattcaccaatatggaagctcagcttatcagacagatggagggcgaaggggtgctgagcaaagccgacctcgagaaccctcatctgcccgaaaagaaaattacccagtggctggagacaaagggcgtcgagcggctcaaacgcatggcgatctccggagatgactgcgtggtgaagcccattgatgacagatttgccaacgctctgcttgccctgaatgatatgggcaaggttcggaaagacatccctcaatggcagccgagcaaggggtggcacgattggcagcaggtgcccttctgttctcatcacttccacgaactcattatgaaagacggacgcaagctggtcgtgccttgcagaccccaagacgagcttatcggccgggctcgcatttcccagggggccggatggagcctgaaagaaaccgcttgtctcggcaaggcctacgcgcagatgtggtctctgatgtattttcatagacgggatctgcgcctcgcctccaacgctatctgcagcgccgttcctgtgcactgggtccccacatctagaacgacctggtccatccatgcccaccatcaatggatgacaaccgaggacatgctgacagtgtggaatcgggtctggattgaagataacccttggatggaggacaagacccccgtgacgacctgggagaatgttccgtaccttgggaaaagagaagatcagtggtgtggcagcctgatcggactcacatcccgcgctacctgggcccagaacattcctacagcgatccagcaagtgcggagcctgattggcaatgaggaattccttgactacatgccctctatgaagagatttcgcaaagaggaggaaagcgagggggctatctggtga

SEQ ID NO: 20568 - RNA, 9873 nt, synthetic construct
  misc_feature 1..9873: note = derived and/or modified CDS sequence (opt5) from DENV-3__HQ705619__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcttacatggaatcggaaagagctgctcgtcacctttaagaacgctcacgcgaaaaagcaagaagtggtcgtgctggggtctcaggagggagccatgcacacagctctgaccggcgccaccgaaatccagaatagcgggggcacaagcattttcgccggacatctcaagtgtcgcctgaaaatggacaaacttgagctgaaaggcatgtcttacgctatgtgcacgaacacctttgttctcaagaaagaggtgtccgaaacacagcacgggaccatcctgatcaaggtcgagtacaagggagaagatgtgccttgtaaaattcccttcagcacagaggacggccaagggaaggcccataacggaagactgatcaccgcgaatcctgttgtgacgaaaaaggaggaacccgtcaacattgaggctgaaccccctttcggcgagtccaatatcgtgattgggatcggcgataacgcccttaaaatcaattggtataagaagggatctagcattggcaaaatgtttgaagccacagctagaggggctagacgcatggctatcctcggagacaccgcctgggatttcggctccgtcgggggagttctgaacagcctgggcaagatggtccaccagatttttgggtctgcgtacaccgccctcttctccggcgtgagctgggtgatgaaaatcggaattggcgtcctgcttacatggatcgggctcaattctaagaacaccagcatgtccttttcttgcattgctatcggaatcattacactctatctgggcgccgtggttcaggctgacatggggtgtgtgatcaattggaaaggaaaggagctgaagtgcggcagcgggattttcgtcacgaacgaggtgcatacctggacagaacagtacaaatttcaagccgattccccgaagcggcttgcgaccgccatcgctggcgcctgggagaatggagtttgtggcattagaagcacaacccgcatggaaaacctcctgtggaaacagatcgctaatgagctgaactatatcctctgggaaaataacattaagctgacggtggtcgtgggggacatcattggagttcttgagcagggcaaacggaccctgacaccccagcctatggagctcaagtactcttggaaaacctgggggaaggccaagatcgtgacagccgaaacccaaaactccagcttcattatcgatggacccaatacacctgagtgcccctctgtctccagagcttggaacgtgtgggaagtggaggactatggctttggcgtcttcaccacgaatatctggctgaaactgcgcgaagtttacacacagctttgtgaccaccggctcatgagcgcggccgtgaaggatgagagagctgtgcacgccgacatggggtactggattgagtcccagaaaaacggatcttggaagctggaaaaagccagcctgatcgaggtcaagacctgcacctggccgaagtcccatacactctggtctaatggcgtgctggaaagcgatatgattatccctaaatcccttgctgggcccattagccagcacaaccatcgccctggatatcacacccaaacggccggcccctggcacctggggaagctcgagctggactttaattactgcgagggaacaaccgttgtgatcacagaaaactgtggcacccggggcccttctctgagaacaaccacggtctccgggaaacttatccatgagtggtgctgtcgcagctgcaccctgcccccgctgcggtatatgggagaagatggctgttggtacgggatggagattagacctatctctgaaaaggaggagaatatggtgaaatccctggttagcgcgggatctggcaaggtggacaacttcacaatgggggtcctctgcctggctattctttttgaagaggtgatgcggggaaagttcggcaaaaagcacatgatcgccggcgttttctttaccttcgtgctgctcctgagcgggcagattacatggcgcgatatggcccataccctgatcatgattggatccaatgctagcgacagaatgggcatgggggtcacgtatcttgccctgatcgcgacatttaaaatccagcccttcctcgctctgggatttttcctccggaagctgacctctagagaaaaccttctgctcggcgtggggctggccatggccacaaccctgcaacttcccgaggatattgaacagatggctaatggaatcgccctgggcctcatggctctgaaactcattacccagtttgagacataccagctgtggacggcccttatctccctgacctgtagcaacacaattttcaccctcacagtggcgtggcgcaccgccacgctgatcctggctggcgtctcccttctgcctgtttgccaatctagctccatgcggaagacagactggctcccgatggccgtggctgccatgggggtgccccctctgcccctctttatcttcggactgaaggatacccttaaaagacgctcttggcctctgaatgagggcgtcatggccgtggggctggttagcattctcgcttcctctctgcttagaaacgacgtgcccatggcgggacctctggtcgccggcgggctcctgatcgcttgttatgtgattaccggaacaagcgccgatctcaccgttgaaaaggccgctgacatcacatgggaggaagaggccgaacagacgggcgtgtcccacaacctgatgattaccgtcgacgatgacggcacaatgcggatcaaagatgacgagaccgagaatatccttacagtgctgctgaagaccgcgctcctgattgtcagcgggatctttccctactctattccggctacgcttctggtgtggcatacctggcagaaacagacacaacgctccggagttctctgggatgtgccttctccccctgaaacccagaaggccgagctggaagagggcgtctacagaatcaaacagcaggggattttcggaaagacacaagtgggcgttggggtgcagaaggagggagtctttcacaccatgtggcacgtgacacggggcgccgtgctcacgtataacggcaaacgcctggaacccaattgggcttccgttaagaaagaccttatctcctacgggggaggctggagactgagcgcccagtggcaaaagggggaggaagtccaggtgattgcggtggagccgggcaagaaccctaagaatttccagaccatgcccggcacattccagaccaccacaggggaaatcggagctatcgccctggattttaagcctggcacgtctggctcccccattatcaaccgggaggggaaagtcgtgggactctatggcaatggggttgtgaccaagaacggaggctacgtcagcgggattgcccaaacaaatgctgagcccgacggccctaccccggaactggaggaagagatgttcaaaaagcgcaaccttacaatcatggatctgcatcccggatccggcaaaaccagaaagtatctccctgccattgtgcgggaagctatcaagcgcagactgcggacgctcatcctggcccccacaagagttgtggcggccgagatggaggaagctcttaaagggctgcctattcgctaccagaccaccgccacaaagagcgagcacaccggacgggaaatcgtcgacctgatgtgccatgctacatttaccatgagactcctgtctcccgtgcgcgttcctaattataaccttattatcatggatgaggcccacttcacggacccggccagcattgctgcgcggggctacatctccacaagagtggggatgggagaagccgctgccatctttatgaccgccacaccccctggcaccgctgatgccttcccccagtctaatgcgcctattcaggacgaggagcgcgacatccccgaacggagctggaactccgggaatgagtggattacggattttgctggcaaaaccgtctggttcgtgccgtctatcaaggccggaaacgacattgccaactgtctgcgcaaaaatggcaagaaggtgatccaactcagcagaaaaacatttgataccgaataccagaagacaaaactgaacgactgggatttcgtcgttaccacagacatttccgagatgggggctaattttaaggccgatcgggtgatcgaccctagacggtgcctgaaacccgtgatcctcaccgatggacccgagcgcgtcattcttgcgggccctatgcccgtgacggccgcttctgccgctcagagacgggggcgcgttggaagaaaccctcagaaggaaaatgaccaatatatcttcacaggccagccgctgaacaatgatgaggaccatgcccactggaccgaagctaagatgctgctcgacaacattaatacccccgaggggatcattcctgccctgttcgaacccgagcgggagaaaagcgcggccatcgatggcgaatacagacttaagggagagtcccgcaaaacatttgtggaactgatgcggagaggcgacctccctgtctggctggctcacaaggtggccagcgaggggatcaaatataccgatcgcaagtggtgcttcgacggacagcggaacaatcagattctggaagagaacatggatgttgagatctggacaaaagaaggcgagaagaagaaactcagaccccgctggcttgacgctcggacgtactctgatccgctggccctgaaggaatttaaagagttcgccgctgggagaaagtccattgcgctcgacctggtgaccgaaatcggacgcgtccctagccatcttgcccacagaacacggaatgctctggataacctcgtgatgctgcatacctctgagcacggcggccgcgcctatagacacgccgtcgaggaactgcccgagacaatggaaaccctccttctgctggggctcatgattctgcttacgggaggcgctatgctgtttctcatctccgggaaaggaatcggcaagaccagcattgggctgatctgtgtgattgcctcctctggaatgctgtggatggcggagatccctctccaatggattgccagcgctatcgttcttgagttctttatgatggtgctgctgattcccgaacctgagaagcagcggacaccccaggacaatcaactcgcctacgtggtcatcggcatcctgacccttgctgccattatcgcggccaacgaaatgggcctgctcgagacaaccaaacgcgatctggggatgtccaaggaaccgggagttgtgagccctacgtcttatctggacgtggatctccatcccgcttccgcctggacactttacgctgtcgccaccacagtgattacccccatgctgagacacaccatcgagaatagcacagctaacgtttctctggccgcgattgccaaccaggctgtggtcctcatgggcctggacaaagggtggcctatcagcaagatggaccttggagtgccgctgctcgccctgggctgctactcccaggtcaatcccctgacgctcaccgctgccgtgcttctgctgatcacacattatgccattatcgggcctggactccaggcgaaagctacccgggaggcccaaaagagaacagctgccggcattatgaagaaccccaccgttgatggcatcatgacgattgacctggatcctgtgatctacgactctaaattcgaaaagcagcttgggcaggtcatgctgctcgtgctgtgtgccgttcagctgctccttatgcgcacaagctgggctctgtgcgaggccctgaccctcgcgaccggacccatcacaaccctgtgggaaggctcccctgggaaattttggaatacaacgattgccgtgtctatggctaacatcttccggggaagctatcttgccggcgctgggctggccttttccattatgaaaagcgtcggaaccggcaaaagaggcacagggtctcaaggagagaccctcggcgaaaagtggaagaaaaagctgaatcagctgtcccgcaaagatttcgacctctacaagaaaagcgggatcacagaggtggatcggaccgaggcgaaggaaggacttaaaagaggcgagattacgcaccatgccgtgtcccgggggtctgctaagctgcagtggtttgttgaacgcaacatggtcatcccggagggaagagtgattgacctgggctgtggcagagggggatggagctattactgcgccggcctcaagaaagtgaccgaagtccgcgggtatacaaagggaggccccgggcacgaggagcctgttcccatgtccacctacggatggaatatcgtgaaactgatgtctggcaaggatgtgttctaccttcctcccgaaaaatgtgacacactgctctgcgatatcggcgagagctccccgagccctaccgtcgaagagtctagaacaattcgggtgctgaagatggttgagccctggctgaagaacaatcagttctgtatcaaagtgctcaacccctatatgcctaccgtcattgaacaccttgagcgcctgcaaagaaagcatgggggaatgctggtgcggaatcccctctcccgcaacagcacgcacgaaatgtactggatctctaatggcacagggaacattgttgcttccgtgaatatggtcagcagactgcttctgaaccggtttaccatgacccatagacgccctacaatcgagaaagacgtggatctcggagccggcacgcggcacgtgaacgctgaaccggagacccccaatatggacgtcatcggggagagaattaagcgcatcaaagaagaacacaactctacatggcattatgacgatgaaaatccttacaagacctgggcctatcacggaagctacgaggttaaggcgacaggctccgcctctagcatgattaacggcgtggtgaaactgctgaccaagccctgggacgtcgtgcctatggttacacagatggctatgaccgatacgacccccttcgggcagcaacgggtgtttaaagaaaaggtcgacacaagaaccccgcgctccatgcctggaacacggagagtgatgggcatcaccgccgagtggctctggcgcacgctggggcggaataaaaagcccagactttgcacacgcgaggagttcaccaagaaagttcggacaaacgctgccatgggagccgtgtttaccgaggaaaatcagtgggatagcgcgaaggctgccgtcgaggacgaagatttctggaaactggtggacagagagcgcgagctccataagctgggcaaatgtgggtcctgcgtttataacatgatgggcaagagagagaagaaacttggagagtttggcaaggccaaagggtctcgggctatttggtacatgtggctgggagcccgctacctcgagttcgaggctctgggctttctgaatgaggatcactggttcagcagagaaaactcctattctggggtggagggagaaggcctccataagctggggtacatccttcgggacatcagcaaaattcctggcggagccatgtatgcggatgacacggccggctgggacaccagaatcacagaggatgacctgcacaatgaagagaagattacccagcagatggatcccgagcaccggcaactcgctaacgccatctttaaactgacataccagaataaggtcgtgaaggtccagcgccctacccccacagggaccgtgatggacattatctccagaaaagatcagcggggatctggccaagttgggacgtatggacttaacacattcaccaatatggaagctcagctgatccgccagatggagggcgaaggggtgctcagcaaggccgacctggagaacccgcatctgcctgagaagaagattacccagtggctcgagacaaaaggcgtcgagagactgaagcggatggcgatctccggagatgactgcgtggtgaagcccattgatgaccgctttgccaacgcccttctggccctcaatgatatgggcaaagttagaaaggacatcccccaatggcagcctagcaaagggtggcacgattggcaacaggtgccgttctgttctcatcacttccacgaactgattatgaaggacggacggaaacttgtcgtgccctgccgccctcaagacgagctgatcggcagagctcggatttcccagggggccggatggagcctcaaggaaaccgcttgtctgggcaaggcctacgcgcagatgtggtctctgatgtattttcatcgcagagatctccggctggcctccaacgctatctgcagcgccgttcccgtgcactgggtccctacatctcgcacgacctggtccatccatgcccaccatcaatggatgacaaccgaggacatgcttacagtgtggaatagagtctggattgaagataacccctggatggaggacaaaacccctgtgacgacctgggagaatgttccctacctggggaagcgggaagatcagtggtgtggcagcctcatcggactgacatccagagctacctgggcccagaacattccgacagcgatccagcaagtgcgcagccttattggcaatgaggagttcctggactacatgccttctatgaaacggtttagaaaggaggaggaaagcgagggggctatctggtga

SEQ ID NO: 20569 - RNA, 9873 nt, synthetic construct
  misc_feature 1..9873: note = derived and/or modified CDS sequence (opt5) from DENV-3__HQ705620__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatgggtggggcttaattctaagaacaccagcatgtccttttcttgcatcgctattggaatcatcacactgtacctcggcgccgttgtgcaggctgacatggggtgtgtcattaattggaaaggaaaggagctgaagtgcggcagcgggatcttcgtgacgaacgaggttcacacctggacagaacagtataaatttcaagccgattcccccaagcggctggcgaccgccattgctggcgcctgggagaatggagtgtgtggcatcagaagcacaacccgcatggaaaaccttctctggaaacagattgctaatgagctgaactacatcctgtgggaaaataacatcaagctcacggtcgtggttggggacattatcggagtgctggagcagggcaaacggacccttacacctcagcccatggagctgaagtattcttggaaaacctgggggaaggccaagattgtcacagccgaaacccaaaactccagcttcatcattgatggacctaatacacccgagtgcccgtctgtgtccagagcttggaacgtgtgggaagtcgaggactacggctttggcgttttcaccacgaatatctggctcaaactgcgcgaagtgtatacacagctgtgtgaccaccggcttatgagcgcggccgtgaaggatgagagagctgtccatgccgacatggggtactggatcgagtcccagaaaaacggatcttggaagctcgaaaaagccagcctgattgaggtgaagacctgcacctggcctaagtcccacacactgtggtctaatggcgttctcgaaagcgatatgatcattcccaaatccctggctgggcctatcagccagcataaccaccgccccggataccacacccaaacggccggcccttggcatcttgggaagctggagctcgactttaattattgcgagggaacaaccgtggtcattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggttaaatccctggtgagcgcgggatctggcaaggtcgacaacttcacaatgggggtgctgtgcctcgctatcctgtttgaagaggttatgcggggaaagttcggcaaaaagcatatgattgccggcgtgttctttaccttcgtccttctgctcagcgggcagatcacatggcgcgatatggcccacaccctgattatgatcggatccaatgctagcgacagaatgggcatgggggtgacgtacctggcccttattgcgacatttaaaatccagcccttcctggctctcggatttttcctgcggagactcacctctcgcgaaaacctgcttctgggcgtggggctcgccatggccacaaccctgcaactgcctgaggatatcgaacagatggctaatggaattgcccttggcctgatggctctcaagctgatcacccagtttgagacatatcagctctggacggccctgatttcccttacctgtagcaacacaatcttcaccctgacagtcgcgtggcggaccgccacgctcattctggctggcgtttccctgcttccggtgtgccaatctagctccatgagaaaaacagactggctgcccatggccgtggctgccatgggggtccctcccctccctctgtttatcttctctctcaaggataccctgaagcgcagaagctggccccttaatgagggagtgatggccgttggcctggtgtccatcctggcttctagcctcctgcggaacgacgtccctatggcggggccccttgtggccggaggcctgctcattgcttgttacgttatcaccgggacatccgccgatctgaccgtggaaaaagccgctgacattacatgggaggaagaggccgaacagacgggagtcagccataacctcatgatcaccgtggacgatgacggcacaatgcgcattaaggatgacgagaccgagaatatcctgacagtccttctgaaaaccgcgctgctcatcgtgtctggcatttttccgtattccatccctgctacgctgcttgtttggcacacctggcagaagcagacacaaagaagcggggtgctgtgggatgtcccctctcctcccgaaacccagaaagccgagctcgaagagggagtgtaccggattaagcagcagggcatcttcgggaaaacacaagttggagtgggcgtccagaaggagggggtgtttcacaccatgtggcatgtgacacgcggagccgttctgacgtacaacggcaagagactcgaaccgaattgggcttccgtcaaaaaggacctgattagctatggcgggggatggcggctttctgcccagtggcaaaaaggcgaggaagtccaggtgatcgcggtcgagcctgggaagaaccccaaaaatttccagaccatgcctggaacattccagaccaccacaggcgaaattggggctatcgccctggattttaagcccggaacgtccggcagccccatcattaaccgcgagggcaaggtggttgggctgtacggaaatggcgtggtcaccaaaaacgggggatatgtgtccggcatcgcccaaacaaatgctgagcctgacgggccgacccccgaactcgaggaagagatgttcaagaaaagaaacctgacaattatggatcttcaccctggcagcggaaagacccggaaatacctgcccgccatcgttcgcgaagctattaagagacggctcagaacgctgatcctcgcccctacacgcgtggtcgcggccgagatggaggaagctctgaagggccttcccatccggtatcagaccaccgccacaaaatctgagcataccgggagagaaattgtggacctgatgtgccacgctacatttaccatgcgcctgctcagccctgttcgggtgccgaattacaacctgatcattatggatgaggcccatttcacggaccccgcctccatcgctgcgagaggatatatttctacacgcgtcggcatgggggaagccgctgccatctttatgaccgccacacctcccggaaccgctgatgccttccctcagagcaatgcgcccatccaggacgaggagcgggacattccggaaagatcctggaactctggcaatgagtggatcacggattttgctgggaagaccgtgtggttcgtgcctagcattaaagccggcaacgacatcgccaactgtcttcgcaagaatggcaaaaaggtcattcaactgtcccggaagacatttgataccgaataccagaaaacaaagctcaacgactgggatttcgttgtgaccacagacatctctgagatgggagctaattttaaagccgatagagtgattgacccccggcgctgcctgaagcccgtcatcctgaccgatgggcctgagagagtgatcctcgcgggacccatgcctgttacggccgctagcgccgctcagcggcgcggcagagtggggcggaacccgcagaaagaaaatgaccaatacattttcacaggacagccccttaacaatgatgaggaccacgcccactggaccgaagctaagatgctgctggacaacatcaatacccctgagggcattatccccgccctcttcgaacctgagagagagaagtccgcggccattgatggggaatatcgcctgaaaggcgagagccggaagacatttgtcgaacttatgagacgcggagacctgcccgtgtggctcgctcataaagttgcctctgagggcatcaagtacaccgatcggaaatggtgcttcgacgggcagagaaacaatcagatcctggaagagaacatggatgtggagatttggacaaaggaaggagagaaaaagaagctgcgcccgcggtggctcgacgctagaacgtattccgatcctcttgccctgaaagaatttaaggagttcgccgctggccgcaaaagcatcgcgctggacctcgtcaccgaaattgggagagtgccctctcacctggcccatcggacacgcaatgctcttgataacctggtcatgctccacacctccgagcacggaggcagagcctaccggcatgccgtggaggaactgcctgagacaatggaaaccctgctccttctgggcctgatgatcctcctgacagggggagctatgctttttctgattagcggcaaggggatcggaaaaacctccatcggcctcatttgtgttatcgcctctagcgggatgctgtggatggcggagattcccctgcaatggatcgcctccgctattgtgctcgagttctttatgatggtgcttctgatccctgaacccgagaagcagcgcacaccgcaggacaatcaactggcctatgtcgttattggaatcctcaccctggctgccatcattgcggccaacgaaatgggccttctggagacaaccaagagagatctcggcatgagcaaagaacctggggtggtgtctcccacgtcctacctggacgtcgatctgcaccccgctagcgcctggacactctatgctgtggccaccacagttatcacccctatgcttcggcataccattgaaaattctacagctaacgtgagcctggccgcgatcgccaaccaggctgtcgtgctgatgggactcgacaagggctggccgatttccaaaatggacctgggggtcccccttctggccctcggatgctactctcaggtgaatcctctgacgctgaccgctgccgttctccttctgatcacacactacgccatcattggccccgggctgcaggcgaaggctaccagagaggcccaaaaacgcacagctgccggaatcatgaagaaccctaccgtggatggcattatgacgatcgacctcgatcccgtcatttatgacagcaagttcgaaaaacagctgggccaggtgatgcttctggttctctgtgccgtgcagctgctgctcatgcggacatcctgggctctttgcgaggccctgaccctggcgaccgggcctatcacaaccctctgggaaggatctccgggcaagttttggaatacaacgatcgccgtcagcatggctaacattttcagagggtcctacctggccggagctggccttgcctttagcatcatgaaatctgtggggaccggaaagcgcggcacaggctcccaaggggagaccctgggagaaaaatggaagcggaagctcaatcagctgagcagaaaagatttcgacctgtataagaaatccggcattacagaggtggatcggaccgaggcgaaggaagggctcaaacgcggagagatcacgcatcacgccgtttctagaggcagcgctaaacttcagtggtttgtcgaacggaacatggtgattcccgaggggcgcgtgatcgacctgggatgtggcagaggcgggtggtcctactattgcgccggactgaaaaaggtcaccgaagttcggggctacacaaaagggggacctggccacgaggagcccgtgcctatgtctacctatgggtggaatattgtgaaactcatgagcggaaaggatgtcttctacctgcccccggaaaaatgtgacacacttctgtgcgatatcggcgagtccagcccttctcccaccgtggaagagtcccgcacaatcagagttctcaagatggtggagccctggctgaaaaacaatcagttctgtattaaggtcctgaacccttacatgcccaccgtgatcgaacatctcgagcggcttcaacgcaagcacggcgggatgctggttagaaatcctctgagccggaactctacgcatgaaatgtattggatttccaatggaacaggcaacatcgtggctagcgtcaatatggtgtctagactcctgcttaaccgctttaccatgacccaccggagaccgacaattgagaaagacgtggatctgggggccggaacgcgccacgtcaacgctgaacccgagacccctaatatggacgttatcggcgagcggatcaagagaattaaagaagaacacaacagcacatggcactacgacgatgaaaatccctataagacctgggcctaccatgggtcctatgaggtgaaagcgacaggatctgccagctccatgatcaacggcgtggtcaagctcctgaccaagccttgggacgtggttcccatggtgacacagatggctatgaccgatacgaccccgttcggccagcaacgcgtctttaaagaaaaggtggacacacggacccctagaagcatgcccgggacacgccgggttatgggaattaccgccgagtggctgtggagaacgctcggccgcaataaaaagcctcggctgtgcacaagagaggagttcaccaaaaaggtgcgcacaaacgctgccatgggggccgtctttaccgaggaaaatcagtgggattccgcgaaggctgccgtggaggacgaagatttctggaaacttgttgacagagagcgggagctgcacaagctcggaaaatgtggctcttgcgtgtacaacatgatggggaagcgcgagaagaagctgggcgagtttggaaaagccaagggcagcagagctatctggtatatgtggcttggggcccggtacctggagttcgaggctctcggatttctgaatgaggatcattggttctccagagaaaactcttacagcggcgtcgagggggaaggactgcacaagctcggctatattctgcgggacatctccaaaatccccgggggcgccatgtacgcggatgacacggccggatgggacacccgcattacagaggatgaccttcacaatgaagagaagatcacccagcagatggatcctgagcatagacaactggctaacgccatttttaaactcacatatcagaataaggtggtcaaagtgcagcggcccaccccgacaggcaccgttatggacatcatttctcgcaaggatcagagagggagcggacaagtgggcacgtacgggctgaacacattcaccaatatggaagctcagcttatccggcagatggagggagaaggcgtcctgtccaaggccgacctcgagaaccctcatctgcccgagaagaagatcacccagtggctggagacaaaaggggtggagcgcctcaagagaatggcgattagcggcgatgactgcgtggttaaacccatcgatgaccggtttgccaacgctctgcttgccctgaatgatatgggaaaggtgcgcaaggacattcctcaatggcagccgtctaaaggctggcatgattggcagcaggtccccttctgttcccaccacttccatgaactcatcatgaaggacgggagaaaactggtggttccttgccggccccaagacgagcttattggacgcgctagaatcagccagggcgccgggtggtctctgaaggaaaccgcttgtctcggaaaagcctatgcgcagatgtggtccctgatgtactttcaccggcgcgatctgagactcgccagcaacgctatttgctctgccgtgcctgtccattgggtgcccacatcccggacgacctggagcatccacgcccatcaccaatggatgacaaccgaggacatgctgacagtctggaatagagtgtggatcgaagataacccttggatggaggacaagacccccgttacgacctgggagaatgtgccgtatcttggcaagcgcgaagatcagtggtgtgggtccctgattggcctcacaagccgggctacctgggcccagaacatccctacagcgattcagcaagtcagatctctgatcggaaatgaggagttccttgactacatgcccagcatgaaacgctttcggaaggaggaggaatccgagggcgctatttggtga

SEQ ID NO: 20570 - RNA, 9873 nt, synthetic construct
  misc_feature 1..9873: note = derived and/or modified CDS sequence (opt5) from DENV-3__HQ705621__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggactggctgcccatggccgttgctgccatgggggtgcctcccctccctctgtttattttctctctcaaggatacactgaaaagacgcagctggccccttaatgagggagtgatggccgtcggcctggtgtccatcctggcttctagcctcctgagaaacgacgttcctatggcggggccccttgtggccggaggcctgctcattgcttgttacgtcatcaccgggacctccgccgatctgacagtggaaaaggccgctgacattacctgggaggaagaggccgaacagacaggagttagccataacctcatgatcacggtggacgatgacggcaccatgcggatcaaagatgacgagacagagaatattctgaccgtccttctgaagacagcgctgctcatcgtgtctggcatttttccgtattccatccctgctaccctgcttgtctggcacacgtggcagaaacagacccaacgcagcggggtgctgtgggatgttccctctcctcccgaaacacagaaggccgagctcgaagagggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgaaccgaattgggcttccgtgaagaaagacctgattagctatggcgggggatggagactttctgcccagtggcaaaagggcgaggaagttcaggtcatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtggtcgggctgtacggaaatggcgtggttacgaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtccgggaagctatcaagcgcagactccggaccctgattctcgcccctacgagagtggttgcggccgagatggaggaagctctgaaaggccttcccatccgctatcagacaaccgccaccaagtctgagcatacagggcgggaaattgtggacctgatgtgccacgctacctttacaatgagactgctcagccctgtccgcgtgccgaattacaacctgatcattatggatgaggcccatttcaccgaccccgcctccatcgctgcgcggggatatatctctacgagagttggcatgggggaagccgctgccatttttatgacagccacccctcccggaacagctgatgccttccctcagagcaatgcgcccatccaggacgaggagcgcgacattccggaacggtcctggaactctggcaatgagtggatcaccgattttgctgggaaaacggtgtggttcgtccctagcattaaggccggcaacgacatcgccaactgtcttcgcaaaaatggaaagaaggtgattcaactgtccagaaaaacctttgatacagaataccagaagaccaaactcaacgactgggatttcgtggtcacaaccgacatctctgagatgggcgctaattttaaggccgatcgggttatcgaccccagacggtgcctgaaacccgtgattctgacagatgggcctgagcgcgtgatcctcgcgggacccatgcctgtcaccgccgctagcgccgctcagagacggggccgcgtggggagaaacccgcagaaggaaaatgaccaatacattttcacgggacagccccttaacaatgatgaggaccacgcccactggacagaagctaagatgctgctggacaacatcaatacccctgagggcattatccccgccctcttcgaacctgagcgggagaaatccgcggccatcgatggggaatatagactgaagggcgagagccgcaaaacctttgttgaacttatgcggagaggagacctgcccgtgtggctcgctcataaggtcgcctctgagggcattaaatacacagatcgcaagtggtgcttcgacgggcagcggaacaatcagatcctggaagagaacatggatgtggagatttggaccaaagaaggagagaagaagaaactgagaccgcgctggctcgacgctcggacatattccgatcctcttgccctgaaggaatttaaagagttcgccgctggcagaaagagcatcgcgctggacctcgttacggaaattgggcgcgtgccctctcacctggcccatagaacccggaatgctcttgataacctggtcatgctccacacatccgagcacggaggccgcgcctacagacatgccgtggaggaactgcctgagaccatggaaacactgctccttctgggcctgatgatcctcctgaccgggggagctatgctttttctgatcagcggcaaagggattggaaagacgtccatcggcctcatttgtgtcatcgcctctagcgggatgctgtggatggcggagattcccctgcaatggatcgcctccgctattgtgctcgagttctttatgatggttcttctgatccctgaacccgagaagcagcggaccccgcaggacaatcaactggcctatgtggtgatcggcattctcacactggctgccatcattgcggccaacgaaatgggccttctggagaccacaaaacgcgatctcggcatgagcaaggaacctggggtcgtttctcccacctcctacctggacgtggatctgcaccccgctagcgcctggacgctctatgctgtggccacaaccgtcatcacacctatgcttagacataccattgaaaattctaccgctaacgtgagcctggccgcgatcgccaaccaggctgttgtgctgatgggactcgacaaaggctggccgatctccaagatggacctgggggtcccccttctggccctcggatgctactctcaggtgaatcctctgacactgacggctgccgtcctccttctgattacccactacgccatcattggccccgggctgcaggcgaaagctacacgggaggcccaaaagagaaccgctgccggaatcatgaagaaccctacagtggatggcattatgaccatcgacctcgatcccgttatctatgacagcaaattcgaaaagcagctgggccaggtgatgcttctggtcctctgtgtggttcagctgctgctcatgcgcacgtcctgggccctttgcgaggctctgacactggccaccgggcctattaccacactctgggaaggatctccgggcaaattttggaataccacaatcgcggtgagcatggccaacattttccgggggtcctacctggctggagccggccttgcttttagcatcatgaagtctgtcgggacgggaaaaagaggcaccggctcccaaggggagacactgggagaaaagtggaagaaaaagctcaatcagctgagccgcaaagatttcgacctgtataagaaatccggcattaccgaggtggatcggacagaggccaaggaagggctcaaaagaggagagatcacccatcacgcggtgtctcggggcagcgccaaacttcagtggtttgttgaacgcaacatggtcattcccgaggggagagtgatcgacctgggatgtggccggggcgggtggtcctactattgcgctggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatattggcgagtccagcccttctcccacagtcgaagagtccagaaccatccgggtgctcaagatggttgagccctggctgaagaacaatcagttctgtattaaagtgctgaacccttacatgcccacagtcatcgaacatctcgagcgccttcaaagaaagcacggcgggatgctggtgcggaatcctctgagccgcaactctacccatgaaatgtattggatttccaatggaacgggcaacatcgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcattggcgagagaatcaagcgcattaaagaagaacataacagcacctggcaccatgacgatgaaaatccctacaagacatgggcttatcacgggtcctacgaggttaaggccaccggatctgcgagctccatgatcaacggcgtggtgaaactcctgacaaagccttgggacgtcgtgcccatggttacccagatggccatgacagataccacgccgttcggccagcaacgggtgtttaaagaaaaggtcgacaccagaacacctcgcagcatgcccgggacccggagagtgatgggaattacagctgagtggctgtggcgcaccctcggccggaataaaaagcctagactgtgcacgcgcgaggagttcacaaagaaagttcggaccaacgccgctatgggggccgtgtttacagaggaaaatcagtgggattccgccaaggcggctgtcgaggacgaagatttctggaaacttgtggacagagagcgcgagctgcataagctcggaaaatgtggctcttgcgtttataacatgatggggaagagagagaagaagctgggcgagtttggaaaggccaaaggcagccgggccatctggtacatgtggcttggggctcgctatctggagttcgaggccctcggatttctgaatgaggatcactggttctccagagaaaactcttacagcggcgtggagggggaaggactgcacaagctcggctacatcctgcgggacatttccaaaatccccgggggcgctatgtatgccgatgacaccgcgggatgggacacgagaattaccgaggatgaccttcataatgaagagaagatcacacagcagatggatcctgagcaccggcaactggccaacgctatttttaaactcacctaccagaataaggtcgtgaaggtccagcgccccacaccgaccggcacagtgatggacatcatctctagaaaagatcagcgggggagcggacaagttggcacctatgggctgaacacgttcacaaatatggaagcccagcttattcgccagatggagggagaaggcgtgctgtccaaggctgacctcgagaaccctcatctgcccgagaagaagatcacccagtggctggagaccaaaggggtcgagagactcaagcggatggccattagcggcgatgactgcgtggtgaagcccatcgatgaccgctttgcgaacgccctgcttgctctgaatgatatgggaaaagttagaaaggacattcctcaatggcagccgtctaaaggctggcacgattggcaacaggtgcccttctgttcccaccatttccacgaactcatcatgaaggacgggcggaaactggtcgtgccttgccgcccccaagacgagcttattggacgggcccggatcagccagggcgctgggtggtctctgaaggaaacagcctgtctcggaaaggcttacgcccagatgtggtccctgatgtattttcatcgcagagatctgcggctcgcgagcaacgccatctgctctgctgttcctgtgcactgggtccccacctcccgcacaacgtggagcattcatgcccaccaccaatggatgaccacagaggacatgctgaccgtgtggaatagagtctggatcgaagataacccttggatggaggacaaaacacccgtgaccacgtgggagaatgttccgtaccttggcaagcgggaagatcagtggtgtgggtccctgattggcctcaccagcagagccacatgggctcagaacatccctaccgccattcagcaagtgcgctctctgatcggaaatgaggagttccttgactatatgcccagcatgaaacggtttagaaaggaggaggaatccgagggcgcgatctggtga

SEQ ID NO: 20571 - RNA, 9873 nt, synthetic construct
  misc_feature 1..9873: note = derived and/or modified CDS sequence (opt5) from DENV-3__HQ671176__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatgctagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggactggctgcccatggccgttgctgccatgggggtgcctcccctccctctgtttattttctctctcaaggatacactgaaaagacgcagctggccccttaatgagggagtgatggccgtcggcctggtgtccatcctggcttctagcctcctgagaaacgacgttcctatggcggggccccttgtggccggaggcctgctcattgcttgttacgtcatcaccgggacctccgccgatctgacagtggaaaaggccgctgacattacctgggaggaagaggccgaacagacaggagttagccataacctcatgatcacggtggacgatgacggcaccatgcggatcaaagatgacgagacagagaatattctgaccgtccttctgaagacagcgctgctcatcgtgtctggcatttttccgtattccatccctgctaccctgcttgtctggcacacgtggcagaaacagacccaacgcagcggggtgctgtgggatgttccctctcctcccgaaacacagaaggccgagctcgaagagggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgaaccgaattgggcttccgtgaagaaagacctgattagctatggcgggggatggagactttctgcccagtggcaaaagggcgaggaagttcaggtcatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtggtcgggctgtacggaaatggcgtggttacgaagaacgggggatatgtgtccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtccgggaagctatcaagcgcagactccggaccctgattctcgcccctacgagagtggttgcggccgagatggaggaagctctgaaaggccttcccatccgctatcagacaaccgccaccaagtctgagcatacagggcgggaaattgtggacctgatgtgccacgctacctttacaatgagactgctcagccctgtccgcgtgccgaattacaacctgatcgttatggatgaggcccatttcaccgaccccgcctccattgctgcgcggggatatatctctacgagagtgggcatgggggaagccgctgccatctttatgacagccacccctcccggaacagctgatgccttccctcagagcaatgcgcccattcaggacgaggagcgcgacatcccggaacggtcctggaactctggcaatgagtggattaccgattttgctgggaaaacggtctggttcgtgcctagcatcaaggccggcaacgacattgccaactgtcttcgcaaaaatggaaagaaggtgatccaactgtccagaaaaacctttgatacagaataccagaagaccaaactcaacgactgggatttcgtcgttacaaccgacatttctgagatgggcgctaattttaaggccgatcgggtgatcgaccccagacggtgcctgaaacccgtgatcctgacagatgggcctgagcgcgtcattctcgcgggacccatgcctgtgaccgccgctagcgccgctcagagacggggccgcgttgggagaaacccgcagaaggaaaatgaccaatacatcttcacgggacagccccttaacaatgatgaggaccacgcccactggacagaagctaagatgctgctggacaacattaatacccctgagggcatcattcccgccctcttcgaacctgagcgggagaaatccgcggccatcgatggggaatatagactgaagggcgagagccgcaaaacctttgtggaacttatgcggagaggagacctgcccgtctggctcgctcataaggtggcctctgagggcatcaaatacacagatcgcaagtggtgcttcgacgggcagcggaacaatcagattctggaagagaacatggatgttgagatctggaccaaagaaggagagaagaagaaactgagaccgcgctggctcgacgctcggacatattccgatcctcttgccctgaaggaatttaaagagttcgccgctggcagaaagagcattgcgctggacctcgtgacggaaatcgggcgcgtcccctctcacctggcccatagaacccggaatgctcttgataacctggtgatgctccacacatccgagcacggaggccgcgcctacagacatgccgtcgaggaactgcctgagaccatggaaacactgctccttctgggcctgatgattctcctgaccgggggagctatgctttttctgatcagcggcaaagggatcggaaagacgtccattggcctcatctgtgtgattgcctctagcgggatgctgtggatggcggagatccccctgcaatggattgcctccgctatcgttctcgagttctttatgatggtgcttctgattcctgaacccgagaagcagcggaccccgcaggacaatcaactggcctatgtggtcatcggaatcctcacactggctgccattatcgcggccaacgaaatgggccttctggagaccacaaaacgcgatctcggcatgagcaaggaacctggggttgtgtctcccacctcctacctggacgtggatctgcaccccgctagcgcctggacgctctatgctgtcgccacaaccgtgattacacctatgcttagacataccatcgaaaattctaccgctaacgttagcctggccgcgattgccaaccaggctgtggtcctgatgggactcgacaaaggctggccgatctccaagatggacctgggggtgccccttctggccctcggatgctactctcaggtcaatcctctgacactgacggctgccgtgctccttctgatcacccactacgccattatcggccccgggctgcaggcgaaagctacacgggaggcccaaaagagaaccgctgccggaattatgaagaaccctacagttgatggcatcatgaccattgacctcgatcccgtgatctatgacagcaaattcgaaaagcagctgggccaggtcatgcttctggtgctctgtgccgttcagctgctgctcatgcgcacgtcctgggctctttgcgaggccctgacactggcgaccgggcctatcaccacactctgggaaggatctccgggcaaattttggaataccacaattgccgtgagcatggctaacatcttccgggggtcctacctggccggagctggccttgcctttagcattatgaagtctgtcgggacgggaaaaagaggcaccggctcccaaggggagacactgggagaaaagtggaagaaaaagctcaatcagctgagccgcaaagatttcgacctgtataagaaatccggcatcaccgaggtggatcggacagaggcgaaggaagggctcaaaagaggagagattacccatcacgccgtgtctcggggcagcgctaaacttcagtggtttgttgaacgcaacatggtcatccccgaggggagagtgattgacctgggatgtggccggggcgggtggtcctactattgcgccggactgaagaaagtgacggaagtccgcggctacaccaaagggggacctggccacgaggagcccgttcctatgtctacatatgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttacatgcccacagtcattgaacatctcgagcgccttcaaagaaagcacggcgggatgctggtgcggaatcctctgagccgcaactctacccatgaaatgtattggatctccaatggaacgggcaacattgttgctagcgtgaatatggtctctagactcctgcttaaccggtttacaatgacccacagacgcccgaccatcgagaaagacgtggatctgggggccggaacacggcacgtgaacgctgaacccgagacgcctaatatggacgtcatcggcgagagaattaagcgcatcaaagaagaacacaacagcacctggcactacgacgatgaaaatccctataagacatgggcctaccatgggtcctatgaggttaaggcgaccggatctgccagctccatgattaacggcgtggtgaaactcctgacaaagccttgggacgtcgtgcccatggttacccagatggctatgacagataccacgccgttcggccagcaacgggtgtttaaagaaaaggtcgacaccagaacacctcgcagcatgcccgggacccggagagtgatgggaatcacagccgagtggctgtggcgcaccctcggccggaataaaaagcctagactgtgcacgcgcgaggagttcacaaagaaagttcggaccaacgctgccatgggggccgtgtttacagaggaaaatcagtgggattccgcgaaggctgccgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggctatttggtatatgtggcttggggcccgctacctggagttcgaggctctcggatttctgaatgaggatcattggttctccagagaaaactcttacagcggcgtggagggggaaggactgcacaagctcggctatatcctgcgggacatctccaaaattcccgggggcgccatgtacgcggatgacaccgccggatgggacacgagaatcaccgaggatgaccttcacaatgaagagaagattacacagcagatggatcctgagcatcggcaactggctaacgccatctttaaactcacctatcagaataaggtcgtgaaggtccagcgccccacaccgaccggcacagtgatggacattatctctagaaaagatcagcgggggagcggacaagttggcacctacgggctgaacacgttcacaaatatggaagctcagcttatccgccagatggagggagaaggcgtgctgtccaaggccgacctcgagaaccctcatctgcccgagaagaagattacccagtggctggagaccaaaggggtcgagagactcaagcggatggcgatcagcggcgatgactgcgtggtgaagcccattgatgaccgctttgccaacgctctgcttgccctgaatgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggctcggattagccagggcgccgggtggtctctgaaggaaacagcttgtctcggaaaggcctatgcgcagatgtggtccctgatgtactttcaccgcagagatctgcggctcgccagcaacgctatctgctctgccgttcctgtgcattgggtccccacctcccgcacaacgtggagcatccacgcccatcaccaatggatgaccacagaggacatgctgaccgtgtggaatagagtctggattgaagataacccttggatggaggacaaaacacccgtgaccacgtgggagaatgttccgtatcttggcaagcgggaagatcagtggtgtgggtccctgatcggcctcaccagcagagctacatgggcccagaacattcctaccgcgatccagcaagtgcgctctctgattggaaatgaggagttccttgactacatgcccagcatgaaacggtttagaaaggaggaggaatccgagggcgctatctggtga

SEQ ID NO: 20572 - RNA, 9873 nt, synthetic construct
  misc_feature 1..9873: note = derived and/or modified CDS sequence (opt5) from DENV-3__HQ705609__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtggtcaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccaaggagctgaaatactcttggaagacctgggggaaggccaaaattgtcacagccgaaacccaaaactccagcttcatcattgatggacctaatacacccgagtgcccgtctgtgtccagagcttggaacgtgtgggaagtcgaggactatggctttggcgttttcaccacgaatatctggctcaagctgcgcgaagtgtacacacagctgtgtgaccaccggcttatgagcgcggccgtgaaagatgagagagctgtccacgccgacatggggtactggatcgagtcccagaagaacggatcttggaaactcgaaaaggccagcctgattgaggtgaagacctgcacctggcctaaatcccatacactgtggtctaatggcgttctcgaaagcgatatgatcattcccaagtccctggctgggcctatcagccagcacaaccatcgccccggatatcacacccaaacggccggcccttggcaccttgggaaactggagctcgactttaattactgcgagggaacaaccgtggtcattacagaaaactgtggcacccggggcccctctctgagaacaaccacggtgtccgggaagctgatccatgagtggtgctgtcgcagctgcacccttccgcctctccggtatatgggagaagatggctgttggtacgggatggagatcagacccatttctgaaaaagaggagaatatggttaagtccctggtgagcgcgggatctggcaaggtcgacaacttcacaatgggggtgctgtgcctcgctatcctgtttgaagaggttatgcggggaaaattcggcaagaaacacatgattgccggcgtgttctttaccttcgtccttctgctcagcgggcagatcacatggcgcgatatggcccataccctgattatgatcggatccaatgctagcgacagaatgggcatgggggtgacgtatctggcccttattgcgacatttaagatccagcccttcctggctctcggatttttcctgcggaaactcacctctagagaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacaatcttcaccctgacagtcgcgtggcgcaccgccacgctcattctggctggcgtttccctgcttccggtgtgccaatctagctccatgcggaagacagactggctgcccatggccgtggctgccatgggggtccctcccctccctctgtttatcttctctctcaaagataccctgaagagacgcagctggccccttaatgagggagtgatggccgttggcctggtgtccatcctggcttctagcctcctgagaaacgacgtccctatggcggggccccttgtggccggaggcctgctcattgcttgttatgttatcaccgggacatccgccgatctgaccgtggaaaaagccgctgacattacatgggaggaagaggccgaacagacgggagtcagccacaacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcatacctggcagaagcagacacaacgcagcggggtgctgtgggatgtcccctctcctcccgaaacccagaaagccgagctcgaagagggagtgtacagaattaagcagcagggcatcttcgggaagacacaagttggagtgggcgtccagaaagagggggtgtttcacaccatgtggcacgtgacacggggagccgttctgacgtataacggcaagcgcctcgaaccgaattgggcttccgtcaaaaaggacctgattagctacggcgggggatggagactttctgcccagtggcaaaaaggcgaggaagtgcaggtgatcgcggtcgagcctgggaagaaccccaagaatttccagaccatgcctggaacattccagaccaccacaggcgaaattggggctatcgccctggattttaaacccggaacgtccggcagccccatcattaaccgggagggcaaggtggttgggctgtatggaaatggcgtggtcaccaaaaacgggggatacgtgtccggcatcgcccaaacaaatgctgagcctgacgggccgacccccgaactcgaggaagagatgttcaagaaacgcaacctgacaattatggatcttcatcctggcagcggaaagaccagaaagtatctgcccgccatcgttcgggaagctattaaacgcagactccggacgctgatcctcgcccctacaagagtggtcgcggccgagatggaggaagctctgaagggccttcccatccgctaccagaccaccgccacaaaatctgagcacaccgggcgggaaattgtggacctgatgtgccatgctacatttaccatgagactgctcagccctgttcgcgtgccgaattataacctgatcattatggatgaggcccacttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaagaccgtgtggttcgtgcctagcattaaagccggcaacgacatcgccaactgtcttagaaagaatggaaagaaagtcattcaactgtcccgcaagacatttgataccgaataccagaaaacaaagctcaacgactgggatttcgttgtgaccacagacatctctgagatgggcgctaattttaaagccgatcgggtgattgaccccagacggtgcctgaagcccgtcatcctgaccgatgggcctgagcgcgtgatcctcgcgggacccatgcctgttacggccgctagcgccgctcagagacggggccgcgtggggagaaacccgcagaaggaaaatgaccaatatattttcacaggacagccccttaacaatgatgaggaccatgcccactggaccgaagctaaaatgctgctggacaacatcaatacccctgagggcattatccccgccctcttcgaacctgagcgggagaagtccgcggccattgatggggaatacagactgaaaggcgagagccgcaagacatttgtcgaacttatgcggagaggagacctgcccgtgtggctcgctcacaaagttgcctctgagggcatcaagtataccgatcgcaaatggtgcttcgacgggcagcggaacaatcagatcctggaagagaacatggatgtggagatttggacaaaggaaggagagaagaaaaagctgagaccgcgctggctcgacgctcggacgtactccgatcctcttgccctgaaagaatttaaggagttcgccgctggcagaaaaagcatcgcgctggacctcgtcaccgaaattgggcgcgtgccctctcatctggcccacagaacacggaatgctcttgataacctggtcatgctccatacctccgagcacggaggccgcgcctatagacacgccgtggaggaactgcctgagacaatggaaaccctgctccttctgggcctgatgatcctcctgacggggggagctatgctttttctgattagcggcaaggggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaaacagcggacaccgcaggacaatcaactggcctacgtcgttattggaatcctcaccctggctgccatcattgcggccaacgaaatgggccttctggagacaaccaagcgcgatctcggcatgagcaaagaacctggggtggtgtctcccacgtcctatctggacgtcgatctgcatcccgctagcgcctggacactctacgctgtggccaccacagttatcacccctatgcttagacacaccattgagaattctacagctaacgtgagcctggccgcgatcgccaaccaggctgtcgtgctgatgggactcgacaagggctggccgatttccaaaatggacctgggggtcccccttctggccctcggatgctactctcaggtgaatcctctgacgctgaccgctgccgttctccttctgatcacacattatgccatcattggccccgggctgcaggcgaaggctacccgggaggcccaaaagagaacagctgccggaatcatgaaaaaccctaccgtggatggcattatgacgatcgacctcgatcccgtcatttacgacagcaagttcgaaaaacagctgggccaggtgatgcttctggttctctgtgccgtgcagctgctgctcatgcgcacatcctgggctctttgcgaggccctgaccctggcgaccgggcctatcacaaccctctgggaaggatctccgggcaagttttggaatacaacgatcgccgtcagcatggctaacattttccgggggtcctatctggccggagctggccttgcctttagcatcatgaaatctgtggggaccggaaagagaggcacaggctcccaaggggagaccctgggagaaaagtggaaaaagaaactcaatcagctgagccgcaaggatttcgacctgtacaaaaagtccggcattacagaggtggatcggaccgaggcgaaagaagggctcaagagaggagagatcacgcaccatgccgtttctcggggcagcgctaagcttcagtggtttgtcgaacgcaacatggtgattcccgaggggagagtgatcgacctgggatgtggccggggcgggtggtcctattactgcgccggactgaaaaaggtcaccgaagttcgcggctatacaaaagggggacctggccacgaggagcccgtgcctatgtctacctacgggtggaatattgtgaagctcatgagcggaaaagatgtcttctacctgcccccggaaaagtgtgacacacttctgtgcgatatcggcgagtccagcccttctcccatcgtggaagagtccagaaccattcgggttctcaagatggtggagccctggctgaaaaacaatcagttctgtatcaaggtcctgaacccttatatgcccacagtgattgaacacctcgagcgccttcaaagaaaacatggcgggatgctggttcggaatcctctgagccgcaactctacccacgaaatgtactggatctccaatggaacgggcaacattgtggctagcgtcaatatggtgtctagactcctgcttaaccggtttacaatgacccatagacgcccgaccatcgagaaggacgtggatctgggggccggaacacggcacgtcaacgctgaacccgagacgcctaatatggacgttatcggcgagagaattaaacgcatcaaggaagagcacaacagcacctggcattatgacgatgaaaatccctacaagacatgggcctatcacgggtcctacgaggtgaaagcgaccggatctgccagctccatgattaacggcgtggtcaagctcctgacaaaaccttgggacgtggttcccatggtgacccagatggctatgacagataccacgccgttcggccagcaacgggtctttagagaaaaggtggacacccgcacacctcggagcatgcccgggaccagacgcgttatgggaatcacagccgagtggctgtggcggaccctcggcagaaataaaaagcctcgcctgtgcacgcgggaggaattcacaaagaaagtgagaaccaacgctgccatgggggccgtctttacagaggaaaatcagtgggattccgcgaaggctgccgtggaggacgaagatttctggaaacttgttgaccgcgagagagagctgcataagctcggaaaatgtggctcttgcgtgtataacatgatggggaagcgggaaaaaaagctgggcgagtttggaaaggccaaaggcagccgcgctatttggtacatgtggcttggggccagatacctggaattcgaggctctcggatttctgaatgaggatcactggttctcccgggaaaactcttatagcggcgtcgagggggaaggactgcataagctcggctacatcctgagagacatctccaaaattcccgggggcgccatgtatgcggatgacaccgccggatgggacacgcggatcaccgaggatgaccttcacaatgaagagaagattacacagcagatggatcctgagcaccgccaactggctaacgccatctttaaactcacctaccagaataaggtggtcaaggtgcagagacccacaccgaccggcacagttatggacattatctctcggaaagatcagcgcgggagcggacaagtgggcacctatgggctgaacacgttcacaaatatggaagctcagcttatcagacagatggagggagaaggcgtcctgtccaaggccgacctcgagaaccctcatctgcccgaaaaaaagattacccagtggctggagaccaaaggggtggagcggctcaagcgcatggcgatcagcggcgatgactgcgtggttaagcccattgatgacagatttgccaacgctctgcttgccctgaatgatatgggaaaagtgcggaaggacatccctcaatggcagccgtctaaaggctggcacgattggcagcaggtccccttctgttcccatcacttccacgaactcattatgaaggacgggcgcaaactggtggttccttgcagaccccaagacgagcttatcggacgggctcgcattagccagggcgccgggtggtctctgaaggaaacagcttgtctcggaaaggcctacgcgcagatgtggtccctgatgtattttcatagacgggatctgcgcctcgccagcaacgctatctgctctgccgtgcctgtccactgggtgcccacctccagaacaacgtggagcatccatgcccaccatcaatggatgaccacagaggacatgctgaccgtctggaatcgggtgtggattgaagataacccttggatggaggacaaaacacccgttaccacgtgggagaatgtgccgtaccttggcaagagagaagatcagtggtgtgggtccctgatcggcctcaccagccgcgctacatgggcccagaacattcctaccgcgatccagcaagtccggtctctgattggaaatgaggaattccttgactacatgcccagcatgaaaagatttcgcaaggaggaggaatccgagggcgctatctggtga

SEQ ID NO: 20573 - RNA, 9873 nt, synthetic construct
  misc_feature 1..9873: note = derived and/or modified CDS sequence (opt5) from DENV-3__HQ705610__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacaatttggtctaatggcgtgctggaaagcgatatgatcattcccaaatccctcgctgggcctatcagccagcacaaccatcgccccggatatcacacccaaacggccggcccttggcacctggggaagcttgagctggactttaattactgcgagggaacaaccgttgtgatcacagaaaactgtggcacccggggcccctctctcagaacaaccacggtctccgggaaactgattcatgagtggtgctgtcgcagctgcaccctgccgcctcttcggtatatgggagaagatggctgttggtacgggatggagatcagacccatttctgaaaaggaggagaatatggtgaaatccctcgttagcgcgggatctggcaaggtggacaacttcacaatgggggtcctgtgcctggctatcctctttgaagaggtgatgcggggaaagttcggcaaaaagcacatgattgccggcgttttcctgacctttgtgcttctgctcagcgggcagatcacatggaaagatatggcccataccctgattatgatcggatccaatgctagcgaccgcatgggcatgggggtcacgtatctggcccttatcgcgacattcaagattcagccctttctggctctcggattctttctgagaaaactcacctctcgggaaaacctgcttctgggcgtggggctcgccatggccacaaccctgcaactgcctgaggatatcgaacagatggctaatggaattgcccttggcctgatggctctcaagctgatcacccagttcgagacataccagctctggacggccctgatttcccttacctgtagcaacacaatctccaccctgacagtggcgtggagaaccgccacgctcatcctggctggcgtctctctgcttccggtttgccaaagctcctctatgcgcaagacagactggctgcccatggccgtggctgccatgggggtgcctcccctccctctgtttattttcagcctcaaagataccctgaagcggagatcctggccccttaatgagggagtcatggccgtgggcctggtttctatcctggctagctccctcctgcgcaacgacgtgcctatggcggggccccttgtcgccggaggcctgctcattgcttgttatgtgatcaccgggacaagcgccgatctgaccgttgaaaaagccgctgacattacatgggaggaagaggccgaacagacgggagtgtctcacaacctcatgatcaccgtcgacgatgacggcacaatgagaatcaaggatgacgagaccgagaatattctgacagtgcttctgaaaaccgcgctgctcatcgtctccggcatttttccgtacagcatccctgctacgctgcttgtgtggcatacctggcagaagcagacacaacggtctggggttctgtgggatgtgccctcccctcccgaaacccagaaagccgagctcgaagagggagtctaccgcattaagcagcagggcatcttcgggaagacacaagtgggagttggcgtgcagaaagagggggtctttcacaccatgtggcacgtgacaagaggagccgtgctgacgtataacggcaagcggctcgaaccgaattgggctagcgttaaaaaggacctgatttcttacggcgggggatggcgcctttccgcccagtggcaaaaaggcgaggaagtccaggtgatcgcggtggagcctgggaagaaccccaagaatttccagaccatgcctggaacatttcagaccaccacaggcgaaatcggggctattgccctggatttcaaacccggaacgagcggctcccccatcattaacagagagggcaaggtcgtggggctgtatggaaatggcgttgtgaccaaaaacgggggatacgtcagcggcatcgcccaaacaaatgctgagcctgacgggccgacccccgaactcgaggaagagatgttcaagaaacggaacctgacaattatggatcttcatcctggctctggaaagacccgcaagtatctgcccgccatcgtgagagaagctatcaaacggcgcctcagaacgctgattctcgcccctacacgggttgtggcggccgagatggaggaagctctgaagggccttcccatcagataccagaccaccgccacaaaaagcgagcacaccgggcgcgaaattgtcgacctgatgtgccatgctacatttaccatgcggctgctctcccctgtgagagttccgaattataacctgatcattatggatgaggcccacttcacggaccccgcctctatcgctgcgcgcggatacatcagcacacgggtgggcatgggggaagccgctgccatttttatgaccgccacacctcccggaaccgctgatgccttccctcagtccaatgcgcccatccaggacgaggagagagacattccggaacgctcttggaacagcggcaatgagtggatcacggattttgctgggaagaccgtctggttcgtgccttccattaaagccggcaacgacatcgccaactgtcttcggaagaatggaaagaaagtgattcaactgtctagaaagacatttgataccgaataccagaaaacaaagctcaacgactgggatttcgtcgttaccacagacatcagcgagatgggcgctaattttaaagccgatcgcgtgatcgacccccggagatgcctgaagcccgtgattctgaccgatgggcctgagcgggtcatcctcgcgggacccatgcctgtgacggccgcttccgccgctcagcgcagaggccgggttgggcgcaacccgcagaaggaaaatgaccaatatattttcacaggacagccccttaacaatgatgaggaccatgcccactggaccgaagctaaaatgctgctggacaacatcaatacccctgagggcattatccccgccctctttgaacctgagagagagaagagcgcggccatcgatggggaataccggctgaaaggcgagtctagaaagacattcgtggaacttatgcgccggggagacctgcccgtctggctcgctcacaaagtggcctccgagggcattaagtataccgatagaaaatggtgcttcgacgggcagcgcaacaatcagatcctggaagagaacatggatgttgagatttggacaaaggaaggagagaagaaaaagctgcggccgagatggctcgacgctcgcacgtacagcgatcctcttgccctgaaagaatttaaggagttcgccgctggccggaaatctatcgcgctggacctcgtgaccgaaattgggagagtcccctcccatctggcccaccgcacaagaaatgctcttgataacctggtgatgctccataccagcgagcacggaggccgggcctatcgccacgccgtcgaggaactgcctgagacaatggaaaccctgctccttctgggcctgatgatcctcctgacggggggagctatgctttttctgatctccggcaaggggattggaaagacctctatcggcctcatttgtgtgatcgccagctccgggatgctgtggatggcggagattcccctgcaatggatcgccagcgctattgttctcgagttctttatgatggtgcttctgatccctgaacccgagaaacagagaacaccgcaggacaatcaactggcctacgtggtcatcggaattctcaccctggctgccatcattgcggccaacgaaatgggccttctggagacaaccaagcgggatctcggcatgtctaaagaacctggggttgtgtcccccacgagctatctggacgtggatctgcatcccgcttctgcctggacactctacgctgtcgccaccacagtgatcacccctatgcttcgccacaccattgagaatagcacagctaacgtttccctggccgcgatcgccaaccaggctgtggtcctgatgggactcgacaagggctggccgatctctaaaatggacctgggggtgccccttctggccctcggatgctacagccaggtcaatcctctgacgctgaccgctgccgtgctccttctgattacacattatgccatcattggccccgggctgcaggcgaaggctaccagagaggcccaaaagcggacagctgccggaatcatgaaaaaccctaccgttgatggcattatgacgatcgacctcgatcccgtgatctacgactccaagttcgaaaaacagctgggccaggtcatgcttctggtgctctgtgttgtgcagctgctgctcatgagaacatcttgggccctttgcgaggctctgaccctggccaccgggcctattacaaccctctgggaaggaagcccgggcaagttttggaatacaacgatcgcggtctccatggccaacattttccgcgggagctatctggctggagccggccttgctttttctatcatgaaatccgtggggaccggaaagcggggcacaggcagccaaggggagaccctgggagaaaagtggaaaaagaaactcaatcagctgtccagaaaggatttcgacctgtacaaaaagtctggcattacagaggtggatcgcaccgaggccaaagaagggctcaagcggggagagatcacgcaccatgcggttagcagaggctccgccaagcttcagtggtttgtcgaacggaacatggtgattcccgaggggcgcgtgatcgacctgggatgtggcagaggcgggtggtcttattactgcgctggactgaaaaaggtcaccgaagttcggggctatacaaaagggggacctggccacgaggagcccgtgcctatgagcacctacgggtggaatatcgtgaagctcatgtccggaaaagatgtcttctacctgcccccggaaaagtgtgacacacttctgtgcgatattggcgagagctctccttcccccaccgtggaagagagccgcacaatcagagttctcaagatggtggagccctggctgaaaaacaatcagttttgtattaaggtcctgaacccttatatgcccaccgtgatcgaacacctcgagcggcttcaacgcaaacatggcgggatgctggttagaaatcctctgtctcggaactccacgcacgaaatgtactggattagcaatggaacaggcaacatcgtggcctctgtcaatatggtgagccgcctcctgcttaacagattcaccatgacccatcggagaccgacaatcgagaaggacgtggatctgggggctggaacgcgccacgtcaacgccgaacccgagacccctaatatggacgttattggcgagcggatcaaaagaattaaggaagagcacaactccacatggcattatgacgatgaaaatccctacaagacctgggcttatcacgggtcttacgaggtgaaagccacaggaagcgcgtccagcatgatcaacggcgtggtcaagctcctgaccaaaccttgggacgtggttcccatggtgacacagatggccatgaccgatacgaccccgttcggccagcaacgcgtctttaaggaaaaagtggacacacggacccctagatccatgcccgggacacgccgggttatgggaattaccgctgagtggctgtggagaacgctcggccgcaataagaagcctcggctgtgcacaagagaggaattcaccaaaaaggtgcgcacaaacgccgctatgggggccgtctttaccgaggaaaatcagtgggattctgccaaagcggctgtggaggacgaagatttctggaagcttgttgaccgggagagagagctgcataaactcggaaagtgtggcagctgcgtgtataacatgatggggaaacgcgaaaagaagctgggcgagtttggaaaagccaagggctccagagccatctggtacatgtggcttggggctcggtacctggaattcgaggccctcggatttctgaatgaggatcactggttctctcgcgaaaacagctattccggcgtcgagggggaaggactgcataaactcggctacatcctgagagacatttctaagatccccgggggcgctatgtatgccgatgacacggcgggatgggacacccggattacagaggatgaccttcacaatgaagagaaaatcacccagcagatggatcctgagcacagacaactggccaacgctatttttaagctcacataccagaataaggtggtcaaagtgcagcggcccaccccgacaggcaccgttatggacatcatcagccgcaaggatcagagagggtccggacaagtgggcacgtatgggctgaacacattcaccaatatggaagcccagcttattcggcagatggagggagaaggcgtcctgagcaaagctgacctcgagaaccctcatctgcccgaaaagaaaatcacccagtggctggagacaaagggggtggagcgcctcaagagaatggccatttctggcgatgactgcgtggttaaacccatcgatgaccggtttgcgaacgccctgcttgctctgaatgatatgggaaaggtgcgcaaagacattcctcaatggcagccgtccaagggctggcacgattggcagcaggtccccttctgtagccatcactttcacgaactcatcatgaaagacgggagaaagctggtggttccttgccggccccaagacgagcttattggacgcgccagaatctctcagggcgctgggtggtccctgaaggaaaccgcctgtctcggaaaagcttacgcccagatgtggagcctgatgtatttccatcggcgcgatctgagactcgcgtctaacgccatctgctccgctgtgcctgtccactgggtgcccacaagccggacgacctggtccattcatgcccaccatcaatggatgacaaccgaggacatgctgacagtctggaatcgcgtgtggatcgaagataacccttggatggaggacaagacccccgttacgacctgggagaatgtgccgtaccttggcaaaagagaagatcagtggtgtgggagcctgattggcctcacatctcgggccacctgggctcagaacatccctacagccattcagcaagtcagaagcctgatcggaaatgaggaattccttgactacatgccctccatgaagcgctttcggaaagaggaggaatctgagggcgcgatctggtga

SEQ ID NO: 20574 - RNA, 9873 nt, synthetic construct
  misc_feature 1..9873: note = derived and/or modified CDS sequence (opt5) from DENV-3__HQ705611__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattgcgctggacctcgtgaccgaaatcggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgattctcctgacgggaggcgctatgctttttctgatctccgggaaaggaatcggcaagaccagcattgggctcatctgtgtgattgcctcctctggaatgctgtggatggcggagatccccctgcaatggattgccagcgctatcgttctcgagttctttatgatggtgcttctgattcctgaacccgagaagcagcggacaccgcaggacaatcaactggcctacgtggtcatcggcatcctcaccctggctgccattatcgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgattacccctatgcttagacacaccatcgagaatagcacagctaacgtttctctggccgcgattgccaaccaggctgtggtcctgatgggcctcgacaaagggtggccgatcagcaagatggacctgggagtgccccttctggccctcggctgctactcccaggtcaatcctctgacgctgaccgctgccgtgctccttctgatcacacattatgccattatcgggcccggactgcaggcgaaagctacccgggaggcccaaaagagaacagctgccggcattatgaagaaccctaccgttgatggcatcatgacgattgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctatcacaaccctctgggaaggctccccggggaaattttggaatacaacgattgccgtgtctatggctaacatcttccggggaagctatctggccggcgctgggcttgccttttccattatgaaaagcgtcggaaccggcaaaagaggcacagggtctcaaggagagaccctgggcgaaaagtggaagaaaaagctcaatcagctgtcccgcaaagatttcgacctgtacaagaaaagcgggatcacagaggtggatcggaccgaggcgaaggaaggactcaaaagaggcgagattacgcaccatgccgtgtcccgggggtctgctaaacttcagtggtttgttgaacgcaacatggtcatccccgagggaagagtgattgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatatcggcgagagctcccctagccccaccgtcgaagagtctagaacaattcgggtgctcaagatggttgagccctggctgaagaacaatcagttctgtatcaaagtgctgaacccttatatgcccaccgtcattgaacacctcgagcgccttcaaagaaagcatgggggaatgctggtgcggaatcctctgtcccgcaacagcacgcacgaaatgtactggatctctaatggcacagggaacattgttgcttccgtgaatatggtcagcagactcctgcttaaccggtttaccatgacccatagacgcccgacaatcgagaaagacgtggatctgggagccggcacgcggcacgtgaacgctgaacccgagacccctaatatggacgtcatcggggagagaattaagaaaatcaaggaagaacacaactctacatggcattatgacgatgaaaatccctacaagacctgggcctatcacggaagctacgaggttaaagcgacaggctccgcctctagcatgattaacggcgtggtgaagctcctgaccaaaccttgggacgtcgtgcccatggttacacagatggctatgaccgatacgaccccgttcgggcagcaacgcgtgtttaaggaaaaagtcgacacacggacccctagatccatgcccggaacacgccgggtgatgggcatcaccgccgagtggctgtggagaacgctcgggcgcaataagaagcctcggctgtgcacaagagaggagttcaccaaaaaggttcgcacaaacgctgccatgggagccgtgtttaccgaggaaaatcagtgggatagcgcgaaagctgccgtcgaggacgaagatttctggaaacttgtggaccgggagagagagctgcataaactcggcaagtgtgggtcctgcgtttataacatgatgggcaaacgcgaaaagaagctgggagagtttggcaaagccaaggggtctagagctatttggtacatgtggcttggagcccggtacctggagttcgaggctctcggctttctgaatgaggatcactggttcagccgcgaaaactcctattctggggtggagggagaaggcctgcataaactcgggtacatcctgagagacatcagcaagattcccggcggagccatgtatgcggatgacacggccggctgggacacccggatcacagaggatgaccttcacaatgaagagaaaattacccagcagatggatcctgagcacagacaactggctaacgccatctttaagctcacataccagaataaggtcgtgaaagtccagcggcccaccccgacagggaccgtgatggacattatctcccgcaaggatcagagaggatctggccaagttgggacgtatggactgaacacattcaccaatatggaagctcagcttatccggcagatggagggcgaaggggtgctgagcaaagccgacctcgagaaccctcatctgcccgaaaagaaaattacccagtggctggagacaaagggcgtcgagcgcctcaagagaatggcgatctccggagatgactgcgtggtgaaacccattgatgaccggtttgccaacgctctgcttgccctgaatgatatgggcaaggttcgcaaagacatccctcaatggcagccgagcaaggggtggcacgattggcaacaggtgcccttctgttctcatcacttccacgaactcattatgaaagacggaagaaagctggtcgtgccttgccggccccaagacgagcttatcggccgcgctagaatttcccagggggccggatggagcctgaaggaaaccgcttgtctcggcaaagcctacgcgcagatgtggtctctgatgtattttcatcggcgcgatctgagactcgcctccaacgctatctgcagcgccgttcctgtgcactgggtccccacatctcggacgacctggtccatccatgcccaccatcaatggatgacaaccgaggacatgctgacagtgtggaatcgcgtctggattgaagataacccttggatggaggacaagacccccgtgacgacctgggagaatgttccgtaccttgggaaaagagaagatcagtggtgtggcagcctgatcggactcacatcccgggctacctgggcccagaacattcctacagcgatccagcaagtgagaagcctgattggcaatgaggagttccttgactacatgccctctatgaagcgctttcggaaagaggaggaaagcgagggggctatctggtga

SEQ ID NO: 20575 - RNA, 9873 nt, synthetic construct
  misc_feature 1..9873: note = derived and/or modified CDS sequence (opt5) from DENV-3__HQ705612__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacacaacgtgggaggaagaggccgaacagaccggcgtgtcccacaacctcatgatcacagtcgacgatgacggcaccatgcggattaaagatgacgagacagagaatatcctgaccgtgcttctgaagacggcgctgctcatcgtcagcgggatttttccgtactctatccctgctaccctgcttgtgtggcatacatggcagaaacagacccaacgctccggagttctgtgggatgtgcccagccctcccgaaacacagaaggccgagctcgaagagggcgtctacagaattaaacagcaggggatcttcggaaagacccaagtgggcgttggggtgcagaaggagggagtctttcacacaatgtggcacgtgacgcggggcgccgtgctgacccataacggcaaacgcctcgaaccgaattgggcttctgttaagaaagacctgatttcctatgggggaggctggagacttagcgcccagtggcaaaagggggaggaagtccaggtgatcgcggtggagcctggcaagaaccccaagaatttccagacaatgcctggcaccttccagaccacaacgggggaaattggagctatcgccctggattttaagcccggcacctctggctcccccatcattaaccgggaggggaaagtcgtgggactgtacggcaatggggttgtgacaaagaacggaggctatgtcagcgggatcgcccaaaccaatgctgagcctgacggcccgacacccgaactcgaggaagagatgttcaaaaagcgcaacctgaccattatggatcttcaccctggatccggcaaaacgagaaagtacctgcccgccatcgtgcgggaagctattaagcgcagactccggacactgatcctcgcccctaccagagttgtggcggccgagatggaggaagctctgaaagggcttcccatccgctatcagaccacagccaccaagagcgagcatacaggacgggaaattgtcgacctgatgtgccacgctacctttacgatgagactgctctctcctgtgcgcgttccgaattacaacctgatcattatggatgaggcccatttcacagaccccgccagcatcgctgcgcggggctatatttccaccagagtggggatgggagaagccgctgccatctttatgacagccacccctcccggcacggctgatgccttccctcagtctaatgcgcccatccaggacgaggagcgcgacattccggaacggagctggaactccgggaatgagtggatcaccgattttgctggcaaaacagtctggttcgtgccttctattaaggccggaaacgacatcgccaactgtcttcgcaaaaatggcaagaaggtgattcaactgagcagaaaaacctttgatacagaataccagaagaccaaactcaacgactgggatttcgtcgttacaaccgacatctccgagatgggggctaattttaaggccgatcgggtgattgaccccagacggtgcctgaaacccgtgatcctgacggatggacctgagcgcgtcatcctcgcgggccccatgcctgtgacagccgcttctgccgctcagagacgggggcgcgttggaagaaacccgcagaaggaaaatgaccaatacattttcaccggccagccccttaacaatgatgaggaccacgcccactggaccgaagctaagatgctgctggacaacatcaatacacctgaggggattatccccgccctcttcgaacctgagcgggagaaaagcgcggccattgatggcgaatatagactgaagggagagtcccgcaaaacctttgtggaacttatgcggagaggcgacctgcccgtctggctcgctcataaggtggccagcgaggggatcaaatacacagatcgcaagtggtgcttcgacggacagcggaacaatcagatcctggaagagaacatggatgttgagatttggacgaaagaaggcgagaagaagaaactgagaccgcgctggctcgacgctcggacctattctgatcctcttgccctgaaggaatttaaagagttcgccgctgggagaaagtccatcgcgctggacctcgtgacagaaattggacgcgtccccagccacctggcccatagaacccggaatgctcttgataacctggtgatgctccacacatctgagcacggcggccgcgcctacagacatgccgtcgaggaactgcctgagaccatggaaacgctgctccttctggggctgatgatcctcctgaccggaggcgctatgctttttctgatttccgggaaaggaatcggcaagacaagcatcgggctcatttgtgtgatcgcctcctctggaatgctgtggatggcggagattcccctgcaatggatcgccagcgctattgttctcgagttctttatgatggtgcttctgatccctgaacccgagaagcagcggaccccgcaggacaatcaactggcctatgtggtcattggcatcctcacactggctgccatcattgcggccaacgaaatgggccttctggagaccacgaaacgcgatctcgggatgtccaaggaacctggagttgtgagccccacatcttacctggacgtggatctgcaccccgcttccgcctggaccctctatgctgtcgccacaaccgtgatcacccctatgcttagacatacaattgagaatagcacggctaacgtttctctggccgcgatcgccaaccaggctgtggtcctgatgggcctcgacaaagggtggccgattagcaagatggacctgggagtgccccttctggccctcggctgctactcccaggtcaatcctctgaccctgacagctgccgtgctccttctgatcacccactacgccatcattgggcccggactgcaggcgaaagctacacgggaggcccaaaagagaaccgctgccggcatcatgaagaaccctacggttgatggcattatgacaatcgacctcgatcccgtgatttatgactctaaattcgaaaagcagctggggcaggtcatgcttctggtgctctgtgccgttcagctgctgctcatgcgcaccagctgggctctttgcgaggccctgaccctggcgacaggacctatcaccacactctgggaaggctccccggggaaattttggaatacgaccatcgccgtgtctatggctaacattttccggggaagctacctggccggcgctgggcttgccttttccatcatgaaaagcgtcggaacaggcaaaagaggcaccgggtctcaaggagagacactgggcgaaaagtggaagaaaaagctcaatcagctgtcccgcaaagatttcgacctgtataagaaaagcgggattaccgaggtggatcggacggaggcgaaggaaggactcaaaagaggcgagatcacccatcacgccgtgtcccgggggtctgctaaacttcagtggtttgttgaacgcaacatggtcattcccgagggaagagtgatcgacctgggctgtggcagagggggatggagctactattgcgccggcctgaagaaagtgacagaagtccgcgggtacaccaagggaggccctgggcacgaggagcccgttcctatgtccacatatggatggaatattgtgaaactcatgtctggcaaggatgtgttctacctgcccccggaaaaatgtgacacccttctgtgcgatatcggcgagagctcccctagccccacagtcgaagagtctagaaccatccgggtgctcaagatggttgagccctggctgaagaacaatcagttctgtattaaagtgctgaacccttacatgcccacggtcatcgaacatctcgagcgccttcaaagaaagcacgggggaatgctggtgcggaatcctctgtcccgcaacagcacacatgaaatgtattggatttctaatggcaccgggaacatcgttgcttccgtgaatatggtcagcagactcctgcttaaccggtttaccatgacacacagacgcccgacgattgagaaagacgtggatctgggagccggcacccggcacgtgaacgctgaacccgagacacctaatatggacgtcatcggggagagaatcaagcgcattaaagaagaacacaactctacctggcactacgacgatgaaaatccctataagacatgggcctaccatggaagctatgaggttaaggcgaccggctccgcctctagcatgatcaacggcgtggtgaaactcctgacaaagccttgggacgtcgtgcccatggttacccagatggctatgacggataccacaccgttcgggcagcaacgggtgtttaaagaaaaggtcgacaccagaacacctcgctccatgcccggaacccggagagtgatgggcattacggccgagtggctgtggcgcacactcgggcggaataaaaagcctagactgtgcacccgcgaggagttcacaaagaaagttcggaccaacgctgccatgggagccgtgtttacggaggaaaatcagtgggatagcgcgaaggctgccgtcgaggacgaagatttctggaaacttgtggacagagagcgcgagctgcacaagctcggcaaatgtgggtcctgcgtttacaacatgatgggcaagagagagaagaagctgggagagtttggcaaggccaaagggtctcgggctatctggtatatgtggcttggagcccgctacctggagttcgaggctctcggctttctgaatgaggatcattggttcagcagagaaaactcctactctggggtggagggagaaggcctgcacaagctcgggtatattctgcgggacatcagcaaaatccccggcggagccatgtacgcggatgacaccgccggctgggacacaagaattaccgaggatgaccttcacaatgaagagaagatcacacagcagatggatcctgagcatcggcaactggctaacgccatttttaaactcacctatcagaataaggtcgtgaaggtccagcgccccacaccgaccgggacggtgatggacatcatttccagaaaagatcagcggggatctggccaagttgggacatacggactgaacaccttcaccaatatggaagctcagcttatccgccagatggagggcgaaggggtgctgagcaaggccgacctcgagaaccctcatctgcccgagaaaaagatcacacagtggctggagaccaaaggcgtcgagagactcaagcggatggcgatttccggagatgactgcgtggtgaagcccatcgatgaccgctttgccaacgctctgcttgccctgaatgatatgggcaaagttagaaaggacattcctcaatggcagccgagcaaagggtggcatgattggcaacaggtgcccttctgttctcaccacttccatgaactcatcatgaaggacggacggaaactggtcgtgccttgccgcccccaagacgagcttattggcagagctcggatctcccagggggccggatggagcctgaaggaaacagcttgtctcggcaaggcctatgcgcagatgtggtctctgatgtactttcaccgcagagatctgcggctcgcctccaacgctatttgcagcgccgttcctgtgcattgggtccccacgtctcgcaccacatggtccatccacgcccatcaccaatggatgaccacagaggacatgctgaccgtgtggaatagagtctggatcgaagataacccttggatggaggacaaaacgcccgtgaccacatgggagaatgttccgtatcttgggaagcgggaagatcagtggtgtggcagcctgattggactcacctccagagctacatgggcccagaacatccctaccgcgattcagcaagtgcgcagcctgatcggcaatgaggagttccttgactacatgccctctatgaaacggtttagaaaggaggaggaaagcgagggggctatttggtga

SEQ ID NO: 20576 - RNA, 9873 nt, synthetic construct
  misc_feature 1..9873: note = derived and/or modified CDS sequence (opt5) from DENV-3__HQ705613__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaattatcagaccatgcctggcacattccagaccaccacaggggaaatcggagctatcgccctggatttcaagcccggcacgtctggctcccccattatcaaccgggaggggaaagtcgtgggactgtacggcaatggggttgtgaccaagaacggaggctatgtcagcgggattgcccaaacaaatgctgagcctgacggcccgacccccgaactcgaggaagagatgtttaaaaagcgcaacctgacaatcatggatcttcatcctggatccggcaaaaccagaaagtacctgcccgccattgtgcgggaagctatcaagcgcagactccggacgctgatcctcgcccctacaagagttgtggcggccgagatggaggaagctctgaaagggcttcccattcgctatcagaccaccgccacaaagagcgagcacaccggacgggaaatcgtcgacctgatgtgccatgctacattcaccacgagactgctctctcctgtgcgcgttccgaattacaacctgattatcatggatgaggcccactttacagaccccgccagcattgctgcgcggggctacatctccaccagagtggggatgggagaagccgctgccatcttcatgacagccacccctcccggcacggctgatgcctttcctcagtctaatgcgcccattcaggacgaggagcgcgacatcccggaacggagctggaactccgggaatgagtggattaccgatttcgctggcaaaacagtctggtttgtgccttctatcaaggccggaaacgacattgccaactgtcttcgcaaaaatggcaagaaggtgatccaactgagcagaaaaaccttcgatacagaatatcagaagaccaaactcaacgactgggattttgtcgttacaaccgacatttccgagatgggggctaatttcaaggccgatcgggtgatcgaccccagacggtgcctgaaacccgtgatcctgacggatggacctgagcgcgtcattctcgcgggccccatgcctgtgacagccgcttctgccgctcagagacgggggcgcgttggaagaaacccgcagaaggaaaatgaccaatacatctttaccggccagccccttaacaatgatgaggaccatgcccactggaccgaagctaagatgctgctggacaacattaatacacctgaggggatcattcccgccctcttcgaacctgagcgggagaaaagcgcggccatcgatggcgaatatagactgaagggagagtcccgcaaaaccttcgtggaacttatgcggagaggcgacctgcccgtctggctcgctcacaaggtggccagcgaggggatcaaatacacagatcgcaagtggtgctttgacggacagcggaacaatcagattctggaagagaacatggatgttgagatctggacgaaagaaggcgagaagaagaaactgagaccgcgctggctcgacgctcggacctattctgatcctcttgccctgaaggagttcaaagagtttgccgctgggagaaagtccattgcgctggacctcgtgacagaaatcggacgcgtccccagccatctggcccacagaacccggaatgctcttgataacctggtgatgctccatacatctgagcacggcggccgcgcctacagacacgccgtcgaggaactgcctgagaccatggaaacgctgctccttctggggctgatgattctcctgaccggaggcgctatgcttttcctgatctccgggaaaggaatcggcaagacaagcattgggctcatctgtgtgattgcctcctctggaatgctgtggatggcggagatccccctgcaatggattgccagcgctatcgttctcgagtttttcatgatggtgcttctgattcctgaacccgagaagcagcggaccccgcaggacaatcaactggcctatgtggtcatcggcatcctcacactggctgccattatcgcggccaacgaaatgggccttctggagaccacgaaacgcgatctcgggatgtccaaggaacctggagttgtgagccccacatcttacctggacgtggatctgcatcccgcttccgcctggaccctctacgctgtcgccacaaccgtgattacccctatgcttagacacacaatcgagaatagcacggctaacgtttctctggccgcgattgccaaccaggctgtggtcctgatgggcctcgacaaagggtggccgatcagcaagatggacctgggagtgccccttctggccctcggctgctattcccaggtcaatcctctgaccctgacagctgccgtgctccttctgatcacccattacgccattatcgggcccggactgcaggcgaaagctacacgggaggcccaaaagagaaccgctgccggcattatgaagaaccctacggttgatggcatcatgacaattgacctcgatcccgtgatctatgactctaaatttgaaaagcagctggggcaggtcatgcttctggtgctctgtgccgttcagctgctgctcatgcgcaccagctgggctctttgcgaggccctgaccctggcgacaggacctatcaccacactctgggaaggctccccggggaaattctggaatacgaccattgccgtgtctatggctaacatctttcggggaagctacctggccggcgctgggcttgccttctccattatgaaaagcgtcggaacaggcaaaagaggcaccgggtctcaaggagagacactgggcgaaaagtggaagaaaaagctcaatcagctgtcccgcaaagattttgacctgtataagaaaagcgggatcaccgaggtggatcggacggaggcgaaggaaggactcaaaagaggcgagattacccaccatgccgtgtcccgggggtctgctaaacttcagtggttcgttgaacgcaacatggtcatccccgagggaagagtgattgacctgggctgtggcagagggggatggagctactattgcgccggcctgaagaaagtgacagaagtccgcgggtacaccaagggaggccctgggcacgaggagcccgttcctatgtccacatacggatggaatatcgtgaaactcatgtctggcaaggatgtgttttatctgcccccggaaaaatgtgacacccttctgtgcgatatcggcgagagctcccctagccccacagtcgaagagtctagaaccattcgggtgctcaagatggttgagccctggctgaagaacaatcagttctgtatcaaagtgctgaacccttacatgcccacggtcattgaacacctcgagcgccttcaaagaaagcatgggggaatgctggtgcggaatcctctgtcccgcaacagcacacacgaaatgtattggatctctaatggcaccgggaacattgttgcttccgtgaatatggtcagcagactcctgcttaaccggttcaccatgacacatagacgcccgacgatcgagaaagacgtggatctgggagccggcacccggcacgtgaacgctgaacccgagacacctaatatggacgtcatcggggagagaattaagcgcatcaaagaagaacacaactctacctggcattacgacgatgaaaatccctataagacatgggcctaccacggaagctatgaggttaaggcgaccggctccgcctctagcatgattaacggcgtggtgaaactcctgacaaagccttgggacgtcgtgcccatggttacccagatggctatgacggataccacaccgtttgggcagcaacgggtgttcaaagaaaaggtcgacaccagaacacctcgctccatgcccggaacccggagagtgatgggcatcacggccgagtggctgtggcgcacactcgggcggaataaaaagcctagactgtgcacccgcgaggaatttacaaagaaagttcggaccaacgctgccatgggagccgtgttcacggaggaaaatcagtgggatagcgcgaaggctgccgtcgaggacgaagatttttggaaacttgtggacagagagcgcgagctgcataagctcggcaaatgtgggtcctgcgtttacaacatgatgggcaagagagagaagaagctgggagagttcggcaaggccaaagggtctcgggctatttggtacatgtggcttggagcccgctatctggaatttgaggctctcggcttcctgaatgaggatcactggtttagcagagaaaactcctactctggggtggagggagaaggcctgcataagctcgggtatatcctgcgggacatcagcaaaattcccggcggagccatgtacgcggatgacaccgccggctgggacacaagaatcaccgaggatgaccttcacaatgaagagaagattacacagcagatggatcctgagcaccggcaactggctaacgccatcttcaaactcacctatcagaataaggtcgtgaaggtccagcgccccacaccgaccgggacggtgatggacattatctccagaaaagatcagcggggatctggccaagttgggacatacggactgaacacctttaccaatatggaagctcagcttatccgccagatggagggcgaaggggtgctgagcaaggccgacctcgagaaccctcatctgcccgagaaaaagattacacagtggctggagaccaaaggcgtcgagagactcaagcggatggcgatctccggagatgactgcgtggtgaagcccattgatgaccgcttcgccaacgctctgcttgccctgaatgatatgggcaaagttagaaaggacatccctcaatggcagccgagcaaagggtggcacgattggcaacaggtgcccttttgttctcatcacttccacgaactcattatgaaggacggacggaaactggtcgtgccttgccgcccccaagacgagcttatcggcagagctcggatttcccagggggccggatggagcctgaaggaaacagcttgtctcggcaaggcctatgcgcagatgtggtctctgatgtacttccatcgcagagatctgcggctcgcctccaacgctatctgcagcgccgttcctgtgcactgggtccccacgtctcgcaccacatggtccatccatgcccaccatcaatggatgaccacagaggacatgctgaccgtgtggaatagagtctggattgaagataacccttggatggaggacaaaacgcccgtgaccacatgggagaatgttccgtaccttgggaagcgggaagatcagtggtgtggcagcctgatcggactcacctccagagctacatgggcccagaacattcctaccgcgatccagcaagtgcgcagcctgattggcaatgaggaatttcttgactatatgccctctatgaaacggttcagaaaggaggaggaaagcgagggggctatctggtga

SEQ ID NO: 20577 - RNA, 9873 nt, synthetic construct
  misc_feature 1..9873: note = derived and/or modified CDS sequence (opt5) from DENV-3__HQ705615__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctgacatcacatgggaggaagaggccgaacagacgggagtgagccacaacctcatgattgcggtcgacgatgacggcaccatgcggatcaaagatgacgagacagagaatatcctgaccgtgcttctgaagacagctctgctcattgtctctggcatctttccgtactccattcctgccaccctgcttgtgtggcatacgtggcagaaacagacccaacgcagcggggttctgtgggatgtgccctctcctcccgaaacacagaaggccgagctcgaagagggagtctacagaatcaaacagcagggcattttcgggaagacccaagtgggagttggcgtgcagaaggagggggtctttcacacaatgtggcacgtgacccggggagctgtgctgacatataacggcaaacgcctcgaaccgaattgggcctccgttaagaaagacctgatcagctacggcgggggatggagactttctgcgcagtggcaaaagggcgaggaagtccaggtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtatggaaatggcgttgtgacgaagaacgggggatacgtctccggcattgctcaaaccaatgccgagcctgacgggccgacacccgaactcgaggaagagatgttcaaaaagcgcaacctgaccatcatggatcttcatcctggcagcggaaaaacaagaaagtatctgcccgctattgtgcgggaagccatcaagcgcagactccggaccctgatcctcgcgcctacgagagttgtggccgctgagatggaggaagccctgaaaggccttcccattcgctaccagacaaccgctaccaagtctgagcacacagggcgggaaatcgtcgacctgatgtgccatgccacctttacaatgagactgctcagccctgtgcgcgttccgaattataacctgattatcatggatgaggcccacttcaccgaccccgcttccattgcggcccggggatacatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccaactgtccagaaaaacctttgatacagaataccagaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatatatcttcacgggacagccccttaacaatgatgaggaccatgctcactggacagaagccaagatgctgctggacaacattaatacccctgagggcatcattcccgccctcttcgaacctgagcgggagaaatccgccgctatcgatggggaatacagactgaagggcgagagccgcaaaacctttgtggaacttatgcggagaggagacctgcccgtctggctcgcccacaaggtggcttctgagggcatcaaatatacagatcgcaagtggtgcttcgacgggcagcggaacaatcagattctggaagagaacatggatgttgagatctggaccaaagaaggagagaagaagaaactgagaccgcgctggctcgacgcccggacatactccgatcctcttgccctgaaggaatttaaagagttcgctgcgggcagaaagagcattgccctggacctcgtgacggaaatcgggcgcgtcccctctcatctggctcacagaacccggaatgcccttgataacctggtgatgctccatacatccgagcacggaggccgcgcctatagacacgctgtcgaggaactgcctgagaccatggaaacactgctccttctgggcctgatgattctcctgaccgggggagccatgctttttctgatcagcggcaaagggatcggaaagacgtccattggcctcatctgtgtgattacctctagcgggatgctgtggatggcggagatccccctgcaatggattgcctccgctatcgttctcgagttctttatgatggtgcttctgattcctgaacccgagaagcagcggacaccgcaggacaatcaactggcctacgtggtcatcggaatcctcaccctggctgccattatcgcggccaacgaaatgggccttctggagacaaccaaacgcgatctcggcatgagcaaggaacctggggttgtgtctcccacgtcctatctggacgtggatctgcatcccgctagcgcctggacactctacgctgtcgccaccacagtgattacccctatgcttagacacaccatcgaaaattctacagctaacgttagcctggccgcgattgccaaccaggctgtggtcctgatgggactcgacaaaggctggccgatctccaagatggacctgggggtgccccttctggccctcggatgctactctcaggtcaatcctctgacgctgaccgctgccgtgctccttctgatcacacattatgccattatcggccccgggctgcaggcgaaagctacccgggaggcccaaaagagaacagctgccggaattatgaagaaccctaccgttgatggcatcatgacgattgacctcgatcccgtgatctacgacagcaaattcgaaaagcagctgggccaggtcatgcttctggtgctctgtgccgttcagctgctgctcatgcgcacatcctgggctctttgcgaggccctgaccctggcgaccgggcctatcacaaccctctgggaaggatctccgggcaaattttggaatacaacgattgccgtgagcatggctaacatcttccgggggtcctatctggccggagctggccttgcctttagcattatgaagtctgtcgggaccggaaaaagaggcacaggctcccaaggggagaccctgggagaaaagtggaagaaaaagctcaatcagctgagccgcaaagatttcgacctgtacaagaaatccggcatcacagaggtggatcggaccgaggcgaaggaagggctcaaaagaggagagattacgcaccatgccgtgtctcggggcagcgctaaacttcagtggtttgttgaacgcaacatggtcatccccgaggggagagtgattgacctgggatgtggccggggcgggtggtcctatcactgcgccggactgaagaaagtgaccgaagtccgcggctacacaaaagggggacctggccacgaggagcccgttcctatgtctacctatgggtggaatatcgtgaaactcatgagcggaaaggatgtgttctacctgcccccggaaaaatgtgacacacttctgtgcgatatcggcgagtccagcccttctcccaccgtcgaagagtccagaacaattcgggtgctcaagatggttgagccctggctgaagaacaatcagttctgtatcaaagtgctgaacccttacatgcccaccgtcattgaacatctcgagcgccttcaaagaaagcacggcgggatgctggtgcggaatcctctgagccgcaactctacgcatgaaatgtattggatctccaatggaacaggcaacattgttgctagcgtgaatatggtctctagactcctgcttaaccggtttaccatgacccacagacgcccgacaatcgagaaagacgtggatctgggggccggaacgcggcacgtgaacgctgaacccgagacccctaatatggacgtcatcggcgagagaattaagcgcatcaaagaagaacacaacagcacatggcactacgacgatgaaaatccctataagacctgggcctaccatgggtcctatgaggttaaggcgacaggatctgccagctccatgattaacggcgtggtgaaactcctgaccaagccttgggacgtcgtgcccatggttacacagatggctatgaccgatacgaccccgttcggccagcaacgggtgtttaaagaaaaggtcgacacaagaacccctcgcagcatgcccgggacacggagagtgatgggaatcaccgccgagtggctgtggcgcacgctcggccggaataaaaagcctagactgtgcacacgcgaggagttcaccaagaaagttcggacaaacgctgccatgggggccgtgtttaccgaggaaaatcagtgggattccgcgaaggctgccgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggctatttggtatatgtggcttggggcccgctacctggagttcgaggctctcggatttctgaatgaggatcattggttctccagagaaaactcttacagcggcgtggagggggaaggactgcacaagctcggctatatcctgcgggacatctccaaaattcccgggggcgccatgtacgcggatgacacggccggatgggacaccagaatcacagaggatgaccttcacaatgaagagaagattacccagcagatggatcctgagcatcggcaactggctaacgccatctttaaactcacatatcagaataaggtcgtgaaggtccagcgccccaccccgacaggcaccgtgatggacattatctctagaaaagatcagcgggggagcggacaagttggcacgtacgggctgaacacattcaccaatatggaagctcagcttatccgccagatggagggagaaggcgtgctgtccaaggccgacctcgagaaccctcatctgcccgagaagaagattacccagtggctggagacaaaaggggtcgagagactcaagcggatggcgatcagcggcgatgactgcgtggtgaagcccattgatgaccgctttgccaacgctctgcttgccctgaatgatatgggaaaagttagaaaggacatccctcaatggcagccgtctaaaggctggcatgattggcaacaggtgcccttctgttcccaccacttccatgaactcattatgaaggacgggcggaaactggtcgtgccttgccgcccccaagacgagcttatcggacgggctcggattagccagggcgccgggtggtctctgaaggaaaccgcttgtctcggaaaggcctatgcgcagatgtggtccctgatgtactttcaccgcagagatctgcggctcgccagcaacgctatctgctctgccgttcctgtgcattgggtccccacatcccgcacgacctggagcatccacgcccatcaccaatggatgacaaccgacgatatgctgacagtgtggaatagagtctggattgaggacaacccttggatggaagataaaacccccgtgacgacctgggagaatgttccgtatcttggcaagcgggaggaccagtggtgtgggtccctgatcggcctcacaagcagagctacctgggcccagaacattcctacagcgatccagcaagtgcgctctctgattggaaatgaagagttccttgattacatgcccagcatgaaacggtttagaaaggaagaggagtccgaaggcgctatctggtga

SEQ ID NO: 20578 - RNA, 9873 nt, synthetic construct
  misc_feature 1..9873: note = derived and/or modified CDS sequence (opt5) from DENV-3__JF920398__SS-prME
  source 1..9873: mol_type = other RNA
accagcctgtgcctcatgatgattctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacaatttggtctaatggcgtgctggaaagcgatatgatcattcccaaatccctcgctgggcctatcagccagcacaaccatcgccccggatatcacacccaaacggccggcccttggcacctggggaaacttgagctggactttaattactgcgagggaacaaccgttgtgatcacagaaaactgtggcacccggggcccctctctcagaacaaccacggtctccgggaaactgattcatgagtggtgctgtcgcagctgcaccctgccgcctcttcggtatatgggagaagatggctgttggtacgggatggagatcagacccatttctgaaaaggaggagaatatggtgaaatccctcgttagcgcgggatctggcaaggtggacaacttcacaatgggggtcctgtgcctggctatcctctttgaagaggtgatgcggggaaagttcggcaaaaagcacatgattgccggcgttttcctgacctttgtgcttctgctcagcgggcagatcacatggcgcgatatggcccataccctgattatgatcggatccaatgctagcgacagaatgggcatgggggtcacgtatctggcccttatcgcgacattcaaaattcagccctttctggctctcggattctttctgcggaagctcacctctagagaaaacctgcttctgggcgtggggctcgccatggccacaaccctgcaactgcctgaggatatcgaacagatggctaatggaattgcccttggcctgatggctctcaaactgatcacccagttcgagacataccagctctggacggccctgatttcccttacctgtagcaacacaatctttaccctgacagtggcgtggcgcaccgccacgctcatcctggctggcgtctccctgcttccggtttgccaatctagctccatgcggaagacagactggctgcccatggccgtggctgccatgggggtgcctcccctccctctgttcatcttttctctcaaggataccctgaaaagacgcagctggccccttaatgagggagtcatggccgtgggcctggtttccatcctggcttctagcctcctgagaaacgacgtgcctatggcggggccccttgtcgccggaggcctgctcattgcttgttatgtgatcaccgggacatccgccgatctgaccgttgaaaaggccgctgacattacatgggaggaagaggccgaacagacgggagtgagccacaacctcatgatcaccgtcgacgatgacggcacaatgcggatcaaagatgacgagaccgagaatattctgacagtgcttctgaagaccgcgctgctcatcgtctctggcattttcccgtactccatccctgctacgctgcttgtgtggcatacctggcagaaacagacacaacgcagcggggttctgtgggatgtgccctctcctcccgaaacccagaaggccgagctcgaagagggagtctacagaattaaacagcagggcatctttgggaagacacaagtgggagttggcgtgcagaaggagggggtcttccacaccatgtggcacgtgacacggggagccgtgctgacgtataacggcaaacgcctcgaaccgaattgggcttccgttaagaaagacctgattagctacggcgggggatggagactttctgcccagtggcaaaagggcgaggaagtccaggtgatcgcggtggagcctgggaaaaaccccaagaattttcagaccatgcctggaacattccagaccaccacaggcgaaatcggggctattgccctggatttcaagcccggaacgtccggcagccccatcattaaccgggagggcaaagtcgtggggctgtatggaaatggcgttgtgaccaagaacgggggatacgtctccggcatcgcccaaacaaatgctgagcctgacgggccgacccccgaactcgaggaagagatgtttaaaaagcgcaacctgacaattatggatcttcatcctggcagcggaaaaaccagaaagtatctgcccgccatcgtgcgggaagctatcaagcgcagactccggacgctgattctcgcccctacaagagttgtggcggccgagatggaggaagctctgaaaggccttcccatccgctaccagaccaccgccacaaagtctgagcacaccgggcgggaaattgtcgacctgatgtgccatgctacattcaccatgagactgctcagccctgtgcgcgttccgaattataacctgatcattatggatgaggcccactttacggaccccgcctccatcgctgcgcggggatacatctctacaagagtgggcatgggggaagccgctgccattttcatgaccgccacacctcccggaaccgctgatgcctttcctcagagcaatgcgcccatccaggacgaggagcgcgacattccggaacggtcctggaactctggcaatgagtggatcacggatttcgctgggaaaaccgtctggtttgtgcctagcattaaggccggcaacgacatcgccaactgtcttcgcaaaaatggaaagaaggtgattcaactgtccagaaaaacattcgataccgaataccagaagacaaaactcaacgactgggattttgtcgttaccacagacatctctgagatgggcgctaatttcaaggccgatcgggtgatcgaccccagacggtgcctgaaacccgtgattctgaccgatgggcctgagcgcgtcatcctcgcgggacccatgcctgtgacggccgctagcgccgctcagagacggggccgcgttgggagaaacccgcagaaggaaaatgaccaatatatttttacaggacagccccttaacaatgatgaggaccatgcccactggaccgaagctaagatgctgctggacaacatcaatacccctgagggcattatccccgccctcttcgaacctgagcgggagaaatccgcggccatcgatggggaatacagactgaagggcgagagccgcaaaacattcgtggaacttatgcggagaggagacctgcccgtctggctcgctcacaaggtggcctctgagggcattaaatataccgatcgcaagtggtgctttgacgggcagcggaacaatcagatcctggaagagaacatggatgttgagatttggacaaaagaaggagagaagaagaaactgagaccgcgctggctcgacgctcggacgtactccgatcctcttgccctgaaggagttcaaagagtttgccgctggcagaaagagcatcgcgctggacctcgtgaccgaaattgggcgcgtcccctctcatctggcccacagaacacggaatgctcttgataacctggtgatgctccatacctccgagcacggaggccgcgcctatagacacgccgtcgaggaactgcctgagacaatggaaaccctgctccttctgggcctgatgatcctcctgacagggggagctatgcttttcctgatcagcggcaaagggattggaaagacctccatcggcctcatttgtgtgatcgcctctagcgggatgctgtggatggcggagattcccctgcaatggatcgcctccgctattgttctcgagtttttcatgatggtgcttctgatccctgaacccgagaagcagcggacaccgcaggacaatcaactggcctacgtggtcatcggcattctcaccctggctgccatcattgcggccaacgaaatgggccttctggagacaaccaaacgcgatctcggcatgagcaaggaacctggggttgtgtctcccacgtcctatctggacgtggatctgcatcccgctagcgcctggacactctacgctgtcgccaccacagtgatcacccctatgcttagacacaccattgaaaattctacagctaacgttagcctggccgcgatcgccaaccaggctgtggtcctgatgggactcgacaaaggctggccgatctccaagatggacctgggggtgccccttctggccctcggatgctactctcaggtcaatcctctgacgctgaccgctgccgtgctccttctgattacacattatgccatcattggccccgggctgcaggcgaaagctacccgggaggcccaaaagagaacagctgccggaatcatgaagaaccctaccgttgatggcattatgacgatcgacctcgatcccgtgatctacgacagcaaatttgaaaagcagctgggccaggtcatgcttctggtgctctgtgccgttcagctgctgctcatgcgcacatcctgggctctttgcgaggccctgaccctggcgaccgggcctattacaaccctctgggaaggatctccgggcaaattctggaatacaacgatcgccgtgagcatggctaacatttttcgggggtcctatctggccggagctggccttgccttcagcatcatgaagtctgtcgggaccggaaaaagaggcacaggctcccaaggggagaccctgggagaaaagtggaagaaaaagctcaatcagctgagccgcaaagattttgacctgtacaagaaatccggcattacagaggtggatcggaccgaggcgaaggaagggctcaaaagaggagagatcacgcaccatgccgtgtctcggggcagcgctaaacttcagtggttcgttgaacgcaacatggtcattcccgaggggagagtgatcgacctgggatgtggccggggcgggtggtcctattactgcgccggactgaagaaagtgaccgaagtccgcggctatacaaaagggggacctggccacgaggagcccgttcctatgtctacctacgggtggaatatcgtgaaactcatgagcggaaaggatgtgttttacctgcccccggaaaaatgtgacacacttctgtgcgatattggcgagtccagcccttctcccaccgtcgaagagtccagaacaatccgggtgctcaagatggttgagccctggctgaagaacaatcagttctgtattaaagtgctgaacccttatatgcccaccgtcatcgaacacctcgagcgccttcaaagaaagcatggcgggatgctggtgcggaatcctctgagccgcaactctacgcacgaaatgtactggatttccaatggaacaggcaacatcgttgctagcgtgaatatggtctctagactcctgcttaaccggttcaccatgacccatagacgcccgacaatcgagaaagacgtggatctgggggccggaacgcggcacgtgaacgctgaacccgagacccctaatatggacgtcattggcgagagaatcaagcgcattaaagaagaacacaacagcacatggcattatgacgatgaaaatccctacaagacctgggcctatcacgggtcctacgaggttaaggcgacaggatctgccagctccatgatcaacggcgtggtgaaactcctgaccaagccttgggacgtcgtgcccatggttacacagatggctatgaccgatacgaccccgtttggccagcaacgggtgttcaaagaaaaggtcgacacaagaacccctcgcagcatgcccgggacacggagagtgatgggaattaccgccgagtggctgtggcgcacgctcggccggaataaaaagcctagactgtgcacacgcgaggaatttaccaagaaagttcggacaaacgctgccatgggggccgtgttcaccgaggaaaatcagtgggattccgcgaaggctgccgtcgaggacgaagatttttggaaacttgtggacagagagcgcgagctgcataagctcggaaaatgtggctcttgcgtttataacatgatggggaagagagagaagaagctgggcgagttcggaaaggccaaaggcagccgggctatctggtacatgtggcttggggcccgctacctggaatttgaggctctcggattcctgaatgaggatcactggttttccagagaaaactcttatagcggcgtggagggggaaggactgcataagctcggctacatcctgcgggacatttccaaaatccccgggggcgccatgtatgcggatgacacggccggatgggacaccagaattacagaggatgaccttcacaatgaagagaagatcacccagcagatggatcctgagcaccggcaactggctaacgccattttcaaactcacataccagaataaggtcgtgaaggtccagcgccccaccccgacaggcaccgtgatggacatcatctctagaaaagatcagcgggggagcggacaagttggcacgtatgggctgaacacatttaccaatatggaagctcagcttattcgccagatggagggagaaggcgtgctgtccaaggccgacctcgagaaccctcatctgcccgagaagaagatcacccagtggctggagacaaaaggggtcgagagactcaagcggatggcgattagcggcgatgactgcgtggtgaagcccatcgatgaccgcttcgccaacgctctgcttgccctgaatgatatgggaaaagttagaaaggacattcctcaatggcagccgtctaaaggctggcacgattggcaacaggtgcccttttgttcccatcacttccacgaactcatcatgaaggacgggcggaaactggtcgtgccttgccgcccccaagacgagcttattggacgggctcggatcagccagggcgccgggtggtctctgaaggaaaccgcttgtctcggaaaggcctacgcgcagatgtggtccctgatgtatttccatcgcagagatctgcggctcgccagcaacgctatctgctctgccgttcctgtgcactgggtccccacatcccgcacgacctggagcattcatgcccaccatcaatggatgacaaccgaggacatgctgacagtgtggaatagagtctggatcgaagataacccttggatggaggacaaaacccccgtgacgacctgggagaatgttccgtaccttggcaagcgggaagatcagtggtgtgggtccctgattggcctcacaagcagagctacctgggcccagaacatccctacagcgattcagcaagtgcgctctctgatcggaaatgaggaatttcttgactacatgcccagcatgaaacggttcagaaaggaggaggaatccgagggcgctatctggtga

SEQ ID NO: 20579 - RNA, 9873 nt, synthetic construct
  misc_feature 1..9873: note = derived and/or modified CDS sequence (opt5) from DENV-3__JF920402__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggcgagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcgcgcggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagatctatcagctctggaccgcgctgatttcccttacatgtagcaacacgatcttcaccctgacagtggcctggcgcaccgctacactcatcctggccggcgtctccctgcttccgatgtgccaatctagctccatgcggaagaccgactggctgcccatggctgttgccgccatgggggtgcctcccctccctctgtttattttctctctcaaggatacgctgaaaagacgcagctggccccttaatgagggagtgatggctgtcggcctggtgtccatcctggcgtctagcctcctgagaaacgacgttcctatggccgggccccttgtggctggaggcctgctcattgcctgttacgtcatcacagggacctccgccgatctgaccgtggaaaaggctgccgacattacatgggaggaagaggcggaacagaccggagttagccataacctcatgatcacagtggacgatgacggcacgatgcggatcaaagatgacgagaccgagaatattctgacagtccttctgaagaccgctctgctcatcgtgtctggcatttttccgtattccatccctgccacactgcttgtctggcacacctggcagaaacagacgcaacgcagcggggtgctgtgggatgttccctctcctcccgaaacccagaaggccgagctcgaagagggagtgtacagaattaaacagcagggcatcttcgggaagacacaagtcggagtgggcgttcagaaggagggggtgtttcacaccatgtggcatgtcacacggggagctgtgctgacctacaacggcaaacgcctcgaaccgaattgggcctccgtgaagaaagacctgattagctatggcgggggatggagactttctgcgcagtggcaaaagggcgaggaagttcaggtcatcgctgtggagcctgggaaaaaccccaagaatttccagacaatgcctggaacgttccagaccacaaccggcgaaatcggggccattgccctggattttaagcccggaacctccggcagccccatcattaaccgggagggcaaagtggtcgggctgtacggaaatggcgtggttacaaagaacgggggatatgtgtccggcatcgctcaaacgaatgccgagcctgacgggccgacccccgaactcgaggaagagatgttcaaaaagcgcaacctgacaattatggatcttcaccctggcagcggaaaaaccagaaagtacctgcccgctatcgtccgggaagccatcaagcgcagactccggacactgattctcgcgcctaccagagtggttgccgctgagatggaggaagccctgaaaggccttcccatccgctatcagacgacagctaccaagtctgagcataccgggcgggaaattgtggacctgatgtgccacgccacatttaccatgagactgctcagccctgtccgcgtgccgaattacaacctgatcattatggatgaggcccatttcacagaccccgcttccatcgcggcccggggatatatctctaccagagttggcatgggggaagctgccgccatttttatgacggctacacctcccggaaccgccgatgcgttccctcagagcaatgctcccatccaggacgaggagcgcgacattccggaacggtcctggaactctggcaatgagtggatcacagattttgccgggaaaaccgtgtggttcgtccctagcattaaggccggcaacgacatcgctaactgtcttcgcaaaaatggaaagaaggtgattcaactgtccagaaaaacgtttgataccgaataccagaagacaaaactcaacgactgggatttcgtggtcaccacagacatctctgagatgggcgccaattttaaggcggatcgggttatcgaccccagacggtgcctgaaacccgtgattctgaccgatgggcctgagcgcgtgatcctcgccggacccatgcctgtcacagctgccagcgctgcccagagacggggccgcgtggggagaaacccgcagaaggaaaatgaccaatacattttcaccggacagccccttaacaatgatgaggaccacgctcactggacggaagccaagatgctgctggacaacatcaatacacctgagggcattatccccgccctcttcgaacctgagcgggagaaatccgccgctatcgatggggaatatagactgaagggcgagagccgcaaaacctttgttgaacttatgcggagaggagacctgcccgtgtggctcgcccataaggtcgcttctgagggcattaaatacaccgatcgcaagtggtgcttcgacgggcagcggaacaatcagatcctggaagagaacatggatgtggagatttggacaaaagaaggagagaagaagaaactgagaccgcgctggctcgacgcccggacctattccgatcctcttgccctgaaggaatttaaagagttcgctgcgggcagaaagagcatcgccctggacctcgttacagaaattgggcgcgtgccctctcacctggctcatagaacgcggaatgcccttgataacctggtcatgctccacacctccgagcacggaggccgcgcctacagacatgctgtggaggaactgcctgagacaatggaaaccctgctccttctgggcctgatgatcctcctgacagggggagccatgctttttctgatcagcggcaaagggattggaaagacctccatcggcctcatttgtgtcatcgcgtctagcgggatgctgtggatggccgagattcccctgcaatggatcgcttccgccattgtgctcgagttctttatgatggttcttctgatccctgaacccgagaagcagcggacgccgcaggacaatcaactggcttatgtggtgatcggcattctcaccctggccgcgatcattgccgctaacgaaatgggccttctggagacaaccaaacgcgatctcggcatgagcaaggaacctggggtcgtttctcccacatcctacctggacgtggatctgcaccccgccagcgcttggaccctctatgccgtggctacgacagtcatcacccctatgcttagacatacaattgaaaattctaccgccaacgtgagcctggcggccatcgctaaccaggccgttgtgctgatgggactcgacaaaggctggccgatctccaagatggacctgggggtcccccttctggctctcggatgctactctcaggtgaatcctctgaccctgacagccgccgtcctccttctgattacgcactacgcgatcattggccccgggctgcaggctaaagccacccgggaggctcaaaagagaacagccgccggaatcatgaagaaccctaccgtggatggcattatgacaatcgacctcgatcccgttatctatgacagcaaattcgaaaagcagctgggccaggtgatgcttctggtcctctgtgtggttcagctgctgctcatgcgcacctcctgggctctttgcgaggccctgacgctggcgacagggcctattaccaccctctgggaaggatctccgggcaaattttggaatacaaccatcgccgtgagcatggctaacattttccgggggtcctacctggccggagctggccttgcctttagcatcatgaagtctgtcgggacaggaaaaagaggcacgggctcccaaggggagaccctgggagaaaagtggaagaaaaagctcaatcagctgagccgcaaagatttcgacctgtataagaaatccggcattacagaggtggatcggaccgaggcgaaggaagggctcaaaagaggagagatcacacatcacgccgtgtctcggggcagcgctaaacttcagtggtttgttgaacgcaacatggtcattcccgaggggagagtgatcgacctgggatgtggccggggcgggtggtcctactattgcgccggactgaagaaagtgaccgaagtccgcggctacacgaaagggggacctggccacgaggagcccgttcctatgtctacctatgggtggaatatcgtgaaactcatgagcggaaaggatgtgttctacctgcccccggaaaaatgtgacacacttctgtgcgatattggcgagtccagcccttctcccaccgtcgaagagtccagaacaatccgggtgctcaagatggttgagccctggctgaagaacaatcagttctgtattaaagtgctgaacccttacatgcccaccgtcatcgaacatctcgagcgccttcaaagaaagcacggcgggatgctggtgcggaatcctctgagccgcaactctacacatgaaatgtattggatttccaatggaaccggcaacatcgttgctagcgtgaatatggtctctagactcctgcttaaccggtttacgatgacacacagacgcccgaccatcgagaaagacgtggatctgggggccggaacccggcacgtgaacgctgaacccgagacacctaatatggacgtcattggcgagagaatcaagcgcattaaagaagaacacaacagcacgtggcactacgacgatgaaaatccctataagacctgggcctaccatgggtcctatgaggttaaggcgacaggatctgccagctccatgatcaacggcgtggtgaaactcctgaccaagccttgggacgtcgtgcccatggttacacagatggctatgaccgatacaaccccgttcggccagcaacgggtgtttaaagaaaaggtcgacacgagaacccctcgcagcatgcccgggacacggagagtgatgggaattaccgccgagtggctgtggcgcacactcggccggaataaaaagcctagactgtgcacccgcgaggagttcacgaagaaagttcggacaaacgctgccatgggggccgtgtttaccgaggaaaatcagtgggattccgcgaaggctgccgtcgaggacgaagatttctggaaacttgtggacagagagcgcgagctgcacaagctcggaaaatgtggctcttgcgtttacaacatgatggggaagagagagaagaagctgggcgagtttggaaaggccaaaggcagccgggctatctggtatatgtggcttggggcccgctacctggagttcgaggctctcggatttctgaatgaggatcattggttctccagagaaaactcttacagcggcgtggagggggaaggactgcacaagctcggctatatcctgcgggacatttccaaaatccccgggggcgccatgtacgcggatgacacagccggatgggacaccagaattacggaggatgaccttcacaatgaagagaagatcacccagcagatggatcctgagcatcggcaactggctaacgccatttttaaactcacatatcagaataaggtcgtgaaggtccagcgccccaccccgacaggcaccgtgatggacatcatctctagaaaagatcagcgggggagcggacaagttggcacatacgggctgaacaccttcacgaatatggaagctcagcttattcgccagatggagggagaaggcgtgctgtccaaggccgacctcgagaaccctcatctgcccgagaagaagatcacacagtggctggagaccaaaggggtcgagagactcaagcggatggcgattagcggcgatgactgcgtggtgaagcccatcgatgaccgctttgccaacgctctgcttgccctgaatgatatgggaaaagttagaaaggacattcctcaatggcagccgtctaaaggctggcatgattggcaacaggtgcccttctgttcccaccacttccatgaactcatcatgaaggacgggcggaaactggtcgtgccttgccgcccccaagacgagcttattggacgggctcggatcagccagggcgccgggtggtctctgaaggaaaccgcttgtctcggaaaggcctatgcgcagatgtggtccctgatgtactttcaccgcagagatctgcggctcgccagcaacgctatctgctctgccgttcctgtgcattgggtccccacatcccgcaccacatggagcattcacgcccatcaccaatggatgacgaccgaggacatgctgacagtgtggaatagagtctggatcgaagataacccttggatggaggacaaaacccccgtgacaacctgggagaatgttccgtatcttggcaagcgggaagatcagtggtgtgggtccctgattggcctcacgagcagagctacctgggcccagaacatccctacagcgattcagcaagtgcgctctctgatcggaaatgaggagttccttgactacatgcccagcatgaaacggtttagaaaggaggaggaatccgagggcgctatctggtga

SEQ ID NO: 20580 - RNA, 9873 nt, synthetic construct
  misc_feature 1..9873: note = derived and/or modified CDS sequence (opt5) from DENV-3__JF937652__SS-prME
  source 1..9873: mol_type = other RNA
accagcctctgcctcatgatgatcctccccgccgctcttgccttccacctgacatcccgggacggagagcctcggatgattgtggggaagaacgaacgcgggaagtctctcctgtttaagacggcgagcggcatcaatatgtgtacccttattgctatggatctgggggagatgtgcgacaacacagtgacctacaagtgtccgcatatcacagaagttgagcccgaagatattgactgctggtgtaatctcacctccacatgggtgacctatggaacgtgcaaccaggccggcgagcacagacgggataagcgctctgtggccctggctcctcatgtcgggatgggactggacaccagaacacaaacctggatgagcgccgagggcgcttggcggcaggtcgaaaaggttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaatcgggattttgtcgaagggctcagcggagctacctgggtggacgtggtcctggagcacggcgggtgcgttaccacaatggccaagaacaaacccacgctggatattgagctccagaagaccgaagctacacaactggccacccttcgcaaactgtgtatcgagggaaagattacaaatatcaccacggactccagatgccctacacagggcgaagcgaccctcccggaggaacaggatcagaactatgtgtgtaaacacacctacgtggaccggggctgggggaatggatgcggcctgttcgggaagggaagccttgtcacatgcgccaagtttcaatgtctggagcccattgagggcaaagtggttcagtatgaaaacctcaagtacaccgtgatcatcacagtccatacgggggatcagcaccaggtgggaaatgagacccaaggcgttacagctgaaattacccctcaggcctctacaaccgaggctgtgctgcccgaatatggcacgctggggctcgagtgctcccctcgcaccggactggacttcaacgagatgatccttctgacaatgaaaaataaggcctggatggtccatagacagtggtttttcgacctccccctgccgtggaccagcggcgccacaaccgaaacgcctacatggaaccggaaagagcttctggtgacctttaagaatgctcacgcgaaaaagcaagaagtcgtggttctcgggtctcaggagggagccatgcacacagctctgaccggcgccaccgaaattcagaactccgggggcacaagcatcttcgccggacatctgaagtgtcgcctcaaaatggataagctggagcttaaaggcatgtcttacgctatgtgcacgaacacctttgtgctgaagaaagaggtctccgaaacacagcacgggaccattctcatcaaggtggagtacaagggagaagacgttccctgtaaaatccctttcagcacagaggatggccaagggaaggcccataatggaagactgattaccgcgaaccccgtggtcacgaaaaaggaggaactggtgaatatcgaggctgaaccccctttcggcgagtccaacattgtgatcgggattggcgacaatgcccttaaaatcaactggtataagaagggatctagcatcggcaaaatgtttgaagccacagctagaggggccagacgcatggctattctcggagataccgcctgggacttcggctccgttgggggagtcctgaatagcctgggcaagatggtgcaccagatctttgggtctgcgtacaccgccctcttctccggcgtgagctgggtcatgaaaattggaatcggcgtgctgcttacatggattgggctgaactctaagaataccagcatgtccttttcttgcatcgctattggaatcatcacactctatctgggcgccgttgtgcaggctgatatggggtgtgtcattaactggaaaggaaaggagctgaagtgcggcagcgggatcttcgtgacgaatgaggttcatacctggacagaacagtacaaatttcaagccgactccccgaagcggcttgcgaccgccattgctggcgcctgggagaacggagtgtgtggcatcagaagcacaacccgcatggaaaatctcctgtggaaacagattgctaacgagctgaattatatcctctgggaaaacaacatcaagctgacggtcgtggttggggatattatcggagtgcttgagcagggcaaacggaccctgacaccccagcctatggagctcaagtactcttggaaaacctgggggaaggccaagattgtcacagccgaaacccaaaattccagcttcatcattgacggacccaacacacctgagtgcccctctgtgtccagagcttggaatgtgtgggaagtcgaggattatggctttggcgttttcaccacgaacatctggctgaaactgcgcgaagtgtacacacagctttgtgaccaccggctcatgagcgcggccgtgaaggacgagagagctgtccacgccgatatggggtactggatcgagtcccagaaaaatggatcttggaagctggaaaaagccagcctgattgaggtgaagacctgcacctggccgaagtcccatacactctggtctaacggcgttctggaaagcgacatgatcattcctaaatcccttgctgggcccatcagccagcacaattatcgccctggataccatacccaaacggccggcccctggcacctggggaagctcgagctggattttaactattgcgagggaacaaccgtggtcattacagaaaattgtggcacccggggcccttctctgagaacaaccacggtgtccgggaaacttatccacgagtggtgctgtcgcagctgcaccctgcccccgctgcggtacatgggagaagacggctgttggtatgggatggagatcagacctatttctgaaaaggaggagaacatggttaaatccctggtgagcgcgggatctggcaaggtcgataatttcacaatgggggtgctctgcctggctatcctttttgaagaggttatgcggggaaagctgggcaaaaagcatatgattgccggcgtgttcttcacctttgtcctcctgctgagcgggcagatcacatggcgcgacatggcccacacccttattatgatcggatccaacgctagcgatagaatgggcatgggggtgacgtacctggccctcattgcgacattcaaaatccagccctttctggctctcggattctttctgcggaaacttacctctagagaaaatctgctcctgggcgtggggctggccatggccacaacccttcaactgcccgaggacatcgaacagatggctaacggaattgccctcggcctgatggctctcaaactgatcacccagttcgagacatatcagctttggacggccctgatttccctcacctgtagcaatacaatctttaccctgacagtcgcgtggcgcaccgccacgctgattcttgctggcgtttccctgctccctgtgtgccaatctagctccatgcggaagacagattggctgccgatggccgtggctgccatgggggtgccccctctccccctgttcatctttggacttaaggacaccctgaaaagacgctcttggcctctgaacgagggcgtgatggccgttgggctcgtgagcatcctggcttcctctcttctgagaaacgatgtccccatggcgggacctctcgtggccggcgggctgctcattgcttgttacgttatcaccggaacaagcgccgacctgaccgtggaaaaggccgctgatattacatgggaggaagaggccgaacagacgggcgtctcccataatcttatgatcaccgtggacgacgatggcacaatgcggattaaagacgatgagaccgagaacatcctgacagtcctgctcaagaccgcgctgcttatcgtgagcgggattttcccctactctatcccggctacgctgctcgtttggcacacctggcagaaacagacacaacgctccggagtgctgtgggacgtcccttctccccctgaaacccagaaggccgagctcgaagagggcgtgtatagaattaaacagcaggggatctttggaaagacacaagttggcgtgggggtccagaaggagggagtgttccataccatgtggcacgtgacacggggcgccgttctgacgtacaatggcaaacgccttgaacccaactgggcttccgtcaagaaagatctgatttcctatgggggaggctggagactgagcgcccagtggcaaaagggggaggaagtccaggtgatcgcggtcgagccgggcaagaatcctaagaactttcagaccatgcccggcacattccagaccaccacaggggaaattggagctatcgccctcgacttcaagcctggcacgtctggctcccccatcattaatcgggaggggaaagtggttggactgtacggcaacggggtggtcaccaagaatggaggctatgtgagcgggatcgcccaaacaaacgctgagcccgatggccctaccccggaacttgaggaagagatgtttaaaaagcgcaatctgacaattatggacctccaccccggatccggcaaaaccagaaagtacctgcctgccatcgttcgggaagctattaagcgcagactccggacgctgatccttgcccccacaagagtggtcgcggccgagatggaggaagctctgaaagggctgcctatccgctatcagaccaccgccacaaagagcgagcataccggacgggaaattgtggatctcatgtgccacgctacattcaccatgagactgctttctcccgttcgcgtgcctaactacaatctgatcattatggacgaggcccattttacggatccggccagcatcgctgcgcggggctacatttccacaagagtcgggatgggagaagccgctgccatcttcatgaccgccacaccccctggcaccgctgacgcctttccccagtctaacgcgcctatccaggatgaggagaaagacattcccgaacgcagctggaatagcgggaacgagtggatcacggacttcgctggcaagaccgtgtggtttgtgccgtctattaaagccggaaacgatatcgccaattgtctccggaagaacggcaagaaagtcattcaactgagcagaaagacattcgacaccgaatatcagaaaacaaagctgaatgattgggactttgttgtgaccacagatatctccgagatgggggctaacttcaaagccgaccgcgtgattgatcctcggagatgcctcaagcccgtcatccttaccgacggacccgagcgggtgatcctggcgggccctatgcccgttacggccgcttctgccgctcagcgcagagggcgggtgggacgcaatcctcagaaggaaaacgatcaatacatttttacaggccagccgctgaataacgacgaggatcacgcccattggaccgaagctaaaatgctcctggacaatatcaacacccccgaggggattatccctgcccttttcgaacccgagagagaaaagagcgcggccattgacggcgaatatcggctgaaaggagagtccagaaagacattcgtcgaactcatgcgccggggcgatctgcctgtgtggctggctcacaaagttgccagcgaggggatcaagtacaccgacagaaaatggtgctttgatggacagcgcaataaccagatcctcgaagagaatatggacgtggagatttggacaaaggaaggcgagaagaagaaacttcggcccagatggctggatgctcgcacgtattctgacccgctggccctcaaagagttcaaagagtttgccgctgggcggaaatccatcgcgctggatcttgtcaccgaaattggaagagtgcctagccacctggcccatcgcacaagaaacgctctcgacaatctggtcatgctgcacacctctgagcatggcggccgggcctaccgccacgccgtggaggaactccccgagacaatggaaacccttctgctgctcgggctgatgatccttctgacgggaggcgctatgctgttcctgatttccgggaagggaatcggcaagaccagcatcgggctgatttgtgttatcgcctcctctggaatgctctggatggcggagattcctcttcaatggatcgccagcgctattgtgctggagtttttcatgatggtgctgctcatccccgaacctgagaaacagagaacaccccaggataaccaactggcctatgtcgttattggcatccttaccctggctgccatcattgcggccaatgaaatgggcctcctggagacaaccaagcgggacctggggatgtccaaagaaccgggagtggtgagccctacgtcttacctcgatgtcgaccttcaccccgcttccgcctggacactgtacgctgtggccaccacagttatcacccccatgctgcgccataccattgagaacagcacagctaacgtgtctctcgccgcgatcgccaatcaggctgtcgtgctgatgggccttgataaggggtggcctattagcaaaatggacctgggagtcccgctcctggccctgggctgctattcccaggtgaaccccctcacgcttaccgctgccgttctgctgctcatcacacactacgccatcattgggcctggactgcaggcgaaggctaccagagaggcccaaaagcggacagctgccggcatcatgaaaaatcccaccgtggacggcattatgacgatcgatcttgaccctgtcatttatgattctaagtttgaaaaacagctgggacaggtgatgctcctggttctgtgtgccgtgcagctccttctgatgagaacaagctgggctctgtgcgaggccctcaccctggcgaccggacccatcacaaccctttgggaaggctcccctgggaagttctggaacacaacgatcgccgtctctatggctaatatttttcgcggaagctacctggccggcgctgggctcgccttctccatcatgaaaagcgtgggaaccggcaagcggggcacagggtctcaaggagagaccctgggcgaaaagtggaaaaagaaactgaaccagctctccagaaaggactttgatctttataaaaagagcgggattacagaggtggaccgcaccgaggcgaaagaaggactgaagcggggcgagatcacgcatcacgccgtttccagagggtctgctaagctgcagtggttcgtcgaacggaatatggtgattccggagggacgcgtgatcgatctcggctgtggcagagggggatggagctactattgcgccggcctgaaaaaggtcaccgaagttcgggggtacacaaaaggaggccccgggcatgaggagcctgtgcccatgtccacctacggatggaacattgtgaaacttatgtctggcaaagacgtcttttatctgcctcccgaaaagtgtgatacactcctgtgcgacatcggcgagagctccccgagccctaccgtggaagagtctcgcacaatcagagttctgaagatggtggagccctggctcaaaaataaccagttctgtattaaggtccttaatccctacatgcctaccgtgatcgaacacctggagcggctgcaacgcaaacacgggggaatgctcgttagaaaccccctgtcccggaatagcacgcatgaaatgtattggatttctaacggcacagggaatatcgtggcttccgtcaacatggtgagccgccttctgctcaacagattcaccatgacccaccggagacctacaattgagaaggatgtggacctgggagccggcacgcgccatgtcaatgctgaaccggagacccccaacatggatgttatcggggagcggatcaaaagaattaaggaggaacacaattctacatggcactacgacgacgaaaacccttataagacctgggcctaccatggaagctatgaggtgaaagcgacaggctccgcctctagcatgatcaatggcgtggtcaagctgctcaccaaaccctgggatgtggttcctatggtgacacagatggctatgaccgacacgaccccctttgggcagcaacgcgtcttcaaggaaaaagtggatacacggaccccgagatccatgcctggaacacgccgggttatgggcattaccgccgagtggctgtggagaacgcttgggcgcaacaagaagccccggctgtgcacaagagaggaatttaccaaaaaggtgcgcacaaatgctgccatgggagccgtcttcaccgaggaaaaccagtgggacagcgcgaaagctgccgtggaggatgaagacttttggaagctcgttgatcgggagagagagctgcacaaacttggcaagtgtgggtcctgcgtgtacaatatgatgggcaaacgcgaaaagaagctgggagagttcggcaaagccaaggggtctagagctatctggtacatgtggctcggagcccggtatctggaatttgaggctctgggcttcctcaacgaggaccattggtttagccgcgaaaattcctactctggggtcgagggagaaggcctgcacaaacttgggtatattctgagagatatcagcaagatccctggcggagccatgtacgcggacgatacggccggctgggacacccggattacagaggacgatctccataacgaagagaaaatcacccagcagatggaccccgagcacagacaactggctaatgccattttcaaacttacatatcagaacaaggtggtcaaagtgcagcggcctacccccacagggaccgttatggatatcatttcccgcaaggaccagagaggatctggccaagtggggacgtacggactgaatacatttaccaacatgggcgctcagctcatccggcagatggaaggggagggcgtcctgagcaaagccgatctggaaaacccgcacctccctgagaagaaaatcacccagtggctggaaacaaagggagtggagcgccttaagagaatggcgatttccggcgacgattgcgtggttaaacccatcgacgatcggttcgccaatgctctgctcgccctgaacgacatggggaaggtgcgcaaagatattccccaatggcagcctagcaagggatggcatgactggcagcaggtcccgttttgttctcaccatttccacgagcttatcatgaaagatggcagaaagctggtggttccctgccggcctcaagacgaactcattgggcgcgctagaatctcccagggagccggctggagcctgaaggagaccgcttgtctggggaaagcctatgcgcagatgtggtctctcatgtacttccaccggcgcgacctgagacttgcctccaatgctatttgcagcgccgtgcccgtccattgggtgcctacatctcggacgacctggtccatccacgcccatcaccaatggatgacaaccgaagatatgctgacagtctggaaccgcgtgtggatcgaggacaatccctggatggaagataagacccctgttacgacctgggagaacgtgccctacctcggcaaaagagaggaccagtggtgtggaagcctgattggccttacatcccgggctacctgggcccagaatatcccgacagcgattcagcaagtcagaagcctgatcgggaacgaagagtttctcgattatatgccttctatgaagcgcttccggaaagaagaggagagcgaaggagctatttggtga

SEQ ID NO: 20581 - RNA, 9873 nt, synthetic construct
  misc_feature 1..9873: note = derived and/or modified CDS sequence (opt5) from DENV-3__JF920404__SS-prME
  source 1..9873: mol_type = other RNA
accagcctgtgcctcatgatgatcctgcccgcggctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttcggactcaaggatacactgaaaagacgctcttggccccttaatgagggcgtcatggctgtggggctggttagcattctggcgtcctctctcctgagaaacgacgtgcctatggccggaccccttgtcgctggcgggctgctcatcgcctgttatgtgattaccggaaccagcgccgatctgacagttgaaaaggctgccgacatcacctgggaggaaggcgcggagcagacaggcgtgtcccacaacctcatgattacggtcgacgatgacgggaccatgcggatcaaagatgacgaaacagagaatatcctgaccgtgcttctgaagacagctctgctcattgtcagcggaatctttccgtactctattcctgccaccctgcttgtgtggcatacgtggcagaaacagacccaacgctccggcgttctgtgggatgtgcccagccctcccgagacacagaaggccgaactcgaggaaggggtctacagaatcaaacagcagggaattttcggcaagacccaagtgggggttggagtgcagaaggagggcgtctttcacacaatgtggcacgtgacccggggcgctgtgctgacatataacgggaaacgcctcgagccgaattgggcctctgttaagaaagacctgatctcctacggaggcgggtggagacttagcgcgcagtggcaaaagggagaagaggtccaggtgattgctgtggaacctggcaaaaaccccaagaatttccagacgatgcctgggaccttccagacaaccaccggagagatcggcgccatcgccctggattttaagcccggcacatctgggtcccccattatcaaccgggaaggaaaagtcgtgggcctgtatgggaatggagttgtgacgaagaacggcgggtacgtcagcggcattgctcaaaccaatgccgagcctgacggaccgacacccgagctcgaagaggaaatgttcaaaaagcgcaacctgaccatcatggatcttcatcctggctccgggaaaacaagaaagtatctgcccgctattgtgcgggaggccatcaagcgcagactccggaccctgatcctcgcgcctacgagagttgtggccgctgaaatggaggaggccctgaaaggacttcccattcgctaccagacaaccgctaccaagagcgaacacacaggccgggagatcgtcgacctgatgtgccatgccacctttacaatgagactgctctctcctgtgcgcgttccgaattataacctgattatcatggatgaagcccacttcaccgaccccgctagcattgcggcccgggggtacatctccacgagagtgggaatgggcgaggctgccgccatctttatgacagctacccctcccgggacagccgatgcgttccctcagtctaatgctcccattcaggacgaagaacgcgacatcccggagcggagctggaactccggcaatgaatggattaccgattttgccggaaaaacggtctggttcgtgccttctatcaaggccggcaacgacattgctaactgtcttcgcaaaaatgggaagaaggtgatccaactgagcagaaaaacctttgatacagagtaccagaagaccaaactcaacgactgggatttcgtcgttacaaccgacatttccgaaatgggagccaattttaaggcggatcgggtgatcgaccccagacggtgcctgaaacccgtgatcctgacagatggccctgagcgcgtcattctcgccgggcccatgcctgtgaccgctgcctctgctgcccagagacggggacgcgttggcagaaacccgcagaaggagaatgaccaatatatcttcacggggcagccccttaacaatgatgaagaccatgctcactggacagaggccaagatgctgctggacaacattaatacccctgaaggcatcattcccgccctcttcgagcctgaacgggagaaaagcgccgctatcgatggagagtacagactgaagggcgaatcccgcaaaacctttgtggagcttatgcggagaggggacctgcccgtctggctcgcccacaaggtggctagcgaaggaatcaaatatacagatcgcaagtggtgcttcgacggccagcggaacaatcagattctggaggaaaacatggatgttgagatctggaccaaagagggggaaaagaagaaactgagaccgcgctggctcgacgcccggacatactctgatcctcttgccctgaaggagtttaaagagttcgctgcgggaagaaagtccattgccctggacctcgtgacggagatcggccgcgtccccagccatctggctcacagaacccggaatgcccttgataacctggtgatgctccatacatctgaacacggcgggcgcgcctatagacacgctgtcgaggagctgcctgaaaccatggagacactgctccttctgggactgatgattctcctgaccggcggggccatgctttttctgatctccggaaaaggcatcgggaagacgagcattggactcatctgtgtgattgcgtcctctggcatgctgtggatggccgaaatccccctgcaatggattgctagcgccatcgttctcgagttctttatgatggtgcttctgattcctgagcccgaaaagcagcggaccccgcaggacaatcaactggcttacgtggtcatcggcatcctcacactggccgcgattatcgccgctaacgagatggggcttctggaaaccacaaaacgcgatctcggaatgtccaaggagcctggcgttgtgagccccacctcttatctggacgtggatctgcatcccgcctccgcttggacgctctacgccgtcgctacaaccgtgattacacctatgcttagacacaccatcgaaaatagcaccgccaacgtttctctggcggccattgctaaccaggccgtggtcctgatggggctcgacaaaggatggccgatcagcaagatggacctgggcgtgccccttctggctctcgggtgctactcccaggtcaatcctctgacactgacggccgccgtgctccttctgatcacccattatgcgattatcggacccggcctgcaggctaaagccacacgggaggctcaaaagagaaccgccgccggcattatgaagaaccctacagttgatgggatcatgaccattgacctcgatcccgtgatctacgactctaaattcgagaagcagctgggacaggtcatgcttctggtgctctgtgctgttcagctgctgctcatgcgcacgagctgggccctttgcgaagcgctgacactggccaccggccctatcaccacactctgggaggggtccccgggaaaattttggaataccacaattgctgtgtctatggccaacatcttccggggcagctatctggctggggccggacttgcgttttccattatgaaaagcgtcggcacgggcaaaagagggaccggatctcaaggcgaaacactgggggagaagtggaagaaaaagctcaatcagctgtcccgcaaagatttcgacctgtacaagaaaagcggaatcaccgaagtggatcggacagaggccaaggagggcctcaaaagaggggaaattacccaccatgctgtgtcccggggatctgccaaacttcagtggtttgttgagcgcaacatggtcatccccgaaggcagagtgattgacctgggctgtgggcggggaggctggagctattactgcgctgggctgaagaaagtgacggaggtccgcggatataccaagggcgggcctggacacgaggaacccgttcctatgtccacatacggctggaatatcgtgaaactcatgtctggcaaggatgtgttctacctgcccccggagaaatgtgacacccttctgtgcgatatcggggaaagctcccctagccccacagtcgaggaatctagaaccattcgggtgctcaagatggttgagccctggctgaagaacaatcagttctgtatcaaagtgctgaacccttatatgcccacagtcattgagcacctcgaacgccttcaaagaaagcatggaggcatgctggtgcggaatcctctgtcccgcaacagcacccacgagatgtactggatctctaatgggacgggaaacattgttgcctccgtgaatatggtcagcagactcctgcttaaccggtttacaatgacccatagacgcccgaccatcgaaaaagacgtggatctgggcgctgggacacggcacgtgaacgccgagcccgaaacgcctaatatggacgtcatcggagagagaattaagcgcatcaaagaggaacacaactctacctggcattatgacgatgagaatccctacaagacatgggcgtatcacggcagctacgaagttaaggccaccggctccgcttctagcatgattaacggggtggtgaaactcctgacaaagccttgggacgtcgtgcccatggttacccagatggccatgacagataccacgccgttcggacagcaacgggtgtttaaagagaaggtcgacaccagaacacctcgctccatgcccggcacccggagagtgatggggatcacagctgaatggctgtggcgcaccctcggacggaataaaaagcctagactgtgcacgcgcgaggagttcacaaagaaagttcggaccaacgccgccatgggcgcggtgtttacagaagagaatcagtgggatagcgctaaggccgccgtcgaagacgaggatttctggaaacttgtggacagagaacgcgagctgcataagctcgggaaatgtggctcctgcgtttataacatgatgggaaagagagagaaaaagctgggcgaatttgggaaggctaaaggatctcgggccatttggtacatgtggcttggcgctcgctacctggagttcgaagccctcgggtttctgaatgaggatcactggttcagcagagagaactcctattctggagtggaaggcgaggggctgcataagctcggctacatcctgcgggacatcagcaaaattcccggaggcgcgatgtatgccgatgacaccgctgggtgggacacgagaatcaccgaagatgaccttcacaatgaggaaaagattacacagcagatggatcctgagcaccggcaactggccaacgctatctttaaactcacctaccagaataaggtcgtgaaggtccagcgccccacaccgaccggaacagtgatggacattatctccagaaaagatcagcggggctctgggcaagttggaacctatggcctgaacacgttcacaaatatggaggcccagcttatccgccagatggaaggggagggcgtgctgagcaaggcggacctcgaaaaccctcatctgcccgagaaaaagattacccagtggctggaaaccaaaggagtcgagagactcaagcggatggccatctccggcgatgactgcgtggtgaagcccattgatgaccgctttgctaacgccctgcttgctctgaatgatatggggaaagttagaaaggacatccctcaatggcagccgagcaaaggatggcacgattggcaacaggtgcccttctgttctcatcacttccacgagctcattatgaaggacggccggaaactggtcgtgccttgccgcccccaagacgaacttatcgggagagcccggatttcccagggagctggctggagcctgaaggagacagcctgtctcgggaaggcgtacgcccagatgtggtctctgatgtattttcatcgcagagatctgcggctcgcttccaacgccatctgcagcgccgttcctgtgcactgggtccccacctctcgcacaacgtggtccatccatgctcaccatcaatggatgaccacagaagacatgctgaccgtgtggaatagagtctggattgaggataacccttggatggaagacaaaacacccgtgaccacgtgggagaatgttccgtaccttggcaagcgggaggatcagtggtgtggaagcctgatcggcctcacctccagagccacatgggcgcagaacattcctaccgctatccagcaagtgcgcagcctgattgggaatgaagagttccttgactacatgccctctatgaaacggtttagaaaggaagaggagagcgaaggagccatctggtga

SEQ ID NO: 20582 - RNA, 9873 nt, synthetic construct
  misc_feature 1..9873: note = derived and/or modified CDS sequence (opt5) from DENV-3__JF937641__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttcggactcaaggatacactgaaaagacgctcttggccccttaatgagggcgtcatggctgtggggctggttagcattctggcgtcctctctcctgagaaacgacgtgcctatggccggaccccttgtcgctggcgggctgctcatcgcctgttatgtgattaccggaaccagcgccgatctgacagttgaaaaggctgccgacatcacctgggaggaagaggcggaacagacaggcgtgtcccacaacctcatgattacggtcgacgatgacggcaccatgcggatcaaagatgacgagacagagaatatcctgaccgtgcttctgaagacagctctgctcattgtcagcgggatctttccgtactctattcctgccaccctgcttgtgtggcatacgtggcagaaacagacccaacgctccggagttctgtgggatgtgcccagccctcccgaaacacagaaggccgagctcgaagagggcgtctacagaatcaaacagcaggggattttcggaaagacccaagtgggcgttggggtgcagaaggagggagtctttcacacaatgtggcacgtgacccggggcgctgtgctgacatataacggcaaacgcctcgaaccgaattgggcctctgttaagaaagacctgatctcctacgggggaggctggagacttagcgcgcagtggcaaaagggggaggaagtccaggtgattgctgtggagcctggcaagaaccccaagaatttccagacgatgcctggcaccttccagacaaccaccggggaaatcggagccatcgccctggattttaagcccggcacatctggctcccccattatcaaccgggaggggaaagtcgtgggactgtatggcaatggggttgtgacgaagaacggaggctacgtcagcgggattgctcaaaccaatgccgagcctgacggcccgacacccgaactcgaggaagagatgttcaaaaagcgcaacctgaccatcatggatcttcatcctggatccggcaaaacaagaaagtatctgcccgctattgtgcgggaagccatcaagcgcagactccggaccctgatcctcgcgcctacgagagttgtggccgctgagatggaggaagccctgaaagggcttcccattcgctaccagacaaccgctaccaagagcgagcacacaggacgggaaatcgtcgacctgatgtgccatgccacctttacaatgagactgctctctcctgtgcgcgttccgaattataacctgattatcatggatgaggcccacttcaccgaccccgctagcattgcggcccggggctacatctccacgagagtggggatgggagaagctgccgccatctttatgacagctacccctcccggcacagccgatgcgttccctcagtctaatgctcccattcaggacgaggagcgcgacatcccggaacggagctggaactccgggaatgagtggattaccgattttgccggcaaaacggtctggttcgtgccttctatcaaggccggaaacgacattgctaactgtcttcgcaaaaatggcaagaaggtgatccaactgagcagaaaaacctttgatacagaataccagaagaccaaactcaacgactgggatttcgtcgttacaaccgacatttccgagatgggggccaattttaaggcggatcgggtgatcgaccccagacggtgcctgaaacccgtgatcctgacagatggacctgagcgcgtcattctcgccggccccatgcctgtgaccgctgcctctgctgcccagagacgggggcgcgttggaagaaacccgcagaaggaaaatgaccaatatatcttcacgggccagccccttaacaatgatgaggaccatgctcactggacagaagccaagatgctgctggacaacattaatacccctgaggggatcattcccgccctcttcgaacctgagcgggagaaaagcgccgctatcgatggcgaatacagactgaagggagagtcccgcaaaacctttgtggaacttatgcggagaggcgacctgcccgtctggctcgcccacaaggtggctagcgaggggatcaaatatacagatcgcaagtggtgcttcgacggacagcggaacaatcagattctggaagagaacatggatgttgagatctggaccaaagaaggcgagaagaagaaactgagaccgcgctggctcgacgcccggacatactctgatcctcttgccctgaaggaatttaaagagttcgctgcggggagaaagtccattgccctggacctcgtgacggaaatcggacgcgtccccagccatctggctcacagaacccggaatgcccttgataacctggtgatgctccatacatctgagcacggcggccgcgcctatagacacgctgtcgaggaactgcctgagaccatggaaacactgctccttctggggctgatgattctcctgaccggaggcgccatgctttttctgatctccgggaaaggaatcggcaagacgagcattgggctcatctgtgtgattgcgtcctctggaatgctgtggatggccgagatccccctgcaatggattgctagcgccatcgttctcgagttctttatgatggtgcttctgattcctgaacccgagaagcagcggaccccgcaggacaatcaactggcttacgtggtcatcggcatcctcacactggccgcgattatcgccgctaacgaaatgggccttctggagaccacaaaacgcgatctcgggatgtccaaggaacctggagttgtgagccccacctcttatctggacgtggatctgcatcccgcctccgcttggacgctctacgccgtcgctacaaccgtgattacacctatgcttagacacaccatcgagaatagcaccgccaacgtttctctggcggccattgctaaccaggccgtggtcctgatgggcctcgacaaagggtggccgatcagcaagatggacctgggagtgccccttctggctctcggctgctactcccaggtcaatcctctgacactgacggccgccgtgctccttctgatcacccattatgcgattatcgggcccggactgcaggctaaagccacacgggaggctcaaaagagaaccgccgccggcattatgaagaaccctacagttgatggcatcatgaccattgacctcgatcccgtgatctacgactctaaattcgaaaagcagctggggcaggtcatgcttctggtgctctgtgctgttcagctgctgctcatgcgcacgagctgggccctttgcgaggcgctgacactggccaccggacctatcaccacactctgggaaggctccccggggaaattttggaataccacaattgctgtgtctatggccaacatcttccggggaagctatctggctggcgccgggcttgcgttttccattatgaaaagcgtcggaacgggcaaaagaggcaccgggtctcaaggagagacactgggcgaaaagtggaagaaaaagctcaatcagctgtcccgcaaagatttcgacctgtacaagaaaagcgggatcaccgaggtggatcggacagaggccaaggaaggactcaaaagaggcgagattacccaccatgctgtgtcccgggggtctgccaaacttcagtggtttgttgaacgcaacatggtcatccccgagggaagagtgattgacctgggctgtggcagagggggatggagctattactgcgctggcctgaagaaagtgacggaagtccgcgggtataccaagggaggccctgggcacgaggagcccgttcctatgtccacatacggatggaatatcgtgaaactcatgtctggcaaggatgtgttctacctgcccccggaaaaatgtgacacccttctgtgcgatatcggcgagagctcccctagccccacagtcgaagagtctagaaccattcgggtgctcaagatggttgagccctggctgaagaacaatcagttctgtatcaaagtgctgaacccttatatgcccacagtcattgaacacctcgagcgccttcaaagaaagcatgggggaatgctggtgcggaatcctctgtcccgcaacagcacccacgaaatgtactggatctctaatggcacggggaacattgttgcctccgtgaatatggtcagcagactcctgcttaaccggtttacaatgacccatagacgcccgaccatcgagaaagacgtggatctgggagctggcacacggcacgtgaacgccgaacccgagacgcctaatatggacgtcatcggggagagaattaagcgcatcaaagaagaacacaactctacctggcattatgacgatgaaaatccctacaagacatgggcgtatcacggaagctacgaggttaaggccaccggctccgcttctagcatgattaacggcgtggtgaaactcctgacaaagccttgggacgtcgtgcccatggttacccagatggccatgacagataccacgccgttcgggcagcaacgggtgtttaaagaaaaggtcgacaccagaacacctcgctccatgcccggaacccggagagtgatgggcatcacagctgagtggctgtggcgcaccctcgggcggaataaaaagcctagactgtgcacgcgcgaggagttcacaaagaaagttcggaccaacgccgccatgggagcggtgtttacagaggaaaatcagtgggatagcgctaaggccgccgtcgaggacgaagatttctggaaacttgtggacagagagcgcgagctgcataagctcggcaaatgtgggtcctgcgtttataacatgatgggcaagagagagaagaagctgggagagtttggcaaggctaaagggtctcgggccatttggtacatgtggcttggagctcgctacctggagttcgaggccctcggctttctgaatgaggatcactggttcagcagagaaaactcctattctggggtggagggagaaggcctgcataagctcgggtacatcctgcgggacatcagcaaaattcccggcggagcgatgtatgccgatgacaccgctggctgggacacgagaatcaccgaggatgaccttcacaatgaagagaagattacacagcagatggatcctgagcaccggcaactggccaacgctatctttaaactcacctaccagaataaggtcgtgaaggtccagcgccccacaccgaccgggacagtgatggacattatctccagaaaagatcagcggggatctggccaagttgggacctatggactgaacacgttcacaaatatggaagcccagcttatccgccagatggagggcgaaggggtgctgagcaaggcggacctcgagaaccctcatctgcccgagaaaaagattacccagtggctggagaccaaaggcgtcgagagactcaagcggatggccatctccggagatgactgcgtggtgaagcccattgatgaccgctttgctaacgccctgcttgctctgaatgatatgggcaaagttagaaaggacatccctcaatggcagccgagcaaagggtggcacgattggcaacaggtgcccttctgttctcatcacttccacgaactcattatgaaggacggacggaaactggtcgtgccttgccgcccccaagacgagcttatcggcagagcccggatttcccagggggctggatggagcctgaaggaaacagcctgtctcggcaaggcgtacgcccagatgtggtctctgatgtattttcatcgcagagatctgcggctcgcttccaacgccatctgcagcgccgttcctgtgcactgggtccccacctctcgcacaacgtggtccatccatgctcaccatcaatggatgaccacagaggacatgctgaccgtgtggaatagagtctggattgaagataacccttggatggaggacaaaacacccgtgaccacgtgggagaatgttccgtaccttgggaagcgggaagatcagtggtgtggcagcctgatcggactcacctccagagccacatgggcgcagaacattcctaccgctatccagcaagtgcgcagcctgattggcaatgaggagttccttgactacatgccctctatgaaacggtttagaaaggaggaggaaagcgagggggccatctggtga

SEQ ID NO: 20583 - RNA, 9873 nt, synthetic construct
  misc_feature 1..9873: note = derived and/or modified CDS sequence (opt5) from DENV-3__JF920396__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcgagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgctctcctgacatggatcgggcttaattctaagaacaccagcatgtccttttcttgcattgccatcggaatcattacactgtatctcggcgctgtcgtgcaggccgacatggggtgtgttgtgaattggaaaggaaaggagctgaagtgcggcagcgggatcttcgtcacgaacgaggtgcatacctggacagaacagtacaaatttcaagcggattcccccaagcggctggccaccgctattgccggcgcttgggagaatggagtttgtggcatcagaagcacaacccgcatggaaaaccttctctggaaacagattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgtctccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaaccatcgccccggatatcacacccaaacggcgggcccttggcaccttgggaagctggagctcgactttaattactgcgagggaacaaccgttgtgattacagaaaactgtggcacccggggcccctctctgagaacaaccacggtctccgggaaactgatccatgagtggtgctgtcgcagctgcacccttccgcctctccggtatatgggagaagatggctgttggtacgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcacatgattgccggcgttttctttaccttcgtgcttctgctcagcgggcagatcacatggcgcgatatggctcataccctgattatgatcggatccaatgccagcgacagaatgggcatgggggtcacgtatctggcgcttattgctacatttaaaatccagcccttcctggccctcggatttttcctgcggaagctcacctctagagaaaacctgcttctgggcgtggggctcgccatggctacaaccctgcaactgcctgaggatatcgaacagatggccaatggaattgctcttggcctgatggccctcaaactgatcacccagtttgagacataccagctctggacggcgctgatttcccttacctgtagcaacacaatcttcaccctgacagtggcctggcgcaccgctacgctcattctggccggcgtctccctgcttccggtttgccaatctagctccatgcggaagacagactggctgcccatggctgtggccgccatgggggtgcctcccctccctctgtttatcttctctctcaaggataccctgaaaagacgcagctggccccttaatgagggagtcatggctgtgggcctggtttccatcctggcgtctagcctcctgagaaacgacgtgcctatggccgggccccttgtcgctggaggcctgctcattgcctgttatgtgatcaccgggacatccgccgatctgaccgttgaaaaggctgccgacattacatgggaggaagaggcggaacagacgggagtgagccacaacctcatgatcaccgtcgacgatgacggcacaatgcggattaaagatgacgagaccgagaatatcctgacagtgcttctgaagaccgctctgctcatcgtctctggcatttttccgtactccatccctgccacgctgcttgtgtggcatacctggcagaaacagacacaacgcagcggggttctgtgggatgtgccctctcctcccgaaacccagaaggccgagctcgaagagggagtctacagaattaaacagcagggcatcttcgggaagacacaagtgggagttggcgtgcagaaggagggggtctttcacaccatgtggcacgtgacacggggagctgtgctgacgtataacggcaaacgcctcgaaccgaattgggcctccgttaagaaagacctgattagctacggcgggggatggagactttctgcgcagtggcaaaagggcgaggaagtccaggtgatcgctgtggagcctgggaaaaaccccaagaatttccagaccatgcctggaacattccagaccaccacaggcgaaattggggccatcgccctggattttaagcccggaacgtccggcagccccatcattaaccgggagggcaaagtcgtggggctgtatggaaatggcgttgtgaccaagaacgggggatacgtctccggcatcgctcaaacaaatgccgagcctgacgggccgacccccgaactcgaggaagagatgttcaaaaagcgcaacctgacaattatggatcttcatcctggcagcggaaaaaccagaaagtatctgcccgctatcgtgcgggaagccattaagcgcagactccggacgctgatcctcgcgcctacaagagttgtggccgctgagatggaggaagccctgaaaggccttcccatccgctaccagaccaccgctacaaagtctgagcacaccgggcgggaaattgtcgacctgatgtgccatgccacatttaccatgagactgctcagccctgtgcgcgttccgaattataacctgatcattatggatgaggcccacttcacggaccccgcttccatcgcggcccggggatacatttctacaagagtgggcatgggggaagctgccgccatctttatgaccgctacacctcccggaaccgccgatgcgttccctcagagcaatgctcccatccaggacgaggagcgcgacattccggaacggtcctggaactctggcaatgagtggatcacggattttgccgggaaaaccgtctggttcgtgcctagcattaaggccggcaacgacatcgctaactgtcttcgcaaaaatggaaagaaggtgattcaactgtccagaaaaacatttgataccgaataccagaagacaaaactcaacgactgggatttcgtcgttaccacagacatctctgagatgggcgccaattttaaggcggatcgggtgattgaccccagacggtgcctgaaacccgtgatcctgaccgatgggcctgagcgcgtcatcctcgccggacccatgcctgtgacggctgccagcgctgcccagagacggggccgcgttgggagaaacccgcagaaggaaaatgaccaatatattttcacaggacagccccttaacaatgatgaggaccatgctcactggaccgaagccaagatgctgctggacaacatcaatacccctgagggcattatccccgccctcttcgaacctgagcgggagaaatccgccgctattgatggggaatacagactgaagggcgagagccgcaaaacatttgtggaacttatgcggagaggagacctgcccgtctggctcgcccacaaggtggcttctgagggcatcaaatataccgatcgcaagtggtgcttcgacgggcagcggaacaatcagatcctggaagagaacatggatgttgagatttggacaaaagaaggagagaagaagaaactgagaccgcgctggctcgacgcccggacgtactccgatcctcttgccctgaaggaatttaaagagttcgctgcgggcagaaagagcatcgccctggacctcgtgaccgaaattgggcgcgtcccctctcatctggctcacagaacacggaatgcccttgataacctggtgatgctccatacctccgagcacggaggccgcgcctatagacacgctgtcgaggaactgcctgagacaatggaaaccctgctccttctgggcctgatgatcctcctgacagggggagccatgctttttctgattagcggcaaagggatcggaaagacctccatcggcctcatttgtgtgatcgcgtctagcgggatgctgtggatggccgagattcccctgcaatggatcgcttccgccattgttctcgagttctttatgatggtgcttctgatccctgaacccgagaagcagcggacaccgcaggacaatcaactggcttacgtggtcattggaatcctcaccctggccgcgatcattgccgctaacgaaatgggccttctggagacaaccaaacgcgatctcggcatgagcaaggaacctggggttgtgtctcccacgtcctatctggacgtggatctgcatcccgccagcgcttggacactctacgccgtcgctaccacagtgatcacccctatgcttagacacaccattgaaaattctacagccaacgttagcctggcggccatcgctaaccaggccgtggtcctgatgggactcgacaaaggctggccgatttccaagatggacctgggggtgccccttctggctctcggatgctactctcaggtcaatcctctgacgctgaccgccgccgtgctccttctgatcacacattatgcgatcattggccccgggctgcaggctaaagccacccgggaggctcaaaagagaacagccgccggaatcatgaagaaccctaccgttgatggcattatgacgatcgacctcgatcccgtgatttacgacagcaaattcgaaaagcagctgggccaggtcatgcttctggtgctctgtgctgttcagctgctgctcatgcgcacatcctgggccctttgcgaggcgctgaccctggccaccgggcctatcacaaccctctgggaaggatctccgggcaaattttggaatacaacgatcgctgtgagcatggccaacattttccgggggtcctatctggctggagccggccttgcgtttagcatcatgaagtctgtcgggaccggaaaaagaggcacaggctcccaaggggagaccctgggagaaaagtggaagaaaaagctcaatcagctgagccgcaaagatttcgacctgtacaagaaatccggcattacagaggtggatcggaccgaggccaaggaagggctcaaaagaggagagatcacgcaccatgctgtgtctcggggcagcgccaaacttcagtggtttgttgaacgcaacatggtcattcccgaggggagagtgatcgacctgggatgtggccggggcgggtggtcctattactgcgctggactgaagaaagtgaccgaagtccgcggctatacaaaagggggacctggccacgaggagcccgttcctatgtctacctacgggtggaatattgtgaaactcatgagcggaaaggatgtgttctacctgcccccggaaaaatgtgacacacttctgtgcgatatcggcgagtccagcccttctcccaccgtcgaagagtccagaacaatccgggtgctcaagatggttgagccctggctgaagaacaatcagttctgtattaaagtgctgaacccttatatgcccaccgtcatcgaacacctcgagcgccttcaaagaaagcatggcgggatgctggtgcggaatcctctgagccgcaactctacgcacgaaatgtactggatttccaatggaacaggcaacatcgttgccagcgtgaatatggtctctagactcctgcttaaccggtttaccatgacccatagacgcccgacaattgagaaagacgtggatctgggggctggaacgcggcacgtgaacgccgaacccgagacccctaatatggacgtcatcggcgagagaatcaagcgcattaaagaagaacacaacagcacatggcattatgacgatgaaaatccctacaagacctgggcgtatcacgggtcctacgaggttaaggccacaggatctgctagctccatgatcaacggcgtggtgaaactcctgaccaagccttgggacgtcgtgcccatggttacacagatggccatgaccgatacgaccccgttcggccagcaacgggtgtttaaagaaaaggtcgacacaagaacccctcgcagcatgcccgggacacggagagtgatgggaattaccgctgagtggctgtggcgcacgctcggccggaataaaaagcctagactgtgcacacgcgaggagttcaccaagaaagttcggacaaacgccgccatgggggcggtgtttaccgaggaaaatcagtgggattccgctaaggccgccgtcgaggacgaagatttctggaaacttgtggacagagagcgcgagctgcataagctcggaaaatgtggctcttgcgtttataacatgatggggaagagagagaagaagctgggcgagtttggaaaggctaaaggcagccgggccatctggtacatgtggcttggggctcgctacctggagttcgaggccctcggatttctgaatgaggatcactggttctccagagaaaactcttatagcggcgtggagggggaaggactgcataagctcggctacattctgcgggacatctccaaaatccccgggggcgcgatgtatgccgatgacacggctggatgggacaccagaattacagaggatgaccttcacaatgaagagaagatcacccagcagatggatcctgagcaccggcaactggccaacgctatttttaaactcacataccagaataaggtcgtgaaggtccagcgccccaccccgacaggcaccgtgatggacatcatttctagaaaagatcagcgggggagcggacaagttggcacgtatgggctgaacacattcaccaatatggaagcccagcttatccgccagatggagggagaaggcgtgctgtccaaggcggacctcgagaaccctcatctgcccgagaagaagatcacccagtggctggagacaaaaggggtcgagagactcaagcggatggccattagcggcgatgactgcgtggtgaagcccatcgatgaccgctttgctaacgccctgcttgctctgaatgatatgggaaaagttagaaaggacattcctcaatggcagccgtctaaaggctggcacgattggcaacaggtgcccttctgttcccatcacttccacgaactcatcatgaaggacgggcggaaactggtcgtgccttgccgcccccaagacgagcttattggacgggcccggatcagccagggcgctgggtggtctctgaaggaaaccgcctgtctcggaaaggcgtacgcccagatgtggtccctgatgtattttcatcgcagagatctgcggctcgctagcaacgccatttgctctgccgttcctgtgcactgggtccccacatcccgcacgacctggagcatccatgctcaccatcaatggatgacaaccgaggacatgctgacagtgtggaatagagtctggatcgaagataacccttggatggaggacaaaacccccgtgacgacctgggagaatgttccgtaccttggcaagcgggaagatcagtggtgtgggtccctgattggcctcacaagcagagccacctgggcgcagaacatccctacagctattcagcaagtgcgctctctgatcggaaatgaggagttccttgactacatgcccagcatgaaacggtttagaaaggaggaggaatccgagggcgccatttggtga

SEQ ID NO: 20584 - RNA, 9873 nt, synthetic construct
  misc_feature 1..9873: note = derived and/or modified CDS sequence (opt5) from DENV-3__JF920406__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttgaaatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatggctgtggccgccatgggggtgcctcccctccctctgtttatcttcggactcaaggatacactgaagagacgctcttggccccttaatgaaggcgtcatggctgtggggctggttagcattctggcgtcctctctcctgagaaacgacgtgcctatggccggaccccttgtcgctggcgggctgctcatcgcctgttatgtgattaccggaaccagcgccgatctgacagttgagaaagctgccgacatcacctgggaagaggaagcggagcagacaggcgtgtcccacaacctcatgattacggtcgacgatgacggcaccatgcggatcaaggatgacgagacagaaaatatcctgaccgtgcttctgaaaacagctctgctcattgtcagcgggatctttccgtactctattcctgccaccctgcttgtgtggcatacgtggcagaagcagacccaacgctccggagttctgtgggatgtgcccagccctcccgagacacagaaagccgaactcgaggagggcgtctacagaatcaagcagcaggggattttcggaaaaacccaagtgggcgttggggtgcagaaggaaggagtctttcacacaatgtggcacgtgacccggggcgctgtgctgacatataacggcaagcgcctcgagccgaattgggcctctgttaaaaaggacctgatctcctacgggggaggctggagacttagcgcgcagtggcaaaaaggggaagaggtccaggtgattgctgtggaacctggaaagaaccccaaaaatttccagacgatgcctggcaccttccagacaaccaccggggagatcggagccatcgccctggattttaagcccggcacatctggctcccccattatcaaccgggaggggaaggtcgtgggactgtatggcaatggggttgtgacgaaaaacggaggctacgtcagcgggattgctcaaaccaatgccgaacctgacggcccgacacccgagctcgaagaggaaatgttcaagaaacgcaacctgaccatcatggatcttcatcctggatccggcaagacaagaaaatatctgcccgctattgtgcgggaggccatcaagcgcagactccggaccctgatcctcgcgcctacgagagttgtggccgctgagatggaagaggccctgaaggggcttcccattcgctaccagacaaccgctaccaaaagcgaacacacaggacgggagatcgtcgacctgatgtgccatgccacctttacaatgagactgctctctcctgtgcgcgttccgaattataacctgattatcatggatgaagcccacttcaccgaccccgctagcattgcggcccggggctacatctccacgagagtggggatgggagaggctgccgccatctttatgacagctacccctcccggcacagccgatgcgttccctcagtctaatgctcccattcaggacgaggaacgcgacatcccggagcggagctggaactccgggaatgaatggattaccgattttgccggcaagacggtctggttcgtgccttctatcaaagccggaaacgacattgctaactgtcttagaaagaatggcaaaaaggtgatccaactgagccgcaagacctttgatacagagtaccagaaaaccaagctcaacgactgggatttcgtcgttacaaccgacatttccgagatgggggccaattttaaagcggatcgggtgatcgaccccagacggtgcctgaagcccgtgatcctgacagatggacctgaacgcgtcattctcgccggccccatgcctgtgaccgctgcctctgctgcccagagacgggggcgcgttggaagaaacccgcagaaagagaatgaccaatatatcttcacgggccagccccttaacaatgatgaagaccatgctcactggacagaggccaagatgctgctggacaacattaatacccctgaagggatcattcccgcgctcttcgagcctgagcgggaaaagagcgccgctatcgatggcgagtacagactgaaaggagaatcccgcaagacctttgtggagcttatgcggagaggcgacctgcccgtctggctcgcccacaaagtggctagcgaagggatcaagtatacagatcgcaaatggtgcttcgacggacagcggaacaatcagattctggaggagaacatggatgttgaaatctggaccaaggagggcgaaaaaaagaagctgagaccgcgctggctcgacgcccggacatactctgatcctcttgccctgaaagagtttaaggaattcgctgcggggagaaaatccattgccctggacctcgtgacggagatcggacgcgtccccagccatctggctcacagaacccggaatgcccttgataacctggtgatgctccatacatctgagcacggcggccgcgcctatagacacgctgtcgaagagctgcctgaaaccatggagacactgctccttctggggctgatgattctcctgaccggaggcgccatgctttttctgatctccgggaagggaatcggcaaaacgagcattgggctcatctgtgtgattgcgtcctctggaatgctgtggatggccgagatccccctgcaatggattgctagcgccatcgttctcgaattctttatgatggtgcttctgattcctgagcccgaaaagcagcggaccccgcaggacaatcaactggcttacgtggtcatcggcatcctcacactggccgcgattatcgccgctaacgagatgggccttctggaaaccacaaagcgcgatctcgggatgtccaaagagcctggagttgtgagccccacctcttatctggacgtggatctgcatcccgcctccgcttggacgctctacgccgtcgctacaaccgtgattacacctatgcttagacacaccatcgagaatagcaccgccaacgtttctctggcggccattgctaaccaggccgtggtcctgatgggcctcgacaaggggtggccgatcagcaaaatggacctgggagtgccccttctggctctcggctgctactcccaggtcaatcctctgacactgacggccgccgtgctccttctgatcacccattatgcgattatcgggcccggactgcaggctaaggccacacgggaagctcaaaaaagaaccgccgccggcattatgaagaaccctacagttgatggcatcatgaccattgacctcgatcccgtgatctacgactctaagttcgagaaacagctggggcaggtcatgcttctggtgctctgtgctgttcagctgctgctcatgcgcacgagctgggccctttgcgaagcgctgacactggccaccggacctatcaccacactctgggagggctccccggggaagttttggaataccacaattgctgtgtctatggccaacatcttccggggaagctatctggctggcgccgggcttgcgttttccattatgaaaagcgtcggaacgggcaagagaggcaccgggtctcaaggagaaacactgggcgagaaatggaagaagaaactcaatcagctgtcccgcaaggatttcgacctgtacaaaaagagcgggatcaccgaggtggatcggacagaagccaaagagggactcaagagaggcgaaattacccaccatgctgtgtcccgggggtctgccaaacttcagtggtttgttgagcgcaacatggtcatccccgaaggaagagtgattgacctgggctgtggccgggggggatggagctattactgcgctggcctgaagaaggtgacggaggtccgcgggtataccaaaggaggccctgggcacgaggaacccgttcctatgtccacatacggatggaatatcgtgaagctcatgtctggcaaagatgtgttctacctgcccccggagaagtgtgacacccttctgtgcgatatcggcgaaagctcccctagccccacagtcgaggagtctagaaccattcgggtgctcaaaatggttgaaccctggctgaagaacaatcagttctgtatcaaggtgctgaacccttatatgcccacagtcattgagcacctcgaacgccttcaaagaaaacatgggggaatgctggtgcggaatcctctgtcccgcaacagcacccacgagatgtactggatctctaatggcacggggaacattgttgcctccgtgaatatggtcagcagactcctgcttaaccggtttacaatgacccatagacgcccgaccatcgaaaaggacgtggatctgggagctggcacacggcacgtgaacgccgagcccgagacgcctaatatggacgtcatcggggaaagaattaaacgcatcaaggaggaacacaactctacctggcattatgacgatgagaatccctacaaaacatgggcgtatcacggaagctacgaagttaaggccaccggctccgcttctagcatgattaacggcgtggtgaagctcctgacaaaaccttgggacgtcgtgcccatggttacccagatggccatgacagataccacgccgttcgggcagcaacgggtgtttaaggagaaagtcgacaccagaacacctcgctccatgcccggaacccggagagtgatgggcatcacagctgagtggctgtggcgcaccctcgggcggaataagaaacctagactgtgcacgcgcgaagagttcacaaagaaggttcggaccaacgccgccatgggagcggtgtttacagaagagaatcagtgggatagcgctaaagccgccgtcgaagacgaggatttctggaagcttgtggacagagagcgcgaactgcataaactcggcaagtgtgggtcctgcgtttataacatgatgggcaaaagagagaagaaactgggagaatttggcaaggctaaggggtctcgggccatttggtacatgtggcttggagctcgctacctggagttcgaggccctcggctttctgaatgaagatcactggttcagcagagagaactcctattctggggtggaaggagagggcctgcataaactcgggtacatcctgcgggacatcagcaagattcccggcggagcgatgtatgccgatgacaccgctggctgggacacgagaatcaccgaagatgaccttcacaatgaggagaaaattacacagcagatggatcctgaacaccggcaactggccaacgctatctttaagctcacctaccagaataaagtcgtgaaggtccagcgccccacaccgaccgggacagtgatggacattatctccagaaaggatcagcggggatctggccaagttgggacctatggactgaacacgttcacaaatatggaggcccagcttatccgccagatggaaggcgagggggtgctgagcaaagcggacctcgaaaaccctcatctgcccgagaagaaaattacccagtggctggagaccaagggcgtcgaaagactcaaacggatggccatctccggagatgactgcgtggtgaagcccattgatgaccgctttgctaacgccctgcttgctctgaatgatatgggcaaggttagaaaagacatccctcaatggcagccgagcaaggggtggcacgattggcagcaggtgcccttctgttctcatcacttccacgagctcattatgaaagacggacggaagctggtcgtgccttgccgcccccaagacgaacttatcggcagagcccggatttcccagggggctggatggagcctgaaagagacagcctgtctcggcaaggcgtacgcccagatgtggtctctgatgtattttcatcgcagagatctgcggctcgcttccaacgccatctgcagcgccgttcctgtgcactgggtccccacctctcgcacaacgtggtccatccatgctcaccatcaatggatgaccacagaagacatgctgaccgtgtggaatagagtctggattgaggataacccttggatggaggacaagacacccgtgaccacgtgggaaaatgttccgtaccttgggaaacgggaggatcagtggtgtggcagcctgatcggactcacctccagagccacatgggcgcagaacattcctaccgctatccagcaagtgcgcagcctgattggcaatgaagagttccttgactacatgccctctatgaagcggtttagaaaagaggaagagagcgaaggggccatctggtga

SEQ ID NO: 20585 - RNA, 9873 nt, synthetic construct
  misc_feature 1..9873: note = derived and/or modified CDS sequence (opt5) from DENV-3__JF920409__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcgctcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccacactcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgctttctttatgttcgttcttctgctcagcgggcagattacatggcgcgatatggcccataccctgatcatgattggatccaatgcgagcgacagaatgggcatgggggtgacatatctggctcttatcgccacctttaaaatccagcccttcctggccctcggatttttcctgcggaagctcacgtctagagaaaacctgcttctgggcgtcgggctcgctatggccacaaccctgcaactgcctgaggatattgaacagatggctaatggaatcgcccttggcctgatggcgctcaaactgattacacagtttgagacctaccagctctggaccgccctgatctcccttacatgtagcaacacgattttcaccctgacagtggcttggcgcaccgccacactcatcctggctggcgtgtccctgcttccggtctgccaatctagctccatgcggaagaccgactggctgcccatggccgttgccgctatgggggtgcctcccctccctctgtttatcttctctctcaaggatacgctgaaaagacgcagctggccccttaatgagggagtgatggcggtcggcctggtgtccattctggcctctagcctcctgagaaacgacgttcctatggctgggccccttgtggccggaggcctgctcatcgcctgttatgtcattacagggacctccgctgatctgaccgtggaaaaggccgcggacatcacatgggaggaagaggctgaacagaccggagttagccacaacctcatgattacagtggacgatgacggcacgatgcggatcaaagatgacgagtctgagaatatcctgaccgtccttctgaagacagccctgctcattgtgtccggcatctttccgtacagcattcctgccaccctgcttgtctggcatacatggcagaaacagacccaacgctctggggtgctgtgggatgttccctcccctcccgaaacgcagaaggctgagctcgaagagggagtgtacagaatcaaacagcagggcattttcgggaagacccaagtcggagtgggcgttcagaaggagggggtgtttcacacaatgtggcacgtcacccggggagccgtgctgacatataacggcaaacgcctcgaaccgaattgggcgagcgtgaagaaagacctgatctcttacggcgggggatggagactttccgctcagtggcaaaagggcgaggaagttcaggtcattgccgtggagcctgggaaaaaccccaagaatttccagaccatgcctggaacattccagacgaccacaggcgaaatcggggccatcgctctggattttaagcccggaaccagcggctcccccattatcaaccgggagggcaaagtggtcgggctgtatggaaatggcgtggttaccaagaacgggggatacgtgagcggcattgcccaaacaaatgctgagcctgacgggccgacgcccgaactcgaggaagagatgttcaaaaagcgcaacctgaccatcatggatcttcatcctggctctggaaaaacaagaaagtatctgcccgccattgtccgggaagcgatcaagcgcagactccggaccctgatcctcgcccctacaagagtggttgctgccgagatggaggaagctctgaaaggccttcccattcgctaccagaccacggccacaaagagcgagcacaccgggcgggaaatcgtggacctgatgtgccatgccacctttacaatgagactgctctcccctgtccgcgtgccgaattataacctgattatcatggatgaggctcacttcaccgaccccgcgtctattgccgctcggggatacatcagcacaagagttggcatgggggaagccgccgctatctttatgaccgccacgcctcccggaacagcggatgctttccctcagtccaatgcccccattcaggacgaggagcgcgacatcccggaacggtcttggaacagcggcaatgagtggattaccgattttgccgggaaaacagtgtggttcgtcccttccatcaaggctggcaacgacattgccaactgtcttcgcaaaaatggaaagaaggtgatccaactgtctagaaaaacctttgatacggaataccagaagaccaaactcaacgactgggatttcgtggtcacaaccgacattagcgagatgggcgcgaattttaaggccgatcgggttatcgaccccagacggtgcctgaaacccgtgatcctgacagatgggcctgagcgcgtgattctcgctggacccatgcctgtcaccgccgcttccgccgctcagagacggggccgcgtggggagaaacccgcagaaggaaaatgaccaatatatcttcacaggacagccccttaacaatgatgaggaccatgcccactggaccgaagcgaagatgctgctggacaacattaatacgcctgagggcatcattcccgccctcttcgaacctgagcgggagaaaagcgctgccatcgatggggaatacagactgaagggcgagtctcgcaaaacatttgttgaacttatgcggagaggagacctgcccgtgtggctcgctcacaaggtcgcctccgagggcatcaaatataccgatcgcaagtggtgcttcgacgggcagcggaacaatcagattctggaagagaacatggatgtggagatctggaccaaagaaggagagaagaagaaactgagaccgcgctggctcgacgcccggacatacagcgatcctcttgctctgaaggaatttaaagagttcgcggccggcagaaagtctattgctctggacctcgttaccgaaatcgggcgcgtgccctcccatctggcccacagaacacggaatgcccttgataacctggtcatgctccatacgagcgagcacggaggccgcgcttatagacacgccgtggaggaactgcctgagaccatggaaacactgctccttctgggcctgatgattctcctgaccgggggagcgatgctttttctgatctccggcaaagggatcggaaagacatctattggcctcatctgtgtcattgccagctccgggatgctgtggatggctgagatccccctgcaatggattgccagcgctatcgtgctcgagttctttatgatggttcttctgattcctgaacccgagaagcagcggaccccgcaggacaatcaactggcctacgtggtgatcggaatcctcacgctggcggccattatcgctgccaacgaaatgggccttctggagaccacaaaacgcgatctcggcatgtctaaggaacctggggtcgtttcccccaccagctatctggacgtggatctgcatcccgcttctgcctggacactctacgctgtggccaccacggtcattacacctatgcttagacacaccatcgagaatagcacagcgaacgtgtccctggccgctattgccaaccaggctgttgtgctgatgggactcgacaaaggctggccgatctctaagatggacctgggggtcccccttctggccctcggatgctacagccaggtgaatcctctgaccctgaccgccgcggtcctccttctgatcacacattatgctattatcggccccgggctgcaggccaaagctacgcgggaggcccaaaagagaaccgccgctggaattatgaagaaccctacagtggatggcatcatgaccattgacctcgatcccgttatctacgactccaaattcgaaaagcagctgggccaggtgatgcttctggtcctctgtgccgtgcagctgctgctcatgcgcacatcttgggcgctttgcgaggccctgaccctggctacggggcctatcacaaccctctgggaaggaagcccgggcaaattttggaataccacaattgccgtttccatggctaacatcttccgggggagctatctggccggagcgggccttgccttttctattatgaagtccgtggggaccggaaaaagaggcacaggcagccaaggggagacgctgggagaaaagtggaagaaaaagctcaatcagctgtcccgcaaagatttcgacctgtacaagaaatctggcatcaccgaggtcgatcggacagaggctaaggaagggctcaaaagaggagagattacccaccatgccgtgagccggggctccgctaaacttcagtggtttgtggaacgcaacatggttatccccgaggggagagtcattgacctgggatgtggccggggcgggtggtcttattactgcgccggactgaagaaagtgacagaagtgcgcggctataccaaagggggacctggccacgaggagcccgtccctatgagcacgtacgggtggaatatcgttaaactcatgtccggaaaggatgtgttctacctgcccccggaaaaatgtgacacccttctgtgcgatatcggcgagagctctccttcccccacagtggaagagagcagaaccattcgggtcctcaagatggtggagccctggctgaagaacaatcagttctgtatcaaagttctgaacccttatatgcccacagtgattgaacacctcgagcgccttcaaagaaagcatggcgggatgctggtccggaatcctctgtctcgcaactccacccacgaaatgtactggatcagcaatggaacaggcaacattgtggcttctgttaatatggtgagcagactcctgcttaaccggtttaccatgacgcatagacgcccgacaatcgagaaagacgtcgatctgggggccggaacccggcacgtgaacgcggaacccgagacccctaatatggacgtgatcggcgagagaattaagcgcatcaaagaagaacacaactccacatggcattatgacgatgaaaatccctacaagacgtgggcctatcacgggtcttacgaggtcaaggctaccggaagcgcctccagcatgattaacggcgttgtgaaactcctgacaaagccttgggacgtggtccccatggtgacccagatggctatgacagataccacaccgttcggccagcaacgggtttttaaagaaaaggtggacaccagaacgcctcgctccatgcccgggacccggagagtcatgggaatcacagccgagtggctgtggcgcaccctcggccggaataaaaagcctagactgtgcacacgcgaggagttcaccaagaaagtgcggacgaacgccgcgatgggggctgtttttacagaggaaaatcagtgggattctgccaaggccgctgtggaggacgaagatttctggaaacttgtcgacagagagcgcgagctgcataagctcggaaaatgtggcagctgcgtgtataacatgatggggaagagagagaagaagctgggcgagtttggaaaggccaaaggctcccgggctatttggtacatgtggcttggggcccgctacctggagttcgaggcgctcggatttctgaatgaggatcactggttctctagagaaaacagctattccggcgttgagggggaaggactgcataagctcggctacatcctgcgggacatctctaaaattcccgggggcgccatgtatgctgatgacaccgccggatgggacacaagaatcaccgaggatgaccttcacaatgaagagaagattacgcagcagatggatcctgagcaccggcaactggctaacgccatctttaaactcacctaccagaataaggtggtcaaggtgcagcgccccacaccgaccggcacagtcatggacattatcagcagaaaagatcagcgggggtccggacaagtgggcacctatgggctgaacacattcaccaatatggaagcgcagcttatccgccagatggagggagaaggcgttctgagcaaggccgacctcgagaaccctcatctgcccgagaagaagattacgcagtggctggagacaaaaggggtggagagactcaagcggatggctatctctggcgatgactgcgtcgtgaagcccattgatgaccgctttgccaacgctctgcttgccctgaatgatatgggaaaagtgagaaaggacatccctcaatggcagccgtccaaaggctggcacgattggcagcaggttcccttctgtagccatcacttccacgaactcattatgaaggacgggcggaaactggtggtcccttgccgcccccaagacgagcttatcggacgggctcggatttctcagggcgccgggtggtccctgaaggaaaccgcgtgtctcggaaaggcctacgctcagatgtggagcctgatgtattttcatcgcagagatctgcggctcgcctctaacgccatctgctccgctgtgcctgttcactgggtgcccaccagccgcacaacctggtccatccatgcccaccatcaatggatgacaacggaggacatgctgaccgtctggaatagagtgtggattgaagataacccttggatggaggacaaaacacccgtcaccacatgggagaatgtgccgtaccttggcaagcgggaagatcagtggtgtgggagcctgatcggcctcacctctagagcgacgtgggctcagaacattcctaccgccatccagcaagttcgcagcctgattggaaatgaggagttccttgactacatgccctccatgaaacggtttagaaaggaggaggaatctgagggcgccatctggtga

SEQ ID NO: 20586 - RNA, 9873 nt, synthetic construct
  misc_feature 1..9873: note = derived and/or modified CDS sequence (opt5) from DENV-3__JF920408__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacggcacccaaggcgttacagctgagattacccctcaggcctctacaaccgaagctatcctgcccgagtatgggacgctgggactcgaatgctcccctcgcaccggcctggacttcaatgagatgattcttctgacaatgaaaaacaaggcctggatggtgcatagacagtggtttttcgatctccccctgccgtggaccagcggggccacaaccgagacgcctacatggaatcggaaagaacttctggtcacctttaagaacgctcacgcgaaaaagcaagaggtggtcgtgctcggatctcaggaaggcgccatgcacacagctctgaccggggccaccgagatccagaattccggcggaacaggcattttcgccgggcatctgaagtgtcgcctcaaaatggacaagctggaacttaaaggaatgagctacgctatgtgcacgaacacctttgttctgaagaaagaggtgtctgagacacagcacggcaccatcctcatcaaggtcgaatacaagggggaggatgtgccctgtaaaattcctttctccacagaagacggacaaggcaaggcccataacgggagactgatcaccgcgaatcccgttgtgacgaaaaaggaggagcccgtcaacattgaagctgagcctccgttcggcgaaagcaatatcgtgattggaatcggcgataacgccctgaaaatcaattggtataagaaggggtcctctattggaaaaatgtttgaggccacagctcggggcgccagacgcatggctatccttggggacaccgcctgggatttcggaagcgtgggcggggttctcaactccctgggcaagatggtccaccagatttttggaagcgcgtacaccgccctgttctctggcgtgtcctgggtgatgaaaatcgggattggagtcctcctgacatggatcggccttaatagcaagaacacctctatgagcttttcctgcattgctatcgggatcattacactgtatctcggagccgtggttcaggctgacatgggctgtgtgatcaattggaaagggaaggaactgaagtgcggctctggaattttcgtcacgaacgaggtgcatacctggacagagcagtacaaatttcaagccgatagccccaagcggctggcgaccgccatcgctggcgcctgggaaaatggggtttgtggaattagatccacaacccgcatggagaaccttctctggaaacagatcgctaatgaactgaactatatcctgtgggagaataacattaagctcacggtggtcgtgggcgacatcattggggttctggaacagggaaaacggacccttacacctcagcccatggagctgaagtacagctggaaaacctggggcaaggccaagatcgtgacagccgagacccaaaactcttccttcattatcgatggccctaatacacccgaatgcccgagcgtctctagagcttggaacgtgtgggaggtggaagactatgggtttggagtcttcaccacgaatatctggctcaaactgcgcgaggtttacacacagctgtgtgaccaccggcttatgtccgcggccgtgaaggatgaaagagctgtgcacgccgacatgggctactggattgagagccagaaaaacgggtcctggaagctcgagaaagcctctctgatcgaagtcaagacctgcacctggcctaagagccatacactgtggtccaatggagtgctcgagtctgatatgattatccccaaaagcctggctggccctatttcccagcacaaccatcgccccgggtatcacacccaaacggccggaccttggcaccttggcaagctggaactcgactttaattactgcgagggcacaaccgttgtgatcacagagaactgtgggacccggggacccagcctgagaacaaccacggtctctggcaaactgatccatgaatggtgctgtcgctcctgcacccttccgcctctccggtatatgggggaggatggatgttggtacggcatggaaattagacccatcagcgagaaggaagagaatatggtgaaatctctggtttccgcggggagcggaaaggtggacaacttcacaatgggcgtcctgtgcctcgctattctgtttgaggaagtgatgcggggcaagttcgggaaaaagcacatgatcgccggagttttctttaccttcgtgcttctgctctctggccagattacatggcgcgatatggcccataccctgatcatgattgggagcaatgcttccgacagaatgggaatgggcgtcacgtatctggcccttatcgcgacatttaaaatccagcccttcctggctctcgggtttttcctgcggaagctcaccagcagagagaacctgcttctgggagtgggcctcgccatggccacaaccctgcaactgcctgaagatattgagcagatggctaatggcatcgcccttgggctgatggctctcaaactgattacccagtttgaaacataccagctctggacggccctgatctctcttacctgttccaacacaattttcaccctgacagtggcgtggcgcaccgccacgctcatcctggctggagtcagcctgcttccggtttgccaatcctctagcatgcggaagacagactggctgcccatggccgtggctgccatgggcgtgcctcccctccctctgtttatcttcgggctcaaggataccctgaaaagacgctcctggccccttaatgagggagtcatggccgtgggcctggtttctattctggctagctccctcctgagaaacgacgtgcctatggcggggccccttgtcgccggaggcctgctcatcgcttgttatgtgattaccggcacatctgccgatctgaccgttgagaaggccgctgacatcacatgggaagaggaagccgagcagacgggggtgagccacaacctcatgattaccgtcgacgatgacggaacaatgcggatcaaagatgacgaaaccgagaatatcctgacagtgcttctgaagaccgcgctgctcattgtctccggcatctttccgtacagcattcctgctacgctgcttgtgtggcatacctggcagaaacagacacaacgctctggggttctgtgggatgtgccctcccctcccgagacccagaaggccgaactcgaggaaggagtctacagaatcaaacagcagggcattttcgggaagacacaagtgggagttggcgtgcagaaggagggcgtctttcacaccatgtggcacgtgacacggggggccgtgctgacgtataacggaaaacgcctcgagccgaattgggctagcgttaagaaagacctgatctcttacggcgggggatggagactttccgcccagtggcaaaagggcgaagaggtccaggtgattgcggtggaacctgggaaaaaccccaagaatttccagaccatgcctggaacattccagaccaccacaggcgagatcggcgctatcgccctggattttaagcccgggacgagcggatctcccattatcaaccgggaaggcaaagtcgtggggctgtatggaaatggcgttgtgaccaagaacgggggctacgtctccggaattgcccaaacaaatgctgagcctgacggcccgacccccgagctcgaagaggaaatgttcaaaaagcgcaacctgacaatcatggatcttcatcctgggagcggaaaaaccagaaagtatctgcccgccattgtgcgggaggctatcaagcgcagactccggacgctgatcctcgcccctacaagagttgtggcggccgaaatggaggaggctctgaaaggccttcccattcgctaccagaccaccgccacaaagtccgaacacaccgggcgggagatcgtcgacctgatgtgccatgctacatttaccatgagactgctcagccctgtgcgcgttccgaattataacctgattatcatggatgaagcccacttcacggaccccgcctctattgctgcgcggggatacatcagcacaagagtgggcatgggggaggccgctgccatctttatgaccgccacacctcccggcaccgctgatgccttccctcagtccaatgcgcccattcaggacgaagagcgcgacatcccggagcggtcttggaacagcggaaatgaatggattacggattttgctggcaaaaccgtctggttcgtgccttccatcaaggccgggaacgacattgccaactgtcttagaaaaaatggaaagaaggtgatccaactgtctcgcaaaacatttgataccgagtaccagaagacaaaactcaacgactgggatttcgtcgttaccacagacattagcgaaatgggcgctaattttaaggccgatcgggtgatcgaccccagacggtgcctgaaacccgtgatcctgaccgatgggcctgagcgcgtcattctcgcgggacccatgcctgtgacggccgcttccgccgctcagagacggggccgcgttgggagaaacccgcagaaggagaatgaccaatatatcttcacaggccagccccttaacaatgatgaagaccatgcccactggaccgaggctaagatgctgctggacaacattaatacccctgaaggaatcattcccgccctcttcgagcctgaacgggagaaatctgcggccatcgatggcgagtacagactgaagggggaaagccgcaaaacatttgtggagcttatgcggagaggagacctgcccgtctggctcgctcacaaggtggcctccgaaggcatcaaatataccgatcgcaagtggtgcttcgacgggcagcggaacaatcagattctggaggaaaacatggatgttgagatctggacaaaagagggagaaaagaagaaactgagaccgcgctggctcgacgctcggacgtacagcgatcctcttgccctgaaggagtttaaagaattcgccgctggcagaaagtctattgcgctggacctcgtgaccgagatcggccgcgtcccctcccatctggcccacagaacacggaatgctcttgataacctggtgatgctccataccagcgaacacgggggacgcgcctatagacacgccgtcgaggagctgcctgaaacaatggagaccctgctccttctgggcctgatgattctcctgacggggggagctatgctttttctgatctctggcaaagggatcggaaagacctccattggcctcatctgtgtgattgccagctccggcatgctgtggatggcggaaatccccctgcaatggattgcctctgctatcgttctcgagttctttatgatggtgcttctgattcctgagcccgaaaagcagcggacaccgcaggacaatcaactggcctacgtggtcatcgggatcctcaccctggctgccattatcgcggccaacgagatgggacttctggaaacaaccaaacgcgatctcggcatgagcaaggagcctggggttgtgtcccccacgagctatctggacgtggatctgcatcccgcttctgcctggacactctacgctgtcgccaccacagtgattacccctatgcttagacacaccatcgaaaattccacagctaacgttagcctggccgcgattgccaaccaggctgtggtcctgatgggactcgacaaaggctggccgatctctaagatggacctgggggtgccccttctggccctcggatgctacagccaggtcaatcctctgacgctgaccgctgccgtgctccttctgatcacacattatgccattatcggccccggcctgcaggcgaaagctacccgggaggcccaaaagagaacagctgccgggattatgaagaaccctaccgttgatggaatcatgacgattgacctcgatcccgtgatctacgactccaaattcgagaagcagctgggccaggtcatgcttctggtgctctgtgccgttcagctgctgctcatgcgcacatcttgggctctttgcgaagccctgaccctggcgaccgggcctatcacaaccctctgggagggaagcccgggcaaattttggaatacaacgattgccgtgtccatggctaacatcttccgggggtcttatctggccggagctggccttgcctttagcattatgaagtccgtcggcaccgggaaaagaggaacaggcagccaaggggaaaccctgggagagaagtggaagaaaaagctcaatcagctgtctcgcaaagatttcgacctgtacaagaaatccggcatcacagaagtggatcggaccgaggcgaaggaggggctcaaaagaggagaaattacgcaccatgccgtgagccggggctccgctaagcttcagtggtttgttgagcgcaacatggtcatccccgaaggcagagtgattgacctggggtgtggacggggcgggtggtcttattactgcgccggactgaagaaagtgaccgaggtccgcggctatacaaaggggggacctggccacgaagagcccgttcctatgagcacctacggctggaatatcgtgaaactcatgtccgggaaggatgtgttctacctgcccccggagaaatgtgacacacttctgtgcgatatcggagaatctagcccttcccccaccgtcgaggaaagcagaacaattcgggtgctcaagatggttgagccctggctgaagaacaatcagttctgtatcaaagtgctgaacccttatatgcccaccgtcattgagcacctcgaacgccttcaaagaaagcatggcgggatgctggtgcggaatcctctgtctcgcaactccacgcacgagatgtactggatcagcaatggaacaggcaacattgttgcttctgtgaatatggtctccagactcctgcttaaccggtttaccatgacccatagacgcccgacaatcgaaaaagacgtggatctgggggccggaacgcggcacgtgaacgctgagcccgaaacccctaatatggaggtcatcggcgagagaattaagcgcatcaaagaagagcacaacagcacatggcattatgacgacgaaaatccctacaagacctgggcctatcacggctcttacgaggttaaggcgacagggagcgcctcctctatgattaacggagtggtgaaactcctgaccaagccttgggatgtcgtgcccatggttacacagatggctatgaccgacacgaccccgttcggccagcaacgggtgtttaaagaaaaggtcgatacaagaacccctcgcagcatgcccgggacacggagagtgatgggaatcaccgccgagtggctgtggcgcacgctcggccggaataaaaagcctagactgtgcacacgcgaggaattcaccaagaaagttcggacaaacgctgccatgggggccgtgtttaccgaggaaaatcagtgggactccgcgaaggctgccgtcgaggatgaagacttctggaaacttgtggatagagagcgcgagctgcataagctcggcaaatgtggaagctgcgtttataacatgatgggcaagagagaaaaaaagctgggggagtttggaaaggccaaaggctcccgggctatttggtacatgtggcttggggcccgctacctggaattcgaggctctcggatttctgaatgaggaccactggttctctagagaaaacagctattccggcgtggagggggaaggcctgcataagctcggatacatcctgcgggatatctctaaaattcccggcggggccatgtatgcggacgatacggccggatgggacaccagaatcacagaggacgatcttcacaatgaagagaagattacccagcagatggaccctgagcaccggcaactggctgatgccatctttaaactcacataccagaacaaggtcgtgaaggtccagcgccccaccccgacaggcaccgtgatggacattatcagcagaaaagatcagcgggggtccggacaagttggcacgtatgggctgaatacattcaccaacatggaagctcagcttatccgccagatggagggcgaaggagtgctgtctaaggccgacctcgagaatcctcatctgcccgaaaaaaagattacccagtggctggagacaaaaggcgtcgagagactcaagcggatggcgatcagcggggatgactgcgtggtgaagcccattgatgaccgctttgccaacgctctgcttgccctgaacgatatgggaaaagttagaaaggacatccctcaatggcagccgtccaaaggctggcacgattggcagcaggtgcccttctgtagccatcacttccacgaactcattatgaaggacgggcggaaactggtcgtgccttgccgcccccaagacgagcttatcggaagagctcggatttctcagggcgccgggtggtccctgaaggaaaccgcttgtctcggcaaggcctacgcgcagatgtggagcctgatgtattttcatcgcagagatctgcggctcgcctctaatgctatctgctccgccgttcctgtgcactgggtccccacaagccgcacgacctggtctatccatgcccaccatcaatggatgacaaccgaggacatgctgacagtgtggaacagagtctggattgaagataatccttggatggaggacaaaacccccgtgacgacctgggagaacgttccgtaccttggaaagcgggaagatcagtggtgtggctccctgatcgggctcacaagcagagctacctgggcccagaatattcctacagcgatccagcaagtgcgctccctgattggaaacgaggaattccttgactacatgcccagcatgaaacggtttagaaaggaggaggaatctgagggcgctatctggtga

SEQ ID NO: 20587 - RNA, 9873 nt, synthetic construct
  misc_feature 1..9873: note = derived and/or modified CDS sequence (opt5) from DENV-3__JF920397__SS-prME
  source 1..9873: mol_type = other RNA
accagcctgtgcctcatgatgatcctgcccgccgctcttgccttccacctgacgtcccgggacggagagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagaccttctggtcacctttaagaacgctcacgcgaaaaagcaagaggtggtcgtgctcgggtctcaggaaggagccatgcatacagctctgaccggcgccaccgagatccaaaattccgggggcacaagcattttcgccggacacctgaagtgtcgcctcaaaatggataagctggaacttaaaggcatgtcttatgctatgtgcacgaacacctttgttctgaagaaagaggtgtccgagacacagcatgggaccatcctcatcaaggtcgaatacaagggagaggacgtgccctgtaaaattcctttcagcacagaagatggccaagggaaggcccacaacggaagactgatcaccgcgaatcccgttgtgacgaaaaaggaggagcccgtcaacattgaagctgagcctccgttcggcgaatccaatatcgtgattgggatcggcgacaacgccctgaaaatcaattggtacaagaagggatctagcattggcaaaatgtttgaggccacagctagaggggccagacgcatggctatccttggagataccgcctgggacttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgatatggggtgtgtgatcaattggaaaggaaaggaactgaagtgcggcagcgggattttcgtcacgaacgaggtgcacacctggacagagcagtataaatttcaagccgactcccccaagcggctggcgaccgccatcgctggcgcctgggaaaatggagtttgtggcattagaagcacaacccgcatggagaaccttctctggaaacagatcgctaatgaactgaactacatcctgtgggagaataacattaagctcacggtggtcgtgggggatatcattggagttctggaacagggcaaacggacccttacacctcagcccatggagctgaagtattcttggaaaacctgggggaaggccaagatcgtgacagccgagacccaaaactccagcttcattatcgacggacctaatacacccgaatgcccgtctgtctccagagcttggaacgtgtgggaggtggaagactacggctttggcgtcttcaccacgaatatctggctcaaactgcgcgaggtttatacacagctgtgtgatcaccggcttatgagcgcggccgtgaaggacgaaagagctgtgcatgccgatatggggtactggattgagtcccagaaaaacggatcttggaagctcgagaaagccagcctgatcgaagtcaagacctgcacctggcctaagtcccacacactgtggtctaatggcgtgctcgagagcgacatgattatccccaaatccctggctgggcctattagccagcataaccaccgccccggataccacacccaaacggccggcccttggcatcttgggaagctggaactcgattttaattattgcgagggaacaaccgttgtgatcacagagaactgtggcacccggggcccctctctgagaacaaccacggtctccgggaaactgatccacgaatggtgctgtcgcagctgcacccttccgcctctccggtacatgggagaggacggctgttggtatgggatggaaattagacccatctctgagaaggaagagaatatggtgaaatccctggttagcgcgggatctggcaaggtggataacttcacaatgggggtcctgtgcctcgctattctgtttgaggaagtgatgcggggaaagttcggcaaaaagcatatgatcgccggcgttttctttaccttcgtgcttctgctcagcgggcagattacatggcgcgacatggcccacaccctgatcatgattggatccaatgctagcgatagaatgggcatgggggtcacgtacctggcccttatcgcgacatttaaaatccagcccttcctggctctcggatttttcctgcggaagctcacctctagagagaacctgcttctgggcgtggggctcgccatggccacaaccctgcaactgcctgaagacattgagcagatggctaatggaatcgcccttggcctgatggctctcaaactgattacccagtttgaaatctatcagctctggacagccctgatttcccttacgtgtagcaacaccatcttcacactgaccgtggcgtggcgcacagccaccctcatcctggctggcgtctccctgcttccgatgtgccaatctagctccatgcggaagacggattggctgcccatggccgttgctgccatgggggtgcctcccctccctctgtttattttctctctcaaggacacactgaaaagacgcagctggccccttaatgagggagtgatggccgtcggcctggtgtccatcctggcttctagcctcctgagaaacgatgttcctatggcggggccccttgtggccggaggcctgctcattgcttgttacgtcatcaccgggacctccgccgacctgacagtggagaaggccgctgacattacctgggaagaggaagccgagcagacaggagttagccataacctcatgatcacggtggatgacgatggcaccatgcggatcaaagacgatgaaacagagaatattctgaccgtccttctgaagacagcgctgctcatcgtgtctggcatttttccgtattccatccctgctaccctgcttgtctggcacacgtggcagaaacagacccaacgcagcggggtgctgtgggacgttccctctcctcccgagacacagaaggccgaactcgaggaaggagtgtacagaattaaacagcagggcatcttcgggaagacccaagtcggagtgggcgttcagaaggagggggtgtttcacacaatgtggcatgtcacccggggagccgtgctgacatacaacggcaaacgcctcgagccgaattgggcttccgtgaagaaagatctgattagctatggcgggggatggagactttctacgcagtggcaaaagggcgaagaggttcaggtcatcgccgtggaacctgggaaaaaccccaagaatttccagaccatgcctggaacattccagaccaccacaggcgagatcggggcgattgctctggactttaagcccggaacgtccggcagccccatcattaaccgggaaggcaaagtggtcgggctgtacggaaatggcgtggttaccaagaacgggggatatgtgtccggcatcgcccaaacaaatgccgagcctgatgggccgacccccgagctcgaagaggaaatgttcaaaaagcgcaacctgacaattatggaccttcaccctggcagcggaaaaaccagaaagtacctgcccgctatcgtccgggaggccatcaagcgcagactccggacgctgattctcgctcctacaagagtggttgccgcggaaatggaggaggccctgaaaggccttcccatccgctatcagaccaccgctacaaagtctgaacataccgggcgggagattgtggatctgatgtgccacgccacatttaccatgagactgctcagccctgtccgcgtgccgaattacaacctgatcattatggacgaagctcatttcacggatcccgcctccatcgccgctcggggatatatctctacaagagttggcatgggggaggcggccgctatttttatgaccgccacacctcccggaaccgccgacgctttccctcagagcaatgcccccatccaggacgaagaacgcgatattccggagcggtcctggaactctggcaatgaatggatcacggactttgcggggaaaaccgtgtggttcgtccctagcattaaggctggcaacgatatcgccaactgtcttcgcaaaaatggaaagaaggtgattcaactgtccagaaaaacatttgacaccgagtaccagaagacaaaactcaacgattgggacttcgtggtcaccacagatatctctgaaatgggcgccaattttaaggctgaccgggttatcgatcccagacggtgcctgaaacccgtgattctgaccgacgggcctgagcgcgtgatcctcgccggacccatgcctgtcacggcggccagcgctgcccagagacggggccgcgtggggagaaacccgcagaaggagaatgatcaatacattttcacaggacagccccttaacaatgacgaagaccacgctcactggaccgaggccaagatgctgctggataacatcaatacccctgaaggcattatccccgctctcttcgagcctgaacgggagaaatccgccgcgatcgacggggagtatagactgaagggcgaaagccgcaaaacatttgttgagcttatgcggagaggagatctgcccgtgtggctcgcccataaggtcgcttctgaaggcattaaatacaccgaccgcaagtggtgcttcgatgggcagcggaacaatcagatcctggaggaaaacatggacgtggagatttggacaaaagagggagaaaagaagaaactgagaccgcgctggctcgatgcccggacgtattccgaccctcttgctctgaaggagtttaaagagttcgccgccggcagaaagagcatcgctctggatctcgttaccgagattgggcgcgtgccctctcacctggcgcatagaacacggaatgcccttgacaacctggtcatgctccacacctccgaacacggaggccgcgcttacagacatgccgtggaggagctgcctgaaacaatggagaccctgctccttctgggcctgatgatcctcctgacagggggagccatgctttttctgatcagcggcaaagggattggaaagacctccatcggcctcatttgtgtcatcgcttctagcgggatgctgtggatggccgaaattcccctgcaatggatcgcgtccgccattgtgctcgagttctttatgatggttcttctgatccctgagcccgaaaagcagcggacaccgcaggataatcaactggcttatgtggtgatcggcattctcaccctggccgctatcattgccgcgaacgagatgggccttctggaaacaaccaaacgcgacctcggcatgagcaaggagcctggggtcgtttctcccacgtcctacctggatgtggacctgcaccccgccagcgcttggacactctatgccgtggctaccacagtcatcacccctatgcttagacataccattgaaaattctacagccaacgtgagcctggctgccatcgcgaaccaggccgttgtgctgatgggactcgacaaaggctggccgatctccaagatggatctgggggtcccccttctggctctcggatgctactctcaggtgaatcctctgacgctgaccgccgctgtcctccttctgattacacactacgccatcattggccccgggctgcaggccaaagcgacccgggaggctcaaaagagaacagccgctggaatcatgaagaaccctaccgtggacggcattatgacgatcgatctcgaccccgttatctatgatagcaaattcgagaagcagctgggccaggtgatgcttctggtcctctgtgtggttcagctgctgctcatgcgcacatcctgggccctttgcgaagccctgaccctggctaccgggcctattacaaccctctgggagggatctccgggcaaattttggaatacaacgatcgccgtgagcatggcgaacattttccgggggtcctacctggccggagctggccttgcctttagcatcatgaagtctgtcgggaccggaaaaagaggcacaggctcccaaggggaaaccctgggagagaagtggaagaaaaagctcaatcagctgagccgcaaagacttcgatctgtataagaaatccggcattacagaagtggaccggaccgaggctaaggaggggctcaaaagaggagaaatcacgcatcacgccgtgtctcggggcagcgcgaaacttcagtggtttgttgagcgcaacatggtcattcccgaagggagagtgatcgatctgggatgtggccggggcgggtggtcctactattgcgccggactgaagaaagtgaccgaggtccgcggctacacaaaagggggacctggccacgaggaacccgttcctatgtctacctatgggtggaatatcgtgaaactcatgagcggaaaggacgtgttctacctgcccccggagaaatgtgatacacttctgtgcgacattggcgaatccagcccttctcccaccgtcgaggaatccagaacaatccgggtgctcaagatggttgagccctggctgaagaacaatcagttctgtattaaagtgctgaacccttacatgcccaccgtcatcgagcatctcgaacgccttcaaagaaagcacggcgggatgctggtgcggaatcctctgagccgcaactctacgcatgagatgtattggatttccaatggaacaggcaacatcgttgctagcgtgaatatggtctctagactcctgcttaaccggtttaccatgacccacagacgcccgacaatcgaaaaagatgtggacctgggggccggaacgcggcacgtgaacgctgagcccgaaacccctaatatggacgtcattggcgagagaatcaagcgcattaaagaggaacataacagcacatggcactacgatgacgagaatccctataagacctgggcctaccatgggtcctatgaagttaaggctacaggatctgccagctccatgatcaacggcgtggtgaaactcctgaccaagccttgggatgtcgtgcccatggttacacagatggcgatgaccgacacgaccccgttcggccagcaacgggtgtttaaagagaaggtcgatacaagaacccctcgcagcatgcccgggacacggagagtgatgggaattaccgccgaatggctgtggcgcacgctcggccggaataaaaagcctagactgtgcacacgcgaggagttcaccaagaaagttcggacaaacgctgccatgggggctgtgtttaccgaagagaatcagtgggactccgccaaggccgcggtcgaagatgaggacttctggaaacttgtggatagagaacgcgagctgcacaagctcggaaaatgtggctcttgcgtttacaacatgatggggaagagagagaaaaagctgggcgaatttggaaaggctaaaggcagccgggccatctggtatatgtggcttggggcccgctacctggagttcgaagctctcggatttctgaatgaggaccattggttctccagagagaactcttacagcggcgtggaaggggagggactgcacaagctcggctatatcctgcgggatatttccaaaatccccgggggcgccatgtacgctgacgacacggccggatgggataccagaattacagaagacgatcttcacaatgaggaaaagatcacccagcagatggaccctgagcatcggcaactggcgaacgccatttttaaactcacatatcagaataaggtcgtgaaggtccagcgccccaccccgacaggcaccgtgatggatatcatctctagaaaagaccagcgggggagcggacaagttggcacgtacgggctgaacacattcaccaatatggaggctcagcttattcgccagatggaaggagagggcgtgctgtccaaggccgatctcgaaaaccctcatctgcccgagaaaaagatcacccagtggctggaaacaaaaggggtcgagagactcaagcggatggctattagcggcgacgattgcgtggtgaagcccatcgacgatcgctttgccaacgcgctgcttgccctgaatgacatgggaaaagttagaaaggatattcctcaatggcagccgtctaaaggctggcatgactggcaacaggtgcccttctgttcccaccacttccatgagctcatcatgaaggacgggcggaaactggtcgtgccttgccgcccccaagatgaacttattggacgggctcggatcagccagggcgccgggtggtctctgaaggagaccgcttgtctcggaaaggcctatgctcagatgtggtccctgatgtactttcaccgcagagacctgcggctcgccagcaacgcgatctgctctgccgttcctgtgcattgggtccccacatcccgcacgacctggagcattcacgctcatcaccaatggatgacaaccgaagatatgctgacagtgtggaatagagtctggatcgaggacaacccttggatggaagataaaacccccgtgacgacctgggagaatgttccgtatcttggcaagcgggaggaccagtggtgtgggtccctgattggcctcacaagcagagccacctgggcccagaacatccctacagctattcagcaagtgcgctctctgatcggaaatgaagagttccttgattacatgcccagcatgaaacggtttagaaaggaagaggagtccgaaggcgccatctggtga

SEQ ID NO: 20588 - RNA, 9873 nt, synthetic construct
  misc_feature 1..9873: note = derived and/or modified CDS sequence (opt5) from DENV-3__JN093513__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacacctcagcccatggagctgaagtattcttggaaaacctgggggaaggccaagatcgtgacagccgaaacccaaaactccagcttcattatcgatggacctaatacacccgagtgcccgtctgtctccagagcttggaacgtgtgggaagtggaggactacggctttggcgtcttcaccacgaatatctggctcaaactgcgcgaagtttatacacagctgtgtgaccaccggcttatgagcgcggccgtgaaggatgagagagctgtgcatgccgacatggggtactggattgagtcccagaaaaacggatcttggaagctcgaaaaagccagcctgatcgaggtcaagacctgcacctggcctaagtcccacacactgtggtctaatggcgtgctcgaaagcgatatgattatccccaaatccctggctgggcctattagccagcataaccaccgccccggataccacacccaaacggccggcccttggcatcttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcatatgatcgccggcgttttctttaccttcgtgcttctgctcagcgggcagattacatggcgcgatatggcccacaccctgatcatgattggatccaatacgagcgacagaatgggcatgggggtcacatacctggctcttatcgccacctttaaaatccagcccttcctggcgctcggatttttcctgcggaagctcacatctagagaaaacctgcttctgggcgtggggctcgctatggccaccaccctgcaactgcctgaggatattgaacagatggccaatggaatcgctcttggcctgatggccctcaaactgattacacagtttgagatctatcagctctggacggctctgatttcccttacctgtagcaacacaatcttcaccctgacagtggcctggcgcaccgcgacgctcatcctggccggcgtctccctgcttccggtttgccaatctagctccatgcggaagacagactggctgcccatggctgtggccgctatgggggtgcctcccctccctctgtttattttcggactcaaggataccctgaaaagacgctcttggccccttaatgagggcgtcatggccgtggggctggttagcatcctggcctcctctctcctgagaaacgacgtgcctatggctggaccccttgtcgcgggcgggctgctcattgcctgttacgtgatcaccggaacaagcgctgatctgaccgttgaaaaggccgccgacattacatgggaggaagaggctgaacagacgggcgtgtcccataacctcatgatcaccgtcgacgatgacggcacaatgcggatcaaagatgacgagaccgagaatattctgacagtgcttctgaagaccgccctgctcatcgtcagcgggatttttccgtattctatccctgcgacgctgcttgtgtggcacacctggcagaaacagacacaacgctccggagttctgtgggatgtgcccagccctcccgaaacccagaaggctgagctcgaagagggcgtctacagaattaaacagcaggggatcttcggaaagacacaagtgggcgttggggtgcagaaggagggagtctttcacaccatgtggcatgtgacacggggcgccgtgctgacgtacaacggcaaacgcctcgaaccgaattgggcctctgttaagaaagacctgatttcctatgggggaggctggagacttagcgctcagtggcaaaagggggaggaagtccaggtgatcgccgtggagcctggcaagaaccccaagaatttccagaccatgcctggcacattccagaccaccacaggggaaatcggagcgattgctctggattttaagcccggcacgtctggctcccccatcattaaccgggaggggaaagtcgtgggactgtacggcaatggggttgtgaccaagaacggaggctatgtcagcgggatcgcccaaacaaatgccgagcctgacggcccgacccccgaactcgaggaagagatgttcaaaaagcgcaacctgacaattatggatcttcaccctggatccggcaaaaccagaaagtacctgcccgctatcgtgcgggaagccatcaagcgcagactccggacgctgattctcgctcctacaagagttgtggccgcggagatggaggaagccctgaaagggcttcccatccgctatcagaccaccgctacaaagagcgagcataccggacgggaaattgtcgacctgatgtgccacgccacatttaccatgagactgctctctcctgtgcgcgttccgaattacaacctgatcattatggatgaggctcatttcacggaccccgccagcatcgccgctcggggctatatctccacaagagtggggatgggagaagcggccgctatttttatgaccgccacacctcccggcaccgccgatgctttccctcagtctaatgcccccatccaggacgaggagcgcgacattccggaacggagctggaactccgggaatgagtggatcacggattttgcgggcaaaaccgtctggttcgtgccttctattaaggctggaaacgacatcgccaactgtcttcgcaaaaatggcaagaaggtgattcaactgagcagaaaaacatttgataccgaataccagaagacaaaactcaacgactgggatttcgtcgttaccacagacatctccgagatgggggccaattttaaggctgatcgggtgatcgaccccagacggtgcctgaaacccgtgattctgaccgatggacctgagcgcgtcatcctcgccggccccatgcctgtgacggcggcctctgctgcccagagacgggggcgcgttggaagaaacccgcagaaggaaaatgaccaatacattttcacaggccagccccttaacaatgatgaggaccacgctcactggaccgaagccaagatgctgctggacaacatcaatacccctgaggggattatccccgctctcttcgaacctgagcgggagaaaagcgccgcgatcgatggcgaatatagactgaagggagagtcccgcaaaacatttgtggaacttatgcggagaggcgacctgcccgtctggctcgcccataaggtggctagcgaggggattaaatacaccgatcgcaagtggtgcttcgacggacagcggaacaatcagatcctggaagagaacatggatgttgagatttggacaaaagaaggcgagaagaagaaactgagaccgcgctggctcgacgcccggacgtattctgatcctcttgctctgaaggaatttaaagagttcgccgccgggagaaagtccatcgctctggacctcgtgaccgaaattggacgcgtccccagccacctggcgcatagaacacggaatgcccttgataacctggtgatgctccacacctctgagcacggcggccgcgcttacagacatgccgtcgaggaactgcctgagacaatggaaaccctgctccttctggggctgatgatcctcctgacgggaggcgccatgctttttctgatctccgggaaaggaattggcaagaccagcatcgggctcatttgtgtgatcgcttcctctggaatgctgtggatggccgagattcccctgcaatggatcgcgagcgccattgttctcgagttctttatgatggtgcttctgatccctgaacccgagaagcagcggacaccgcaggacaatcaactggcttatgtggtcatcggcattctcaccctggccgctatcattgccgcgaacgaaatgggccttctggagacaaccaaacgcgatctcgggatgtccaaggaacctggagttgtgagccccacgtcttacctggacgtggatctgcaccccgcctccgcttggacactctatgccgtcgctaccacagtgatcacccctatgcttagacataccattgagaatagcacagccaacgtttctctggctgccatcgcgaaccaggccgtggtcctgatgggcctcgacaaagggtggccgatcagcaagatggacctgggagtgccccttctggctctcggctgctactcccaggtcaatcctctgacgctgaccgccgctgtgctccttctgattacacactacgccatcattgggcccggactgcaggccaaagcgacccgggaggctcaaaagagaacagccgctggcatcatgaagaaccctaccgttgatggcattatgacgatcgacctcgatcccgtgatctatgactctaaattcgaaaagcagctggggcaggtcatgcttctggtgctctgtgccgttcagctgctgctcatgcgcacaagctgggccctttgcgaggctctgaccctggccaccggacctattacaaccctctgggaaggctccccggggaaattttggaatacaacgatcgcggtgtctatggccaacattttccggggaagctacctggctggcgccgggcttgctttttccatcatgaaaagcgtcggaaccggcaaaagaggcacagggtctcaaggagagaccctgggcgaaaagtggaagaaaaagctcaatcagctgtcccgcaaagatttcgacctgtataagaaaagcgggattacagaggtggatcggaccgaggccaaggaaggactcaaaagaggcgagatcacgcatcacgcggtgtcccgggggtctgccaaacttcagtggtttgttgaacgcaacatggtcattcccgagggaagagtgatcgacctgggctgtggcagagggggatggagctactattgcgctggcctgaagaaagtgaccgaagtccgcgggtacacaaagggaggccctgggcacgaggagcccgttcctatgtccacctatggatggaatatcgtgaaactcatgtctggcaaggatgtgttctacctgcccccggaaaaatgtgacacacttctgtgcgatattggcgagagctcccctagccccaccgtcgaagagtctagaacaatccgggtgctcaagatggttgagccctggctgaagaacaatcagttctgtattaaagtgctgaacccttacatgcccaccgtcatcgaacatctcgagcgccttcaaagaaagcacgggggaatgctggtgcggaatcctctgtcccgcaacagcacgcatgaaatgtattggatttctaatggcacagggaacatcgttgcctccgtgaatatggtcagcagactcctgcttaaccggtttaccatgacccacagacgcccgacaatcgagaaagacgtggatctgggagctggcacgcggcacgtgaacgccgaacccgagacccctaatatggacgtcattggggagagaatcaagcgcattaaagaagaacacaactctacatggcactacgacgatgaaaatccctataagacctgggcttaccatggaagctatgaggttaaggccacaggctccgcgtctagcatgatcaacggcgtggtgaaactcctgaccaagccttgggacgtcgtgcccatggttacacagatggccatgaccgatacgaccccgttcgggcagcaacgggtgtttaaagaaaaggtcgacacaagaacccctcgctccatgcccggaacacggagagtgatgggcattaccgctgagtggctgtggcgcacgctcgggcggaataaaaagcctagactgtgcacacgcgaggagttcaccaagaaagttcggacaaacgccgctatgggagccgtgtttaccgaggaaaatcagtgggatagcgccaaggcggctgtcgaggacgaagatttctggaaacttgtggacagagagcgcgagctgcacaagctcggcaaatgtgggtcctgcgtttacaacatgatgggcaagagagagaagaagctgggagagtttggcaaggccaaagggtctcgggccatctggtatatgtggcttggagctcgctacctggagttcgaggccctcggctttctgaatgaggatcattggttcagcagagaaaactcctactctggggtggagggagaaggcctgcacaagctcgggtatatcctgcgggacattagcaaaatccccggcggagctatgtacgccgatgacacggcgggctgggacaccagaattacagaggatgaccttcacaatgaagagaagatcacccagcagatggatcctgagcatcggcaactggccaacgctatttttaaactcacatatcagaataaggtcgtgaaggtccagcgccccaccccgacagggaccgtgatggacatcatctccagaaaagatcagcggggatctggccaagttgggacgtacggactgaacacattcaccaatatggaagcccagcttattcgccagatggagggcgaaggggtgctgagcaaggctgacctcgagaaccctcatctgcccgagaaaaagatcacccagtggctggagacaaaaggcgtcgagagactcaagcggatggccatttccggagatgactgcgtggtgaagcccatcgatgaccgctttgcgaacgccctgcttgctctgaatgatatgggcaaagttagaaaggacattcctcaatggcagccgagcaaagggtggcatgattggcaacaggtgcccttctgttctcaccacttccatgaactcatcatgaaggacggacggaaactggtcgtgccttgccgcccccaagacgagcttattggcagagcccggatctcccagggggctggatggagcctgaaggaaaccgcctgtctcggcaaggcttatgcccagatgtggtctctgatgtactttcaccgcagagatctgcggctcgcgtccaacgccatctgcagcgctgttcctgtgcattgggtccccacatctcgcacgacctggtccattcacgcccatcaccaatggatgacaaccgaggacatgctgacagtgtggaatagagtctggatcgaagataacccttggatggaggacaaaacccccgtgacgacctgggagaatgttccgtatcttgggaagcgggaagatcagtggtgtggcagcctgattggactcacatccagagccacctgggctcagaacatccctacagccattcagcaagtgcgcagcctgatcggcaatgaggagttccttgactacatgccctctatgaaacggtttagaaaggaggaggaaagcgagggggcgatctggtga

SEQ ID NO: 20589 - RNA, 9873 nt, synthetic construct
  misc_feature 1..9873: note = derived and/or modified CDS sequence (opt5) from DENV-3__JF937624__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccatcaccggggaaatcggagctattgccctggattttaagcccggcacatctggctcccccatcattaaccgggaggggaaagtcgtgggactgtatggcaatggggttgtgacgaagaacggaggctacgtcagcgggatcgcccaaaccaatgctgagcctgacggcccgacacccgaactcgaggaagagatgttcaaaaagcgcaacctgaccattatggatcttcatcctggatccggcaaaacaagaaagtatctgcccgccatcgtgcgggaagctatcaagcgcagactccggaccctgattctcgcccctacgagagttgtggcggccgagatggaggaagctctgaaagggcttcccatccgctaccagacaaccgccaccaagagcgagcacacaggacgggaaattgtcgacctgatgtgccatgctacctttacaatgagactgctctctcctgtgcgcgttccgaattataacctgatcattatggatgaggcccacttcaccgaccccgccagcatcgctgcgcggggctacatctccacgagagtggggatgggagaagccgctgccatttttatgacagccacccctcccggcacagctgatgccttccctcagtctaatgcgcccatccaggacgaggagcgcgacattccggaacggagctggaactccgggaatgagtggatcaccgattttgctggcaaaacggtctggttcgtgccttctattaaggccggaaacgacatcgccaactgtcttcgcaaaaatggcaagaaggtgattcaactgagcagaaaaacctttgatacagaataccagaagaccaaactcaacgactgggatttcgtcgttacaaccgacatctccgagatgggggctaattttaaggccgatcgggtgatcgaccccagacggtgcctgaaacccgtgattctgacagatggacctgagcgcgtcatcctcgcgggccccatgcctgtgaccgccgcttctgccgctcagagacgggggcgcgttggaagaaacccgcagaaggaaaatgaccaatatattttcacgggccagccccttaacaatgatgaggaccatgcccactggacagaagctaagatgctgctggacaacatcaatacccctgaggggattatccccgccctcttcgaacctgagcgggagaaaagcgcggccatcgatggcgaatacagactgaagggagagtcccgcaaaacctttgtggaacttatgcggagaggcgacctgcccgtctggctcgctcacaaggtggccagcgaggggattaaatatacagatcgcaagtggtgcttcgacggacagcggaacaatcagatcctggaagagaacatggatgttgagatttggaccaaagaaggcgagaagaagaaactgagaccgcgctggctcgacgctcggacatactctgatcctcttgccctgaaggaatttaaagagttcgccgctgggagaaagtccatcgcgctggacctcgtgacggaaattggacgcgtccccagccatctggcccacagaacccggaatgctcttgataacctggtgatgctccatacatctgagcacggcggccgcgcctatagacacgccgtcgaggaactgcctgagaccatggaaacactgctccttctggggctgatgatcctcctgaccggaggcgctatgctttttctgatctccgggaaaggaattggcaagacgagcatcgggctcatttgtgtgatcgcctcctctggaatgctgtggatggcggagattcccctgcaatggatcgccagcgctattgttctcgagttctttatgatggtgcttctgatccctgaacccgagaagcagcggaccccgcaggacaatcaactggcctacgtggtcatcggcattctcacactggctgccatcattgcggccaacgaaatgggccttctggagaccacaaaacgcgatctcgggatgtccaaggaacctggagttgtgagccccacctcttatctggacgtggatctgcatcccgcttccgcctggacgctctacgctgtcgccacaaccgtgatcacacctatgcttagacacaccattgagaatagcaccgctaacgtttctctggccgcgatcgccaaccaggctgtggtcctgatgggcctcgacaaagggtggccgatcagcaagatggacctgggagtgccccttctggccctcggctgctactcccaggtcaatcctctgacactgacggctgccgtgctccttctgattacccattatgccatcattgggcccggactgcaggcgaaagctacacgggaggcccaaaagagaaccgctgccggcatcatgaagaaccctacagttgatggcattatgaccatcgacctcgatcccgtgatctacgactctaaattcgaaaagcagctggggcaggtcatgcttctggtgctctgtgccgttcagctgctgctcatgcgcacgagctgggctctttgcgaggccctgacactggcgaccggacctattaccacactctgggaaggctccccggggaaattttggaataccacaatcgccgtgtctatggctaacattttccggggaagctatctggccggcgctgggcttgccttttccatcatgaaaagcgtcggaacgggcaaaagaggcaccgggtctcaaggagagacactgggcgaaaagtggaagaaaaagctcaatcagctgtcccgcaaagatttcgacctgtacaagaaaagcgggattaccgaggtggatcggacagaggcgaaggaaggactcaaaagaggcgagatcacccaccatgccgtgtcccgggggtctgctaaacttcagtggtttgttgaacgcaacatggtcattcccgagggaagagtgatcgacctgggctgtggcagagggggatggagctattactgcgccggcctgaagaaagtgacggaagtccgcgggtataccaagggaggccctgggcacgaggagcccgttcctatgtccacatacggatggaatatcgtgaaactcatgtctggcaaggatgtgttctacctgcccccggaaaaatgtgacacccttctgtgcgatattggcgagagctcccctagccccacagtcgaagagtctagaaccatccgggtgctcaagatggttgagccctggctgaagaacaatcagttctgtattaaagtgctgaacccttatatgcccacagtcatcgaacacctcgagcgccttcaaagaaagcatgggggaatgctggtgcggaatcctctgtcccgcaacagcacccacgaaatgtactggatttctaatggcacggggaacatcgttgcttccgtgaatatggtcagcagactcctgcttaaccggtttacaatgacccatagacgcccgaccatcgagaaagacgtggatctgggagccggcacacggcacgtgaacgctgaacccgagacgcctaatatggacgtcattggggagagaatcaagcgcattaaagaagaacacaactctacctggcattatgacgatgaaaatccctacaagacatgggcctatcacggaagctacgaggttaaggcgaccggctccgcctctagcatgatcaacggcgtggtgaaactcctgacaaagccttgggacgtcgtgcccatggttacccagatggctatgacagataccacgccgttcgggcagcaacgggtgtttaaagaaaaggtcgacaccagaacacctcgctccatgcccggaacccggagaattatgggcatcacagccgagtggctgtggcgcaccctcgggcggaataaaaagcctagactgtgcacgcgcgaggagttcacaaagaaagtgcggaccaacgctgccatgggagccgtttttacagaggaaaatcagtgggatagcgcgaaggctgccgtggaggacgaagatttctggaaacttgtcgacagagagcgcgagctgcataagctcggcaaatgtgggtcctgcgtgtataacatgatgggcaagagagagaagaagctgggagagtttggcaaggccaaagggtctcgggctatctggtacatgtggcttggagcccgctacctggagttcgaggctctcggctttctgaatgaggatcactggttcagcagagaaaactcctattctggggttgagggagaaggcctgcataagctcgggtacattctgcgggacatcagcaaaattcccggcggagccatgtatgcggatgacaccgccggctgggacacgagaatcaccgaggatgaccttcacaatgaagagaagattacacagcagatggatcctgagcaccggcaactggctaacgccatctttaaactcacctaccagaataaggtggtcaaggtgcagcgccccacaccgaccgggacagtcatggacatcatttccagaaaagatcagcggggatctggccaagtggggacctatggactgaacacgttcacaaatatggaagctcagcttatccgccagatggagggcgaaggggttctgagcaaggccgacctcgagaaccctcatctgcccgagaaaaagattacccagtggctggagaccaaaggcgtggagagactcaagcggatggcgatctccggagatgactgcgtcgtgaagcccattgatgaccgctttgccaacgctctgcttgccctgaatgatatgggcaaagtgagaaaggacatccctcaatggcagccgagcaaagggtggcacgattggcagcaggttcccttctgttctcatcacttccacgaactcattatgaaggacggacggaaactggtggtcccttgccgcccccaagacgagcttatcggcagagctcggatctcccagggggccggatggagcctgaaggaaacagcttgtctcggcaaggcctacgcgcagatgtggtctctgatgtattttcatcgcagagatctgcggctcgcctccaacgctatttgcagcgccgtgcctgttcactgggtgcccacctctcgcacaacgtggtccatccatgcccaccatcaatggatgaccacagaggacatgctgaccgtctggaatagagtgtggattgaagataacccttggatggaggacaaaacacccgtcaccacgtgggagaatgtgccgtaccttgggaagcgggaagatcagtggtgtggcagcctgatcggactcacctccagagctacatgggcccagaacattcctaccgcgatccagcaagttcgcagcctgatcggcaatgaggagttccttgactacatgccctctatgaaacggtttagaaaggaggaggaaagcgagggggctatttggtga

SEQ ID NO: 20590 - RNA, 9873 nt, synthetic construct
  misc_feature 1..9873: note = derived and/or modified CDS sequence (opt5) from DENV-3__JN000938__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggttattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccttctctgaaaaggaggagaatatggtgaaatccctggttagcgcgggaggcgggaaggtggacaactttacaatgggagtcctgtgcctcgctatcctgttcgaagaggtgatgcggggcaagttcggcaaaaagcacatgattgccggggtctttttcacctttgtgcttctgctctctggacagatcacatggcgcgatatggcccataccctgattatgatcggcagcaatgcttccgacagaatggggatgggagtcacgtatctggcccttattgcgacattcaaaatccagccctttctggctctcggcttctttctgcggaagctcaccagcagagaaaacctgcttctgggggtgggactcgccatggccacaaccctgcaactgcctgaggatatcgaacagatggctaatggcattgcccttggcctgatggctctcaaactgatcacccagttcgagacataccagctctggacggccctgatttctcttacctgttccaacacaatctttaccctgacagtggcgtggcgcaccgccacgctcattctggctggggtcagcctgcttccggtttgccaatcctctagcatgcggaagacagactggctgcccatggccgtggctgccatgggagtgcctcccctccctctgttcatctttggcctcaaggataccctgaaaagacgctcctggccccttaatgagggggtcatggccgtgggactggtttctatcctggctagctccctcctgagaaacgacgtgcctatggcgggcccccttgtcgccgggggactgctcattgcttgttatgtgatcaccggcacatctgccgatctgaccgttgaaaaggccgctgacattacatgggaggaagaggccgaacagacgggcgtgagccacaacctcatgatcaccgtcgacgatgacgggacaatgcggattaaagatgacgagaccgagaatatcctgacagtgcttctgaagaccgcgctgctcatcgtctccggaattttcccgtacagcatccctgctacgctgcttgtgtggcatacctggcagaaacagacacaacgctctggcgttctgtgggatgtgccctcccctcccgaaacccagaaggccgagctcgaagagggggtctacagaattaaacagcagggaatctttggcaagacacaagtgggggttggagtgcagaaggagggcgtcttccacaccatgtggcacgtgacacggggcgccgtgctgacgtataacgggaaacgcctcgaaccgaattgggctagcgttaagaaagacctgatttcttacggaggcgggtggagactttccgcccagtggcaaaagggagaggaagtccaggtgatcgcggtggagcctggcaaaaaccccaagaatttccagaccatgcctgggacatttcagaccaccacaggagaaattggcgctatcgccctggatttcaagcccggcacgagcgggtctcccatcattaaccgggagggaaaagtcgtgggcctgtatgggaatggagttgtgaccaagaacggcgggtacgtctccggcatcgcccaaacaaatgctgagcctgacggaccgacccccgaactcgaggaagagatgtttaaaaagcgcaacctgacaattatggatcttcatcctggcagcgggaaaaccagaaagtatctgcccgccatcgtgcgggaagctattaagcgcagactccggacgctgatcctcgcccctacaagagttgtggcggccgagatggaggaagctctgaaaggacttcccatccgctaccagaccaccgccacaaagtccgagcacaccggccgggaaattgtcgacctgatgtgccatgctacattcaccatgagactgctcagccctgtgcgcgttccgaattataacctgatcattatggatgaggcccactttacggaccccgcctctatcgctgcgcgggggtacattagcacaagagtgggaatgggcgaagccgctgccatcttcatgaccgccacacctcccgggaccgctgatgcctttcctcagtccaatgcgcccatccaggacgaggagcgcgacattccggaacggtcttggaacagcggcaatgagtggatcacggatttcgctggaaaaaccgtctggtttgtgccttccattaaggccggcaacgacatcgccaactgtcttcgcaaaaatgggaagaaggtgattcaactgtctagaaaaacattcgataccgaataccagaagacaaaactcaacgactgggattttgtcgttaccacagacatcagcgagatgggagctaatttcaaggccgatcgggtgattgaccccagacggtgcctgaaacccgtgatcctgaccgatggccctgagcgcgtcatcctcgcggggcccatgcctgtgacggccgcttccgccgctcagagacggggacgcgttggcagaaacccgcagaaggaaaatgaccaatatattttcacagggcagccccttaacaatgatgaggaccatgcccactggaccgaagctaagatgctgctggacaacatcaatacccctgagggcattatccccgccctctttgaacctgagcgggagaaatctgcggccattgatggagaatacagactgaagggcgagagccgcaaaacattcgtggaacttatgcggagaggggacctgcccgtctggctcgctcacaaggtggcctccgagggaatcaaatataccgatcgcaagtggtgctttgacggccagcggaacaatcagatcctggaagagaacatggatgttgagatttggacaaaagaaggggagaagaagaaactgagaccgcgctggctcgacgctcggacgtacagcgatcctcttgccctgaaggagttcaaagagtttgccgctggaagaaagtctatcgcgctggacctcgtgaccgaaattggccgcgtcccctcccatctggcccacagaacacggaatgctcttgataacctggtgatgctccataccagcgagcacggcgggcgcgcctatagacacgccgtcgaggaactgcctgagacaatggaaaccctgctccttctgggactgatgatcctcctgacgggcggggctatgcttttcctgatttctggaaaaggcatcgggaagacctccatcggactcatttgtgtgatcgccagctccggcatgctgtggatggcggagattcccctgcaatggatcgcctctgctattgttctcgagtttttcatgatggtgcttctgatccctgaacccgagaagcagcggacaccgcaggacaatcaactggcctacgtggtcattggcatcctcaccctggctgccatcattgcggccaacgaaatggggcttctggagacaaccaaacgcgatctcggaatgagcaaggaacctggcgttgtgtcccccacgagctatctggacgtggatctgcatcccgcttctgcctggacactctacgctgtcgccaccacagtgatcacccctatgcttagacacaccattgaaaattccacagctaacgttagcctggccgcgatcgccaaccaggctgtggtcctgatggggctcgacaaaggatggccgatttctaagatggacctgggcgtgccccttctggccctcgggtgctacagccaggtcaatcctctgacgctgaccgctgccgtgctccttctgatcacacattatgccatcattggacccggcctgcaggcgaaagctacccgggaggcccaaaagagaacagctgccggcatcatgaagaaccctaccgttgatgggattatgacgatcgacctcgatcccgtgatttacgactccaaatttgaaaagcagctgggacaggtcatgcttctggtgctctgtgccgttcagctgctgctcatgcgcacatcttgggctctttgcgaggccctgaccctggcgaccggccctatcacaaccctctgggaagggagcccgggaaaattctggaatacaacgatcgccgtgtccatggctaacatttttcggggctcttatctggccggggctggacttgccttcagcatcatgaagtccgtcggcaccggcaaaagagggacaggaagccaaggcgagaccctgggggaaaagtggaagaaaaagctcaatcagctgtctcgcaaagattttgacctgtacaagaaatccggaattacagaggtggatcggaccgaggcgaaggaaggcctcaaaagaggggagatcacgcaccatgccgtgagccggggatccgctaaacttcagtggttcgttgaacgcaacatggtcattcccgagggcagagtgatcgacctgggctgtgggcggggaggctggtcttattactgcgccgggctgaagaaagtgaccgaagtccgcggatatacaaagggcgggcctggacacgaggagcccgttcctatgagcacctacggctggaatattgtgaaactcatgtccggcaaggatgtgttctacctgcccccggaaaaatgtgacacacttctgtgcgatatcggggagtctagcccttcccccaccgtcgaagagagcagaacaatccgggtgctcaagatggttgagccctggctgaagaacaatcagttttgtattaaagtgctgaacccttatatgcccaccgtcatcgaacacctcgagcgccttcaaagaaagcatggaggcatgctggtgcggaatcctctgtctcgcaactccacgcacgaaatgtactggattagcaatgggacaggaaacatcgttgcttctgtgaatatggtctccagactcctgcttaaccggttcaccatgacccatagacgcccgacaattgagaaagacgtggatctgggcgccgggacgcggcacgtgaacgctgaacccgagacccctaatatggacgtcatcggagagagaatcaagcgcattaaagaagaacacaacagcacatggcattatgacgatgaaaatccctacaagacctgggcctatcacggctcttacgaggttaaggcgacaggcagcgcctcctctatgatcaacggggtggtgaaactcctgaccaagccttgggacgtcgtgcccatggttacacagatggctatgaccgatacgaccccgtttggacagcaacgggtgttcaaagaaaaggtcgacacaagaacccctcgcagcatgcccggcacacggagagtgatggggattaccgccgagtggctgtggcgcacgctcggacggaataaaaagcctagactgtgcacacgcgaggaatttaccaagaaagttcggacaaacgctgccatgggcgccgtgttcaccgaggaaaatcagtgggattccgcgaaggctgccgtcgaggacgaagatttttggaaacttgtggacagagagcgcgagctgcataagctcgggaaatgtggcagctgcgtttataacatgatgggaaagagagagaagaagctgggcgagttcgggaaggccaaaggatcccgggctatctggtacatgtggcttggcgcccgctacctggaatttgaggctctcgggttcctgaatgaggatcactggttttctagagaaaacagctattccggagtggagggcgaagggctgcataagctcggctacattctgcgggacatctctaaaatccccggaggcgccatgtatgcggatgacacggccgggtgggacaccagaattacagaggatgaccttcacaatgaagagaagatcacccagcagatggatcctgagcaccggcaactggctaacgccattttcaaactcacataccagaataaggtcgtgaaggtccagcgccccaccccgacaggaaccgtgatggacatcattagcagaaaagatcagcggggctccgggcaagttggaacgtatggcctgaacacatttaccaatatggaagctcagcttatccgccagatggagggggaaggcgtgctgtctaaggccgacctcgagaaccctcatctgcccgagaaaaagatcacccagtggctggagacaaaaggagtcgagagactcaagcggatggcgattagcggcgatgactgcgtggtgaagcccatcgatgaccgcttcgccaacgctctgcttgccctgaatgatatggggaaagttagaaaggacattcctcaatggcagccgtccaaaggatggcacgattggcaacaggtgcccttctgtagccatcactttcacgaactcatcatgaaggacggccggaaactggtcgtgccttgccgcccccaagacgagcttattgggagagctcggatctctcagggagccggctggtccctgaaggaaaccgcttgtctcgggaaggcctacgcgcagatgtggagcctgatgtatttccatcgcagagatctgcggctcgcctctaacgctatttgctccgccgttcctgtgcactgggtccccacaagccgcacgacctggtctatccatgcccaccatcaatggatgacaaccgaggacatgctgacagtgtggaatagagtctggatcgaagataacccttggatggaggacaaaacccccgtgacgacctgggagaatgttccgtaccttggcaagcgggaagatcagtggtgtggatccctgattggcctcacaagcagagctacctgggcccagaacatccctacagcgattcagcaagtgcgctccctgatcgggaatgaggaatttcttgactacatgcccagcatgaaacggttcagaaaggaggaggaatctgagggagctatttggtga

SEQ ID NO: 20591 - RNA, 9873 nt, synthetic construct
  misc_feature 1..9873: note = derived and/or modified CDS sequence (opt5) from DENV-3__JN093515__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccagaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaacgggaggaacccgtcaacattgaggctgaacctccgttcggcgagtccaatatcgtgattgggatcggcgataacgccctgaagatcaattggtacaaaaagggatctagcattggcaagatgtttgaagccacagctagaggggcccgccggatggctatccttggagacaccgcctgggatttcggctccgtggggggagttctcaacagcctgggcaaaatggtccatcagatttttgggtctgcgtataccgccctgttctccggcgtgagctgggtgatgaagatcggaattggcgtcctcctgacatggatcgggcttaattctaaaaacaccagcatgtccttttcttgcattgctatcggaatcattacactgtacctcggcgccgtggttcaggctgacatggggtgtgtgatcaattggaagggaaaagagctgaagtgcggcagcgggattttcgtcacgaacgaggtgcacacctggacagaacagtataagtttcaagccgattcccccaaaagactggcgaccgccatcgctggcgcctgggagaatggagtttgtggcattcgcagcacaacccggatggaaaaccttctctggaagcagatcgctaatgagctgaactacatcctgtgggaaaataacattaaactcacggtggtcgtgggggacatcattggagttctggagcagggcaagagaacccttacacctcagcccatggagctgaaatattcttggaagacctgggggaaagccaagatcgtgacagccgaaacccaaaactccagcttcattatcgatggacctaatacacccgagtgcccgtctgtctcccgcgcttggaacgtgtgggaagtggaggactacggctttggcgtcttcaccacgaatatctggctcaagctgcgggaagtttatacacagctgtgtgaccacagacttatgagcgcggccgtgaaagatgagcgcgctgtgcatgccgacatggggtactggattgagtcccagaagaacggatcttggaaactcgaaaaggccagcctgatcgaggtcaaaacctgcacctggcctaagtcccacacactgtggtctaatggcgtgctcgaaagcgatatgattatccccaagtccctggctgggcctattagccagcataaccaccggcccggataccacacccaaacggccggcccttggcatcttgggaaactggagctcgactttaattattgcgagggaacaaccgttgtgatcacagaaaactgtggcaccagaggcccctctctgcgcacaaccacggtctccgggaagctgatccacgagtggtgctgtcggagctgcacccttccgcctctcagatacatgggagaagatggctgttggtatgggatggagattcggcccatctctgaaaaagaggagaatatggtgaagtccctggttagcgcgggatctggcaaagtggacaacttcacaatgggggtcctgtgcctcgctattctgtttgaagaggtgatgcgcggaaagttcggcaagaaacatatgatcgccggcgttttctttaccttcgtgcttctgctcagcgggcagattacatggagagatatggcccacaccctgatcatgattggatccaatgctagcgaccggatgggcatgggggtcacgtacctggcccttatcgcgacatttaagatccagcccttcctggctctcggatttttcctgagaaaactcacctctcgcgaaaacctgcttctgggcgtggggctcgccatggccacaaccctgcaactgcctgaggatattgaacagatggctaatggaatcgcccttggcctgatggctctcaagctgattacccagtttgagatctatcagctctggacagccctgatttcccttacgtgtagcaacaccatcttcacactgaccgtggcgtggcggacagccaccctcatcctggctggcgtctccctgcttccgatgtgccaatctagctccatgagaaaaacggactggctgcccatggccgttgctgccatgggggtgcctcccctccctctgtttattttctctctcaaggatacactgaagcgcagaagctggccccttaatgagggagtgatggccgtcggcctggtgtccatcctggcttctagcctcctgcggaacgacgttcctatggcggggccccttgtggccggaggcctgctcattgcttgttacgtcatcaccgggacctccgccgatctgacagtggaaaaagccgctgacattacctgggaggaagaggccgaacagacaggagttagccataacctcatgatcacggtggacgatgacggcaccatgcgcatcaaggatgacgagacagagaatattctgaccgtccttctgaaaacagcgctgctcatcgtgtctggcatttttccgtattccatccctgctaccctgcttgtctggcacacgtggcagaagcagacccaaagaagcggggtgctgtgggatgttccctctcctcccgaaacacagaaagccgagctcgaagagggagtgtaccggattaagcagcagggcatcttcgggaaaacccaagtcggagtgggcgttcagaaggagggggtgtttcacacaatgtggcatgtcacccgcggagccgtgctgacatacaacggcaagagactcgaaccgaattgggcttccgtgaaaaaggacctgattagctatggcgggggatggcggctttctgcccagtggcaaaaaggcgaggaagttcaggtcatcgcggtggagcctgggaagaaccccaaaaatttccagacgatgcctggaaccttccagacaaccaccggcgaaatcggggctattgccctggattttaagcccggaacatccggcagccccatcattaaccgcgagggcaaggtggtcgggctgtacggaaatggcgtggttacgaaaaacgggggatatgtgtccggcatcgcccaaaccaatgctgagcctgacgggccgacacccgaactcgaggaagagatgttcaagaaaagaaacctgaccattatggatcttcaccctggcagcggaaagacacggaaatacctgcccgccatcgtccgcgaagctatcaagagacggctcagaaccctgattctcgcccctacgcgcgtggttgcggccgagatggaggaagctctgaagggccttcccatccggtatcagacaaccgccaccaaatctgagcatacagggagagaaattgtggacctgatgtgccacgctacctttacaatgcgcctgctcagccctgtccgggtgccgaattacaacctgatcattatggatgaggcccatttcaccgaccccgcctccatcgctgcgagaggatatatctctacgcgcgttggcatgggggaagccgctgccatttttatgacagccacccctcccggaacagctgatgccttccctcagagcaatgcgcccatccaggacgaggagcgggacattccggaaagatcctggaactctggcaatgagtggatcaccgattttgctgggaagacggtgtggttcgtccctagcattaaagccggcaacgacatcgccaactgtcttcgcaagaatggaaaaaaggtgattcaactgtcccggaagacctttgatacagaataccagaaaaccaagctcaacgactgggatttcgtggtcacaaccgacatctctgagatgggcgctaattttaaagccgatagagttatcgacccccggcgctgcctgaagcccgtgattctgacagatgggcctgagagagtgatcctcgcgggacccatgcctgtcaccgccgctagcgccgctcagcggcgcggcagagtggggcggaacccgcagaaagaaaatgaccaatacattttcacgggacagccccttaacaatgatgaggaccacgcccactggacagaagctaagatgctgctggacaacatcaatacccctgagggcattatccccgccctcttcgaacctgagagagagaagtccgcggccatcgatggggaatatcgcctgaaaggcgagagccggaagacctttgttgaacttatgagacgcggagacctgcccgtgtggctcgctcataaagtcgcctctgagggcattaagtacacagatcggaaatggtgcttcgacgggcagagaaacaatcagatcctggaagagaacatggatgtggagatttggaccaaggaaggagagaaaaagaagctgcgcccgcggtggctcgacgctagaacatattccgatcctcttgccctgaaagaatttaaggagttcgccgctggccgcaaaagcatcgcgctggacctcgttacggaaattgggagagtgccctctcacctggcccatcggacccgcaatgctcttgataacctggtcatgctccacacatccgagcacggaggcagagcctaccggcatgccgtggaggaactgcctgagaccatggaaacactgctccttctgggcctgatgatcctcctgaccgggggagctatgctttttctgatcagcggcaaggggattggaaaaacgtccatcggcctcatttgtgtcatcgcctctagcgggatgctgtggatggcggagattcccctgcaatggatcgcctccgctattgtgctcgagttctttatgatggttcttctgatccctgaacccgagaagcagcgcaccccgcaggacaatcaactggcctatgtggtgatcggaattctcacactggctgccatcattgcggccaacgaaatgggccttctggagaccacaaagagagatctcggcatgagcaaagaacctggggtcgtttctcccacctcctacctggacgtggatctgcaccccgctagcgcctggacgctctatgctgtggccacaaccgtcatcacacctatgcttcggcataccattgagaattctaccgctaacgtgagcctggccgcgatcgccaaccaggctgttgtgctgatgggactcgacaagggctggccgatctccaaaatggacctgggggtcccccttctggccctcggatgctactctcaggtgaatcctctgacactgacggctgccgtcctccttctgattacccactacgccatcattggccccgggctgcaggcgaaggctacaagagaggcccaaaaacgcaccgctgccggaatcatgaagaaccctacagtggatggcattatgaccatcgacctcgatcccgttatctatgacagcaagttcgaaaaacagctgggccaggtgatgcttctggtcctctgtgtggttcagctgctgctcatgcggacgtcctgggccctttgcgaggctctgacactggccaccgggcctattaccacactctgggaaggatctccgggcaagttttggaataccacaatcgcggtgagcatggccaacattttcagagggtcctacctggctggagccggccttgcttttagcatcatgaaatctgtcgggacgggaaagcgcggcaccggctcccaaggggagacactgggagaaaaatggaagaagaaactcaatcagctgagccggaaggatttcgacctgtataaaaagtccggcattaccgaggtggatagaacagaggccaaagaagggctcaagcggggagagatcacccatcacgcggtgtctcgcggcagcgccaaacttcagtggtttgttgaaagaaacatggtcattcccgaggggcgggtgatcgacctgggatgtggccgcggcgggtggtcctactattgcgctggactgaagaaggtgacggaagtcagaggctacaccaaagggggacctggccacgaggagcccgttcctatgtctacatatgggtggaatatcgtgaagctcatgagcggaaaagatgtgttctacctgcccccggaaaagtgtgacacccttctgtgcgatattggcgagtccagcccttctcccacagtcgaagagtcccggaccatccgcgtgctcaaaatggttgagccctggctgaagaacaatcagttctgtattaaggtgctgaacccttacatgcccacagtcatcgaacatctcgagagacttcaacggaaacacggcgggatgctggtgcgcaatcctctgagcagaaactctacccatgaaatgtattggatttccaatggaacgggcaacatcgttgccagcgtgaatatggtctctcggctcctgcttaacagatttacaatgacccaccgccggccgaccatcgagaaggacgtggatctgggggctggaacaagacacgtgaacgccgaacccgagacgcctaatatggacattatcggcgagcgcattaaacggatcaaggaagagcataacagcacctggcactacgacgatgaaaatccctataaaacatgggcttaccatgggtcctatgaggtcaaggccaccggatctgcgagctccatgattaacggcgttgtgaagctcctgacaaaaccttgggacgtggtccccatggtgacccagatggccatgacagataccacgccgttcggccagcaaagagtttttaaggaaaaagtggacacccgcacacctcggagcatgcccgggaccagacgcgtcatgggaatcacagctgagtggctgtggcggaccctcggcagaaataagaaacctcgcctgtgcacgcgggaggaattcacaaagaaggtgagaaccaacgccgctatgggggccgtttttacagaggaaaatcagtgggattccgccaaagcggctgtggaggacgaagatttctggaagcttgtcaaccgcgagagagagctgcacaaactcggaaagtgtggctcttgcgtgtacaatatgatggggaaacgggaaaagaaactgggcgagtttggaaaggccaagggcagccgcgccatctggtatatgtggcttggggctagatacctggaattcgaggccctcggatttctgaacgaggaccattggttctcccgggaaaattcttacagcggcgttgagggggaaggactgcacaaactcggctatattctgagagatatctccaagattcccgggggcgctatgtacgccgacgataccgcgggatgggacacgcggatcaccgaggacgatcttcacaacgaagagaaaattacacagcagatggaccctgagcatcgccaactggccaatgctatctttaagctcacctatcagaacaaagtggtcaaggtgcagagacccacaccgaccggcacagtcatggatatcatttctcggaaggaccagcgcgggagcggacaagtgggcacctacgggctgaatacgttcacaaacatggaagcccagcttatcagacagatggagggagaaggcgttctgtccaaagctgatctcgagaaccctcacctgcccgaaaagaaaattacccagtggctggagaccaagggggtggagcggctcaaacgcatggccatcagcggcgacgattgcgtcgtgaagcccattgacgatagatttgcgaatgccctgcttgctctgaacgacatgggaaaggtgcggaaagatatccctcaatggcagccgtctaagggctggcatgactggcagcaggttcccttctgttcccaccacttccatgaactcattatgaaagatgggcgcaagctggtggtcccttgcagaccccaagacgagcttatcggacgggcccgcatcagccagggcgctgggtggtctctgaaagaaacagcctgtctcggaaaggcttatgcccagatgtggtccctgatgtactttcacagacgggacctgcgcctcgcgagcaatgccatttgctctgctgtgcctgttcattgggtgcccacctccagaacaacgtggagcatccacgcccatcaccaatggatgaccacagaggatatgctgaccgtctggaaccgggtgtggattgaagacaatccttggatggaggataagacacccgtcaccacgtgggagaacgtgccgtatcttggcaaaagagaagaccagtggtgtgggtccctgatcggcctcaccagccgcgccacatgggctcagaatattcctaccgccatccagcaagttcggtctctgatcggaaacgaggaattccttgattacatgcccagcatgaagagatttcgcaaagaggaggaatccgagggcgcgatttggtga

SEQ ID NO: 20592 - RNA, 9873 nt, synthetic construct
  misc_feature 1..9873: note = derived and/or modified CDS sequence (opt5) from DENV-3__JF937646__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggaattggcaaccgggactttgtggaagggctcagcggagctacctgggtcgatgtggtgctggagcacggcgggtgcgtcaccacaatggccaagaataaacccacgctggacatcgagctccagaagaccgaagctacacaactggccacccttcgcaaactgtgtattgagggaaagatcacaaacattaccacggattccagatgccctacacagggcgaagcgaccctcccggaggaacaggaccagaattatgtttgtaaacacacctacgtggatcggggctgggggaacggatgcggcctgttcgggaagggaagccttgtgacatgcgccaagtttcaatgtctggagcccatcgagggcaaagtcgtgcagtatgaaaatctcaagtacaccgttatcattacagtgcatacgggggaccagcaccaggtcggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggttcatagacagtggtttttcgatctccccctgccgtggaccagcggcgccacaaccgaaacgcctacatggaatcggaaagagcttctggtgacctttaagaacgctcacgcgaaaaagcaagaagtcgtggtcctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacgcctttgtgctgaagaaagaggtttccgaaacccagcacgggacaatcctcattaaggtggagtacaagggagaagatgtcccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcggcggggtgctcaacagcctggggaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgccggcgcttgggagaatggagtgtgtggcatcagaagcaccacacgcatggaaaaccttctctggaaacagatcgccaatgagctgaactatattctgtgggaaaataacatcaagctcaccgttgtggtcggggacattatcggagtgctggagcagggcaaacggacgcttacccctcagcccatggagctgaagtactcttggaaaacatgggggaaggccaagattgttaccgctgaaacacaaaactccagcttcatcatcgatggacctaatacccccgagtgcccgtctgtgtccagagcgtggaacgtctgggaagtggaggactatggctttggcgtgttcacaaccaatatttggctcaaactgcgcgaagtctacacgcagctgtgtgaccaccggcttatgagcgccgctgttaaggatgagagagccgtgcacgccgacatggggtactggatcgagtcccagaaaaacggatcttggaagctcgaaaaagctagcctgattgaggtgaagacatgcacctggcctaagtcccataccctgtggtctaatggcgtcctcgaaagcgatatgatcattcccaaatccctggccgggcctatcagccagcacaaccatcgccccggatatcacacacaaaccgcgggcccttggcaccttgggaagctggagctcgactttaattactgcgagggaacgacagtggttatcaccgaaaactgtggcacacggggcccctctctgagaaccacaaccgtgtccgggaaactgattcatgagtggtgctgtcgcagctgcacgcttccgcctctccggtatatgggagaagatggctgttggtacgggatggagatcagacccatttctgaaaaggaggagaatatggtcaaatccctggtgagcgctggatctggcaaggttgacaacttcaccatgggggtgctgtgcctcgccatcctgtttgaagaggtcatgcggggaaagttcggcaaaaagcacatgattgccggcgtgttctttacattcgttcttctgctcagcgggcagatcacctggcgcgatatggctcatacactgattatgatcggatccaatgccagcgacagaatgggcatgggggtgacctatctggcgcttatcgctacgtttaaaattcagcccttcctggccctcggatttttcctgcggaagctcacatctagagaaaacctgcttctgggcgtcgggctcgccatggtgaccacactgcaactgcctgaggatatcgaacagatggctaatggaattgcccttggcctgatggctctcaaactgatcacccagtttgagacctaccagctctggacagccctgatttcccttacgtgtagcaacaccatcttcacactgaccgtggcgtggcgcacagccaccctcatcctggctggcgtctccctgcttccggtttgccaatctagctccatgcggaagacggactggctgcccatggccgtggctgccatgggggtgcctcccctccctctgtttattttcggactcaaggatacactgaaaagacgctcttggccccttaatgagggcgtcatggccgtggggctggttagcatcctggcttcctctctcctgagaaacgacgtgcctatggcgggaccccttgtcgccggcgggctgctcattgcttgttatgtgatcaccggaaccagcgccgatctgacagttgaaaaggccgctgacattacctgggaggaagaggccgaacagacaggcgtgtcccacaacctcatgatcacggtcgacgatgacggcaccatgcggatcaaagatgacgagacagagaatattctgaccgtgcttctgaagacagcgctgctcatcgtcagcgggatttttccgtactctatccctgctaccctgcttgtgtggcatacgtggcagaaacagacccaacgctccggagttctgtgggatgtgcccagccctcccgaaacacagaaggccgagctcgaagagggcgtctacagaattaaacagcaggggatcttcggaaagacccaagtgggcgttggggtgcagaaggagggagtctttcacacaatgtggcacgtgacccggggcgccgtgctgacatataacggcaaacgcctcgaaccgaattgggcttctgttaagaaagacctgatttcctacgggggaggctggagacttagcgcccagtggcaaaagggggaggaagtccaggtgatcgcggtggagcctggcaagaaccccaagaatttccagacgatgcctggcaccttccagacaaccaccggggaaatcggagctattgccctggattttaagcccggcacatctggctcccccatcattaaccgggaggggaaagtcgtgggactgtatggcaatggggttgtgacgaagaacggaggctacgtcagcgggatcgcccaaaccaatgctgagcctgacggcccgacacccgaactcgaggaagagatgttcaaaaagcgcaacctgaccattatggatcttcatcctggatccggcaaaacaagaaagtatctgcccgccatcgtgcgggaagctatcaagcgcagactccggaccctgattctcgcccctacgagagttgtggcggccgagatggaggaagctctgaaagggcttcccatccgctaccagacaaccgccaccaagagcgagcacacaggacgggaaattgtcgacctgatgtgccatgctacctttacaatgagactgctctctcctgtgcgcgttccgaattataacctgatcattatggatgaggcccacttcaccgaccccgccagcatcgctgcgcggggctacatctccacgagagtggggatgggagaagccgctgccatttttatgacagccacccctcccggcacagctgatgccttccctcagtctaatgcgcccatccaggacgaggagcgcgacattccggaacggagctggaactccgggaatgagtggatcaccgattttgctggcaaaacggtctggttcgtgccttctattaaggtgggaaacgacatcgccaactgtcttcgcaaaaatggcaagaaggtcattcaactgagcagaaaaacctttgatacagaataccagaagaccaaactcaacgactgggatttcgttgtgacaaccgacatctccgagatgggggccaattttaaggctgatcgggtgatcgaccccagacggtgcctgaaacccgtcattctgacagatggacctgagcgcgtgatcctcgccggccccatgcctgttaccgcggcctctgctgcccagagacgggggcgcgtgggaagaaacccgcagaaggaaaatgaccaatatattttcacgggccagccccttaacaatgatgaggaccatgctcactggacagaagccaagatgctgctggacaacatcaatacccctgaggggattatccccgctctcttcgaacctgagcgggagaaaagcgccgcgatcgatggcgaatacagactgaagggagagtcccgcaaaacctttgtcgaacttatgcggagaggcgacctgcccgtgtggctcgcccacaaggttgctagcgaggggattaaatatacagatcgcaagtggtgcttcgacggacagcggaacaatcagatcctggaagagaacatggatgtggagatttggaccaaagaaggcgagaagaagaaactgagaccgcgctggctcgacgcccggacatactctgatcctcttgctctgaaggaatttaaagagttcgccgccgggagaaagtccatcgctctggacctcgtcacggaaattggacgcgtgcccagccatctggcgcacagaacccggaatgcccttgataacctggtcatgctccatacatctgagcacggcggccgcgcttatagacacgccgtggaggaactgcctgagaccatggaaacactgctccttctggggctgatgatcctcctgaccggaggcgccatgctttttctgatctccgggaaaggaattggcaagacgagcatcgggctcatttgtgttatcgcttcctctggaatgctgtggatggccgagattcccctgcaatggatcgcgagcgccattgtgctcgagttctttatgatggtgcttctgatccctgaacccgagaagcagcggaccccgcaggacaatcaactggcttacgtcgttatcggcattctcacactggccgctatcattgccgcgaacgaaatgggccttctggagaccacaaaacgcgatctcgggatgtccaaggaacctggagtggtgagccccacctcttatctggacgtcgatctgcatcccgcctccgcttggacgctctacgccgtggctacaaccgttatcacacctatgcttagacacaccattgagaatagcaccgccaacgtgtctctggctgccatcgcgaaccaggccgtcgtgctgatgggcctcgacaaagggtggccgatcagcaagatggacctgggagtcccccttctggctctcggctgctactcccaggtgaatcctctgacactgacggccgctgttctccttctgattacccattatgccatcattgggcccggactgcaggccaaagcgacacgggaggctcaaaagagaaccgccgctggcatcatgaagaaccctacagtggatggcattatgaccatcgacctcgatcccgtcatctacgactctaaattcgaaaagcagctgggacaggtgatgcttctggttctctgtgccgtgcagctgctgctcatgcgcacgagctgggccctttgcgaggctctgacactggccaccggacctattaccacactctgggaaggctccccggggaaattttggaataccacaatcgcggtctctatggccaacattttccggggaagctatctggctggcgccgggcttgctttttccatcatgaaaagcgtgggaacgggcaaaagaggcaccgggtctcaaggagagacactgggcgaaaagtggaagaaaaagctcaatcagctgtcccgcaaagatttcgacctgtacaagaaaagcgggattaccgaggtggatcggacagaggccaaggaaggactcaaaagaggcgagatcacccaccatgcggtttcccgggggtctgccaaacttcagtggtttgtcgaacgcaacatggtgattcccgagggaagagtgatcgacctgggctgtggcagagggggatggagctattactgcgctggcctgaagaaagtcacggaagttcgcgggtataccaagggaggccctgggcacgaggagcccgtgcctatgtccacatacggatggaatatcgtgaaactcatgtctggcaaggatgtcttctacctgcccccggaaaaatgtgacacccttctgtgcgatattggcgagagctcccctagccccacagtggaagagtctagaaccatccgggttctcaagatggtggagccctggctgaagaacaatcagttctgtattaaagtcctgaacccttatatgcccacagtgatcgaacacctcgagcgccttcaaagaaagcatgggggaatgctggttcggaatcctctgtcccgcaacagcacccacgaaatgtactggatttctaatggcacggggaacatcgtggcctccgtcaatatggtgagcagactcctgcttaaccggtttacaatgacccatagacgcccgaccatcgagaaagacgtggatctgggagctggcacacggcacgtcaacgccgaacccgagacgcctaatatggacgttattggggagagaatcaagcgcattaaagaagaacacaactctacctggcattatgacgatgaaaatccctacaagacatgggcttatcacggaagctacgaggtgaaggccaccggctccgcgtctagcatgatcaacggcgtggtcaaactcctgacaaagccttgggacgtggttcccatggtgacccagatggccatgacagataccacgccgttcgggcagcaacgggtctttaaagaaaaggtggacaccagaacacctcgctccatgcccggaacccggagagttatgggcattacagctgagtggctgtggcgcaccctcgggcggaataaaaagcctagactgtgcacgcgcgaggagttcacaaagaaagtgcggaccaacgccgctatgggagccgtctttacagaggaaaatcagtgggatagcgccaaggcggctgtggaggacgaagatttctggaaacttgttgacagagagcgcgagctgcataagctcggcaaatgtgggtcctgcgtgtataacatgatgggcaagagagagaagaagctgggagagtttggcaaggccaaagggtctcgggccatctggtacatgtggcttggagctcgctacctggagttcgaggccctcggctttctgaatgaggatcactggttcagcagagaaaactcctattctggggtcgagggagaaggcctgcataagctcgggtacatcctgcgggacattagcaaaatccccggcggagctatgtatgccgatgacaccgcgggctgggacacgagaattaccgaggatgaccttcacaatgaagagaagatcacacagcagatggatcctgagcaccggcaactggccaacgctatttttaaactcacctaccagaataaggtggtcaaggtgcagcgccccacaccgaccgggacagttatggacatcatctccagaaaagatcagcggggatctggccaagtggggacctatggactgaacacgttcacaaatatggaagcccagcttattcgccagatggagggcgaaggggtcctgagcaaggctgacctcgagaaccctcatctgcccgagaaaaagatcacccagtggctggagaccaaaggcgtggagagactcaagcggatggccatttccggagatgactgcgtggttaagcccatcgatgaccgctttgcgaacgccctgcttgctctgaatgatatgggcaaagtgagaaaggacattcctcaatggcagccgagcaaagggtggcacgattggcagcaggtccccttctgttctcatcacttccacgaactcatcatgaaggacggacggaaactggtggttccttgccgcccccaagacgagcttattggcagagcccggatctcccagggggctggatggagcctgaaggaaacagcctgtctcggcaaggcttacgcccagatgtggtctctgatgtattttcatcgcagagatctgcggctcgcgtccaacgccatctgcagcgctgtgcctgtccactgggtgcccacctctcgcacaacgtggtccattcatgcccaccatcaatggatgaccacagaggacatgctgaccgtctggaatagagtgtggatcgaagataacccttggatggaggacaaaacacccgttaccacgtgggagaatgtgccgtaccttgggaagcgggaagatcagtggtgtggcagcctgattggactcacctccagagccacatgggctcagaacatccctaccgccattcagcaagtccgcagcctgatcggcaatgaggagttccttgactacatgccctctatgaaacggtttagaaaggaggaggaaagcgagggggcgatctggtga

SEQ ID NO: 20593 - RNA, 9873 nt, synthetic construct
  misc_feature 1..9873: note = derived and/or modified CDS sequence (opt5) from DENV-3__JF937633__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattaccctggacctcgtgacagaaatcggacgcgtccccagccatctggcgcacagaacccggaatgcccttgataacctggtgatgctccatacatctgagcacggcggccgcgcttatagacacgccgtcgaggaactgcctgagaccatggaaacgctgctccttctggggctgatgattctcctgaccggaggcgccatgctttttctgatctccgggaaaggaatcggcaagacaagcattgggctcatctgtgtgattgcttcctctggaatgctgtggatggccgagatccccctgcaatggattgcgagcgccatcgttctcgagttctttatgatggtgcttctgattcctgaacccgagaagcagcggaccccgcaggacaatcaactggcttacgtggtcatcggcatcctcacactggccgctattatcgccgcgaacgaaatgggccttctggagaccacgaaacgcgatctcgggatgtccaaggaacctggagttgtgagccccacatcttatctggacgtggatctgcatcccgcctccgcttggaccctctacgccgtcgctacaaccgtgattacccctatgcttagacacacaatcgagaatagcacggccaacgtttctctggctgccattgcgaaccaggccgtggtcctgatgggcctcgacaaagggtggccgatcagcaagatggacctgggagtgccccttctggctctcggctgctactcccaggtcaatcctctgaccctgacagccgctgtgctccttctgatcacccattatgccattatcgggcccggactgcaggccaaagcgacacgggaggctcaaaagagaaccgccgctggcattatgaagaaccctacggttgatggcatcatgacaattgacctcgatcccgtgatctacgactctaaattcgaaaagcagctggggcaggtcatgcttctggtgctctgtgccgttcagctgctgctcatgcgcaccagctgggccctttgcgaggctctgaccctggccacaggacctatcaccacactctgggaaggctccccggggaaattttggaatacgaccattgcggtgtctatggccaacatcttccggggaagctatctggctggcgccgggcttgctttttccattatgaaaagcgtcggaacaggcaaaagaggcaccgggtctcaaggagagacactgggcgaaaagtggaagaaaaagctcaatcagctgtcccgcaaagatttcgacctgtacaagaaaagcgggatcaccgaggtggatcggacggaggccaaggaaggactcaaaagaggcgagattacccaccatgcggtgtcccgggggtctgccaaacttcagtggtttgttgaacgcaacatggtcatccccgagggaagagtgattgacctgggctgtggcagagggggatggagctattactgcgctggcctgaagaaagtgacagaagtccgcgggtataccaagggaggccctgggcacgaggagcccgttcctatgtccacatacggatggaatatcgtgaaactcatgtctggcaaggatgtgttctacctgcccccggaaaaatgtgacacccttctgtgcgatatcggcgagagctcccctagccccacagtcgaagagtctagaaccattcgggtgctcaagatggttgagccctggctgaagaacaatcagttctgtatcaaagtgctgaacccttatatgcccacggtcattgaacacctcgagcgccttcaaagaaagcatgggggaatgctggtgcggaatcctctgtcccgcaacagcacacacgaaatgtactggatctctaatggcaccgggaacattgttgcctccgtgaatatggtcagcagactcctgcttaaccggtttaccatgacacatagacgcccgacgatcgagaaagacgtggatctgggagctggcacccggcacgtgaacgccgaacccgagacacctaatatggacgtcatcggggagagaattaagcgcatcaaagaagaacacaactctacctggcattatgacgatgaaaatccctacaagacatgggcttatcacggaagctacgaggttaaggccaccggctccgcgtctagcatgattaacggcgtggtgaaactcctgacaaagccttgggacgtcgtgcccatggttacccagatggccatgacggataccacaccgttcgggcagcaacgggtgtttaaagaaaaggtcgacaccagaacacctcgctccatgcccggaacccggagagtgatgggcatcacggctgagtggctgtggcgcacactcgggcggaataaaaagcctagactgtgcacccgcgaggagttcacaaagaaagttcggaccaacgccgctatgggagccgtgtttacggaggaaaatcagtgggatagcgccaaggcggctgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggccatttggtacatgtggcttggagctcgctacctggagttcgaggccctcggctttctgaatgaggatcactggttcagcagagaaaactcctattctggggtggagggagaaggcctgcataagctcgggtacatcctgcgggacatcagcaaaattcccggcggagctatgtatgccgatgacaccgcgggctgggacacaagaatcaccgaggatgaccttcacaatgaagagaagattacacagcagatggatcctgagcaccggcaactggccaacgctatctttaaactcacctaccagaataaggtcgtgaaggtccagcgccccacaccgaccgggacggtgatggacattatctccagaaaagatcagcggggatctggccaagttgggacatatggactgaacaccttcaccaatatggaagcccagcttatccgccagatggagggcgaaggggtgctgagcaaggctgacctcgagaaccctcatctgcccgagaaaaagattacacagtggctggagaccaaaggcgtcgagagactcaagcggatggccatctccggagatgactgcgtggtgaagcccattgatgaccgctttgcgaacgccctgcttgctctgaatgatatgggcaaagttagaaaggacatccctcaatggcagccgagcaaagggtggcacgattggcaacaggtgcccttctgttctcatcacttccacgaactcattatgaaggacggacggaaactggtcgtgccttgccgcccccaagacgagcttatcggcagagcccggatttcccagggggctggatggagcctgaaggaaacagcctgtctcggcaaggcttacgcccagatgtggtctctgatgtattttcatcgcagagatctgcggctcgcgtccaacgccatctgcagcgctgttcctgtgcactgggtccccacgtctcgcaccacatggtccatccatgcccaccatcaatggatgaccacagaggacatgctgaccgtgtggaatagagtctggattgaagataacccttggatggaggacaaaacgcccgtgaccacatgggagaatgttccgtaccttgggaagcgggaagatcagtggtgtggcagcctgatcggactcacctccagagccacatgggctcagaacattcctaccgccatccagcaagtgcgcagcctgattggcaatgaggagttccttgactacatgccctctatgaaacggtttagaaaggaggaggaaagcgagggggcgatctggtga

SEQ ID NO: 20594 - RNA, 9873 nt, synthetic construct
  misc_feature 1..9873: note = derived and/or modified CDS sequence (opt5) from DENV-3__JF937634__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtggggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcggcggggttctcaacagcctggggaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgtgaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagccgaaacccaaaactccagcttcattatcgatggacctaatacacccgagtgcccgtctgtgtccagagcctggaacgtgtgggaagtcgaggactatggctttggcgttttcaccacgaatatctggctcaaactgcgcgaagtgtacacacagctgtgtgaccaccggcttatgagcgctgcggtgaaggatgagagagccgtccacgctgacatggggtactggattgagtcccagaaaaacggatcttggaagctcgaaaaagccagcctgatcgaggtgaagacctgcacctggcctaagtcccatacactgtggtctaatggcgttctcgaaagcgatatgattatccccaaatccctggccgggcctattagccagcacaaccatcgccccggatatcacacccaaacggctggcccttggcaccttgggaagctggagctcgactttaattactgcgagggaacaaccgtggtcatcacagaaaactgtggcacccggggcccctctctgagaacaaccacggtgtccgggaaactgatccatgagtggtgctgtcgcagctgcacccttccgcctctccggtatatgggagaagatggctgttggtacgggatggagattagacccatctctgaaaaggaggagaatatggttaaatccctggtgagcgccggatctggcaaggtcgacaacttcacaatgggggtgctgtgcctcgcgattctgtttgaagaggttatgcggggaaagttcggcaaaaagcacatgatcgctggcgtgttctttaccttcgtccttctgctcagcgggcagattacatggcgcgatatggcccataccctgatcatgattggatccaatgccagcgacagaatgggcatgggggtgacgtatctggctcttatcgccacatttaaaatccagcccttcctggcgctcggatttttcctgcggaagctcacctctagagaaaacctgcttctgggcgtggggctcgctatggccacaaccctgcaactgcctgaggatattgaacagatggccaatggaatcgctcttggcctgatggccctcaaactgattacccagtttgagacataccagctctggacggctctgatctcccttacctgtagcaacacaattttcaccctgacagtcgcctggcgcaccgcgacgctcatcctggccggcgtttccctgcttccggtgtgccaatctagctccatgcggaagacagactggctgcccatggctgtggccgctatgggggtccctcccctccctctgtttatcttcggactcaaggataccctgaaaagacgctcttggccccttaatgagggcgtgatggccgttgggctggtgagcattctggcctcctctctcctgagaaacgacgtccctatggctggaccccttgtggcgggcgggctgctcatcgcctgttatgttattaccggaacaagcgctgatctgaccgtggaaaaggccgccgacatcacatgggaggaagaggctgaacagacgggcgtctcccacaacctcatgattaccgtggacgatgacggcacaatgcggatcaaagatgacgagaccgagaatatcctgacagtccttctgaagaccgccctgctcattgtgagcgggatctttccgtactctattcctgcgacgctgcttgtttggcatacctggcagaaacagacacaacgctccggagtgctgtgggatgtccccagccctcccgaaacccagaaggctgagctcgaagagggcgtgtacagaatcaaacagcaggggattttcggaaagacacaagttggcgtgggggtccagaaggagggagtgtttcacaccatgtggcacgtgacacggggcgccgttctgacgtataacggcaaacgcctcgaaccgaattgggcctctgtcaagaaagacctgatctcctacgggggaggctggagacttagcgctcagtggcaaaagggggaggaagtccaggtgattgccgtcgagcctggcaagaaccccaagaatttccagaccatgcctggcacattccagaccaccacaggggaaatcggagcgatcgctctggattttaagcccggcacgtctggctcccccattatcaaccgggaggggaaagtggttggactgtatggcaatggggtggtcaccaagaacggaggctacgtgagcgggattgcccaaacaaatgccgagcctgacggcccgacccccgaactcgaggaagagatgttcaaaaagcgcaacctgacaatcatggatcttcatcctggatccggcaaaaccagaaagtatctgcccgctattgttcgggaagccatcaagcgcagactccggacgctgatcctcgctcctacaagagtggtcgccgcggagatggaggaagccctgaaagggcttcccattcgctaccagaccaccgctacaaagagcgagcacaccggacgggaaatcgtggacctgatgtgccatgccacatttaccatgagactgctctctcctgttcgcgtgccgaattataacctgattatcatggatgaggctcacttcacggaccccgccagcattgccgctcggggctacatctccacaagagtcgggatgggagaagcggccgctatctttatgaccgccacacctcccggcaccgccgatgctttccctcagtctaatgcccccattcaggacgaggagcgcgacatcccggaacggagctggaactccgggaatgagtggattacggattttgcgggcaaaaccgtgtggttcgtgccttctatcaaggctggaaacgacattgccaactgtcttcgcaaaaatggcaagaaggtcatccaactgagcagaaaaacatttgataccgaataccagaagacaaaactcaacgactgggatttcgttgtgaccacagacatttccgagatgggggccaattttaaggctgatcgggtgatcgaccccagacggtgcctgaaacccgtcatcctgaccgatggacctgagcgcgtgattctcgccggccccatgcctgttacggcggcctctgctgcccagagacgggggcgcgtgggaagaaacccgcagaaggaaaatgaccaatatatcttcacaggccagccccttaacaatgatgaggaccatgctcactggaccgaagccaagatgctgctggacaacattaatacccctgaggggatcattcccgctctcttcgaacctgagcgggagaaaagcgccgcgatcgatggcgaatacagactgaagggagagtcccgcaaaacatttgtcgaacttatgcggagaggcgacctgcccgtgtggctcgcccacaaggttgctagcgaggggatcaaatataccgatcgcaagtggtgcttcgacggacagcggaacaatcagattctggaagagaacatggatgtggagatctggacaaaagaaggcgagaagaagaaactgagaccgcgctggctcgacgcccggacgtactctgatcctcttgctctgaaggaatttaaagagttcgccgccgggagaaagtccattgctctggacctcgtcaccgaaatcggacgcgtgcccagccatctggcgcacagaacacggaatgcccttgataacctggtcatgctccatacctctgagcacggcggccgcgcttatagacacgccgtggaggaactgcctgagacaatggaaaccctgctccttctggggctgatgattctcctgacgggaggcgccatgctttttctgatctccgggaaaggaatcggcaagaccagcattgggctcatctgtgttattgcttcctctggaatgctgtggatggccgagatccccctgcaatggattgcgagcgccatcgtgctcgagttctttatgatggtgcttctgattcctgaacccgagaagcagcggacaccgcaggacaatcaactggcttacgtcgttatcggcatcctcaccctggccgctattatcgccgcgaacgaaatgggccttctggagacaaccaaacgcgatctcgggatgtccaaggaacctggagtggtgagccccacgtcttatctggacgtcgatctgcatcccgcctccgcttggacactctacgccgtggctaccacagttattacccctatgcttagacacaccatcgagaatagcacagccaacgtgtctctggctgccattgcgaaccaggccgtcgtgctgatgggcctcgacaaagggtggccgatcagcaagatggacctgggagtcccccttctggctctcggctgctactcccaggtgaatcctctgacgctgaccgccgctgttctccttctgatcacacattatgccattatcgggcccggactgcaggccaaagcgacccgggaggctcaaaagagaacagccgctggcattatgaagaaccctaccgtggatggcatcatgacgattgacctcgatcccgtcatctacgactctaaattcgaaaagcagctgggacaggtgatgcttctggttctctgtgccgtgcagctgctgctcatgcgcacaagctgggccctttgcgaggctctgaccctggccaccggacctatcacaaccctctgggaaggctccccggggaaattttggaatacaacgattgcggtctctatggccaacatcttccggggaagctatctggctggcgccgggcttgctttttccattatgaaaagcgtgggaaccggcaaaagaggcacagggtctcaaggagagaccctgggcgaaaagtggaagaaaaagctcaatcagctgtcccgcaaagatttcgacctgtacaagaaaagcgggatcacagaggtggatcggaccgaggccaaggaaggactcaaaagaggcgagattacgcaccatgcggtttcccgggggtctgccaaacttcagtggtttgtcgaacgcaacatggtgatccccgagggaagagtgattgacctgggctgtggcagagggggatggagctattactgcgctggcctgaagaaagtcaccgaagttcgcgggtatacaaagggaggccctgggcacgaggagcccgtgcctatgtccacctacggatggaatatcgtgaaactcatgtctggcaaggatgtcttctacctgcccccggaaaaatgtgacacacttctgtgcgatatcggcgagagctcccctagccccaccgtggaagagtctagaacaattcgggttctcaagatggtggagccctggctgaagaacaatcagttctgtatcaaagtcctgaacccttatatgcccaccgtgattgaacacctcgagcgccttcaaagaaagcatgggggaatgctggttcggaatcctctgtcccgcaacagcacgcacgaaatgtactggatctctaatggcacagggaacattgtggcctccgtcaatatggtgagcagactcctgcttaaccggtttaccatgacccatagacgcccgacaatcgagaaagacgtggatctgggagctggcacgcggcacgtcaacgccgaacccgagacccctaatatggaggttatcggggaaagaattaagcgcatcaaagaggaacacaactctacatggcattatgacgacgagaatccctacaagacctgggcttatcacggaagctacgaagtgaaggccacaggctccgcgtctagcatgattaacggcgtggtcaaactcctgaccaagccttgggatgtggttcccatggtgacacagatggccatgaccgacacgaccccgttcgggcagcaacgggtctttaaagagaaggtggatacaagaacccctcgctccatgcccggaacacggagagttatgggcatcaccgctgagtggctgtggcgcacgctcgggcggaataaaaagcctagactgtgcacacgcgaagagttcaccaagaaagtgcggacaaacgccgctatgggagccgtctttaccgaagagaatcagtgggacagcgccaaggcggctgtggaagatgaggacttctggaaacttgttgatagagagcgcgaactgcataagctcggcaaatgtgggtcctgcgtgtataacatgatgggcaagagagagaaaaagctgggagaatttggcaaggccaaagggtctcgggccatttggtacatgtggcttggagctcgctacctggagttcgaggccctcggctttctgaatgaagaccactggttcagcagagagaactcctattctggggtcgaaggagagggcctgcataagctcgggtacatcctgcgggatatcagcaaaattcccggcggagctatgtatgccgacgatacggcgggctgggacaccagaatcacagaagacgatcttcacaatgaggagaagattacccagcagatggaccctgaacaccggcaactggccgatgctatctttaaactcacataccagaacaaggtggtcaaggtgcagcgccccaccccgacagggaccgttatggacattatctccagaaaagatcagcggggatctggccaagtggggacgtatggactgaatacattcaccaacatggaggcccagcttatccgccagatggaaggcgagggggtcctgagcaaggctgacctcgaaaatcctcatctgcccgagaaaaagattacccagtggctggagacaaaaggcgtggaaagactcaagcggatggccatctccggagatgactgcgtggttaagcccattgatgaccgctttgcgaacgccctgcttgctctgaacgatatgggcaaagtgagaaaggacatccctcaatggcagccgagcaaagggtggcacgattggcagcaggtccccttctgttctcatcacttccacgagctcattatgaaggacggacggaaactggtggttccttgccgcccccaagacgaacttatcggcagagcccggatttcccagggggctggatggagcctgaaggagaccgcctgtctcggcaaggcttacgcccagatgtggtctctgatgtattttcatcgcagagatctgcggctcgcgtccaatgccatctgcagcgctgtgcctgtccactgggtgcccacatctcgcacgacctggtccatccatgcccaccatcaatggatgacaaccgaagacatgctgacagtctggaacagagtgtggattgaggataatccttggatggaggacaaaacccccgttacgacctgggaaaacgtgccgtaccttgggaagcgggaggatcagtggtgtggcagcctgatcggactcacatccagagccacctgggctcagaatattcctacagccatccagcaagtccgcagcctgattggcaacgaagagttccttgactacatgccctctatgaaacggtttagaaaggaggaagagagcgaaggggcgatctggtga

SEQ ID NO: 20595 - RNA, 9873 nt, synthetic construct
  misc_feature 1..9873: note = derived and/or modified CDS sequence (opt5) from DENV-3__JF937636__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatggggattctgtgcctcgctatcctgtttgaagaggtcatgcggggaaagttcggcaaaaagcacatgattgccggcgtgttctttaccttcgttcttctgctcagcgggcagatcacatggcgcgatatggcccataccctgattatgatcggatccaatgctagcgacagaatgggcatgggggtgacgtatctggcccttatcgcgacatttaaaattcagcccttcctggctctcggatttttcctgcggaagctcacctctagagaaaacctgcttctgggcgtcgggctcgccatggccacaaccctgcaactgcctgaggatatcgaacagatggctaatggaattgcccttggcctgatggctctcaaactgatcacccagtttgagacataccagctctggacggccctgatttcccttacctgtagcaacacaatcttcaccctgacagtggcgtggcgcaccgccacgctcatcctggctggcgtgtccctgcttccggtctgccaatctagctccatgcggaagacagactggctgcccatggccgttgctgccatgggggtgcctcccctccctctgtttattttctctctcaaggataccctgaaaagacgcagctggccccttaatgagggagtgatggccgtcggcctggtgtccatcctggcttctagcctcctgagaaacgacgttcctatggcggggccccttgtggccggaggcctgctcattgcttgttatgtcatcaccgggacatccgccgatctgaccgtggaaaaggccgctgacattacatgggaggaagaggccgaacagacgggagttagccacaacctcatgatcaccgtggacgatgacggcacaatgcggatcaaagatgacgagaccgagaatattctgacagtccttctgaagaccgcgctgctcatcgtgtctggcatttttccgtactccatccctgctacgctgcttgtctggcatacctggcagaaacagacacaacgcagcggggtgctgtgggatgttccctctcctcccgaaacccagaaggccgagctcgaagagggagtgtacagaattaaacagcagggcatcttcgggaagacacaagtcggagtgggcgttcagaaggagggggtgtttcacaccatgtggcacgtcacacggggagccgtgctgacgtataacggcaaacgcctcgaaccgaattgggcttccgtgaagaaagacctgattagctacggcgggggatggagactttctgcccagtggcaaaagggcgaggaagttcaggtcatcgcggtggagcctgggaaaaaccccaagaatttccagaccatgcctggaacattccagaccaccacaggcgaaatcggggctattgccctggattttaagcccggaacgtccggcagccccatcattaaccgggagggcaaagtggtcgggctgtatggaaatggcgtggttaccaagaacgggggatacgtgtccggcatcgcccaaacaaatgctgagcctgacgggccgacccccgaactcgaggaagagatgttcaaaaagcgcaacctgacaattatggatcttcatcctggcagcggaaaaaccagaaagtatctgcccgccatcgtccgggaagctatccgcagacggctcagaacgctgattctcgcccctacacgcgtggttgcggccgagatggaggaagctctgaagggccttcccatccggtaccagaccaccgccacaaaatctgagcacaccgggagagaaattgtggacctgatgtgccatgctacatttaccatgcgcctgctcagccctgtccgggtgccgaattataacctgatcattatggatgaggcccacttcacggaccccgcctccatcgctgcgagaggatacatctctacacgcgttggcatgggggaagccgctgccatttttatgaccgccacacctcccggaaccgctgatgccttccctcagagcaatgcgcccatccaggacgaggagcgggacattccggaaagatcctggaactctggcaatgagtggatcacggattttgctgggaagaccgtgtggttcgtccctagcattaaagccggcaacgacatcgccaactgtcttcgcaagaatggcaaaaaggtgattcaactgtcccggaagacatttgataccgaataccagaaaacaaagctcaacgactgggatttcgtggtcaccacagacatctctgagatgggagctaattttaaagccgatagagttatcgacccccggcgctgcctgaagcccgtgattctgaccgatgggcctgagagagtgatcctcgcgggacccatgcctgtcacggccgctagcgccgctcagcggcgcggcagagtggggcggaacccgcagaaagaaaatgaccaatatattttcacaggacagccccttaacaatgatgaggaccatgcccactggaccgaagctaagatgctgctggacaacatcaatacccctgagggcattatccccgccctcttcgaacctgagagagagaagtccgcggccatcgatggggaataccgcctgaaaggcgagagccggaagacatttgttgaacttatgagacgcggagacctgcccgtgtggctcgctcacaaagtcgcctctgagggcattaagtataccgatcggaaatggtgcttcgacgggcagagaaacaatcagatcctggaagagaacatggatgtggagatttggacaaaggaaggagagaaaaagaagctgcgcccgcggtggctcgacgctagaacgtactccgatcctcttgccctgaaagaatttaaggagttcgccgctggccgcaaaagcatcgcgctggacctcgttaccgaaattgggagagtgccctctcatctggcccaccggacacgcaatgctcttgataacctggtcatgctccatacctccgagcacggaggcagagcctatcggcacgccgtggaggaactgcctgagacaatggaaaccctgctccttctgggcctgatgatcctcctgacagggggagctatgctttttctgatcagcggcaaggggattggaaaaacctccatcggcctcatttgtgtcatcgcctctagcgggatgctgtggatggcggagattcccctgcaatggatcgcctccgctattgtgctcgagttctttatgatggttcttctgatccctgaacccgagaagcagcgcacaccgcaggacaatcaactggcctacgtggtgatcggcattctcaccctggctgccatcattgcggccaacgaaatgggccttctggagacaaccaagagagatctcggcatgagcaaagaacctggggtcgtttctcccacgtcctatctggacgtggatctgcatcccgctagcgcctggacactctacgctgtggccaccacagtcatcacccctatgcttcggcacaccattgaaaattctacagctaacgtgagcctggccgcgatcgccaaccaggctgttgtgctgatgggactcgacaagggctggccgatctccaaaatggacctgggggtcccccttctggccctcggatgctactctcaggtgaatcctctgacgctgaccgctgccgtcctccttctgattacacattatgccatcattggccccgggctgcaggcgaaggctaccagagaggcccaaaaacgcacagctgccggaatcatgaagaaccctaccgtggatggcattatgacgatcgacctcgatcccgttatctacgacagcaagttcgaaaaacagctgggccaggtgatgcttctggtcctctgtgccgtgcagctgctgctcatgcggacatcctgggctctttgcgaggccctgaccctggcgaccgggcctattacaaccctctgggaaggatctccgggcaagttttggaatacaacgatcgccgttagcatggctaacattttcagagggtcctatctggccggagctggccttgcctttagcatcatgaaatctgtggggaccggaaagcgcggcacaggctcccaaggggagaccctgggagaaaaatggaagaagaaactcaatcagctgagccggaaggatttcgacctgtacaaaaagtccggcattacagaggtcgatagaaccgaggcgaaagaagggctcaagcggggagagatcacgcaccatgccgtgtctcgcggcagcgctaaacttcagtggtttgtggaaagaaacatggttattcccgaggggcgggtcatcgacctgggatgtggccgcggcgggtggtcctattactgcgccggactgaagaaggtgaccgaagtgagaggctatacaaaagggggacctggccacgaggagcccgtccctatgtctacctacgggtggaatatcgttaagctcatgagcggaaaagatgtgttctacctgcccccggaaaagtgtgacacacttctgtgcgatattggcgagtccagcccttctcccaccgtggaagagtcccggacaatccgcgtcctcaaaatggtggagccctggctgaagaacaatcagttctgtattaaggttctgaacccttatatgcccaccgtgatcgaacacctcgagagacttcaacggaaacatggcgggatgctggtccgcaatcctctgagcagaaactctacgcacgaaatgtactggatttccaatggaacaggcaacatcgtggctagcgttaatatggtgtctcggctcctgcttaacagatttaccatgacccatcgccggccgacaatcgagaaggacgtcgatctgggggccggaacgagacacgtgaacgctgaacccgagacccctaatatggacgtgattggcgagcgcatcaaacggattaaggaggaacacaacagcacatggcattatgacgatgaaaatccctacaaaacctgggcctatcacgggtcctacgaggtcaaggcgacaggatctgccagctccatgatcaacggcgttgtgaagctcctgaccaaaccttgggacgtggtccccatggtgacacagatggctatgaccgatacgaccccgttcggccagcaaagagtttttaaggaaaaagtggacacacgcacccctcggagcatgcccgggacaagacgcgtcatgggaattaccgccgagtggctgtggcggacgctcggcagaaataagaaacctcgcctgtgcacacgggaggagttcaccaagaaggtgagaacaaacgctgccatgggggccgtttttaccgaggaaaatcagtgggattccgcgaaagctgccgtggaggacgaagatttctggaaacttgtcgaccgcgagagagagctgcataaactcggaaagtgtggctcttgcgtgtataacatgatggggaaacgggaaaagaaactgggcgagtttggaaaggccaagggcagccgcgctatctggtacatgtggcttggggccagatacctggagttcgaggctctcggatttctgaatgaggatcactggttctcccgggaaaactcttatagcggcgttgagggggaaggactgcataaactcggctacatcctgagagacatttccaagatccccgggggcgccatgtatgcggatgacacggccggatgggacacccggattacagaggatgaccttcacaatgaagagaaaatcacccagcagatggatcctgagcaccgccaactggctaacgccatttttaagctcacataccagaataaagtggtcaaggtgcagagacccaccccgacaggcaccgtcatggacatcatctctcggaaggatcagcgcgggagcggacaagtgggcacgtatgggctgaacacattcaccaatatggaagctcagcttattagacagatggagggagaaggcgttctgtccaaagccgacctcgagaaccctcatctgcccgaaaagaaaatcacccagtggctggagacaaagggggtggagcggctcaaacgcatggcgattagcggcgatgactgcgtcgtgaagcccatcgatgacagatttgccaacgctctgcttgccctgaatgatatgggaaaggtgcggaaagacattcctcaatggcagccgtctaagggctggcacgattggcagcaggttcccttctgttcccatcacttccacgaactcatcatgaaagacgggcgcaagctggtggtcccttgcagaccccaagacgagcttattggacgggctcgcatcagccagggcgccgggtggtctctgaaagaaaccgcttgtctcggaaaggcctacgcgcagatgtggtccctgatgtattttcatagacgggatctgcgcctcgccagcaacgctatctgctctgccgtgcctgttcactgggtgcccacatccagaacgacctggagcattcatgcccaccatcaatggatgacaaccgaggacatgctgacagtctggaatcgggtgtggatcgaagataacccttggatggaggacaagacccccgtcacgacctgggagaatgtgccgtaccttggcaaaagagaagatcagtggtgtgggtccctgattggcctcacaagccgcgctacctgggcccagaacatccctacagcgattcagcaagttcggtctctgatcggaaatgaggagttccttgactacatgcccagcatgaagagatttcgcaaagaggaggaatccgagggcgctatctggtga

SEQ ID NO: 20596 - RNA, 9873 nt, synthetic construct
  misc_feature 1..9873: note = derived and/or modified CDS sequence (opt5) from DENV-3__JF937626__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcgggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatgacatgggaggaagaggccgaacagacgggcgtgtcccacaacctcatgatcaccgtcgacgatgacggcacaatgcggattaaagatgacgagaccgagaatatcctgacagtgcttctgaagaccgcgctgctcatcgtcagcgggatttttccgtactctatccctgctacgctgcttgtgtggcatacctggcagaaacagacacaacgctccggagttctgtgggatgtgcccagccctcccgaaacccagaaggccgagctcgaagagggcgtctacagaattaaacagcaggggatcttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatttcctacgggggaggctggagacttagcgcccagtggcaaaagggggaggaagtccaggtgatcgcggtggagcctggcaagaaccccaagaatttccagaccatgcctggcacattccagaccaccacaggggaaattggagctatcgccctggattttaagcccggcacgtctggctcccccatcattaaccgggaggggaaagtcgtgggactgtatggcaatggggttgtgaccaagaacggaggctacgtcagcgggatcgcccaaacaaatgctgagcctgacggcccgacccccgaactcgaggaagagatgttcaaaaagcgcaacctgacaattatggatcttcatcctggatccggcaaaaccagaaagtatctgcccgccatcgtgcgggaagctattaagcgcagactccggacgctgatcctcgcccctacaagagttgtggcggccgagatggaggaagctctgaaagggcttcccatccgctaccagaccaccgccacaaagagcgagcacaccggacgggaaattgtcgacctgatgtgccatgctacatttaccatgagactgctctctcctgtgcgcgttccgaattataacctgatcattatggatgaggcccacttcacggaccccgccagcatcgctgcgcggggctacatttccacaagagtggggatgggagaagccgctgccatctttatgaccgccacacctcccggcaccgctgatgccttccctcagtctaatgcgcccatccaggacgaggagcgcgacattccggaacggagctggaactccgggaatgagtggatcacggattttgctggcaaaaccgtctggttcgtgccttctattaaggccggaaacgacatcgccaactgtcttcgcaaaaatggcaagaaggtgattcaactgagcagaaaaacatttgataccgaataccagaagacaaaactcaacgactgggatttcgtcgttaccacagacatctccgagatgggggctaattttaaggccgatcgggtgattgaccccagacggtgcctgaaacccgtgatcctgaccgatggacctgagcgcgtcatcctcgcgggccccatgcctgtgacggccgcttctgccgctcagagacgggggcgcgttggaagaaacccgcagaaggaaaatgaccaatatattttcacaggccagccccttaacaatgatgaggaccatgcccactggaccgaagctaagatgctgctggacaacatcaatacccctgaggggattatccccgccctcttcgaacctgagcgggagaaaagcgcggccattgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagatcctggaagagaacatggatgttgagatttggacaaaagaaggcgagaagaagaaactgagaccgcgctggctcgacgctcggacgtactctgatcctcttgccctgaaggaatttaaagagttcgccgctgggagaaagtccatcgcgctggacctcgtgaccgaaattggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgatcctcctgacgggaggcgctatgctttttctgatttccgggaaaggaatcggcaagaccagcatcgggctcatttgtgtgatcgcctcctctggaatgctgtggatggcggagattcccctgcaatggatcgccagcgctattgttctcgagttctttatgatggtgcttctgatccctgaacccgagaagcagcggacaccgcaggacaatcaactggcctacgtggtcattggcatcctcaccctggctgccatcattgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgatcacccctatgcttagacacaccattgagaatagcacagctaacgtttctctggccgcgatcgccaaccaggctgtggtcctgatgggcctcgacaaagggtggccgattagcaagatggacctgggagtgccccttctggccctcggctgctactcccaggtcaatcctctgacgctgaccgctgccgtgctccttctgatcacacattatgccatcattgggcccggactgcaggcgaaagctacccgggaggcccaaaagagaacagctgccggcatcatgaagaaccctaccgttgatggcattatgacgatcgacctcgatcccgtgatttacgactctaaattcgaaaagcagctggggcaggtcatgcttctggtgctctgtgccgttcagctgctgctcatgcgcacaagctgggctctttgcgaggccctgaccctggcgaccggacctatcacaaccctctgggaaggctccccggggaaattttggaatacaacgatcgccgtgtctatggctaacattttccggggaagctatctggccggcgctgggcttgccttttccatcatgaaaagcgtcggaaccggcaaaagaggcacagggtctcaaggagagaccctgggcgaaaagtggaagaaaaagctcaatcagctgtcccgcaaagatttcgacctgtacaagaaaagcgggattacagaggtggatcggaccgaggcgaaggaaggactcaaaagaggcgagatcacgcaccatgccgtgtcccgggggtctgctaaacttcagtggtttgttgaacgcaacatggtcgtgcccgagggaagagtgattgacctgggctgtggcagagggggatggagctattactgcgccggcctgaagaaagtcaccgaagttcgcgggtatacaaagggaggccctgggcacgaggagcccgtgcctatgtccacctacggatggaatatcgtgaaactcatgtctggcaaggatgtcttctacctgcccccggaaaaatgtgacacacttctgtgcgatattggcgagagctcccctagccccaccgtggaagagtctagaacaatccgggttctcaagatggtggagccctggctgaagaacaatcagttctgtatcaaagtcctgaacccttatatgcccaccgtgattgaacacctcgagcgccttcaaagaaagcatgggggaatgctggttcggaatcctctgtcccgcaacagcacgcacgaaatgtactggatctctaatggcacagggaacattgtggcttccgtcaatatggtgagcagactcctgcttaaccggtttaccatgacccatagacgcccgacaatcgagaaagacgtggatctgggagccggcacgcggcacgtcaacgctgaacccgagacccctaatatggacgttattggggagagaatcaagcgcatcaaagaagaacacaactctacatggcattatgacgatgaaaatccctacaagacctgggcctatcacggaagctacgaggtgaaggcgacaggctccgcctctagcatgattaacggcgtggtcaaactcctgaccaagccttgggacgtggttcccatggtgacacagatggctatgaccgatacgaccccgttcgggcagcaacgggtctttaaagaaaaggtggacacaagaacccctcgctccatgcccggaacacggagagttatgggcatcaccgccgagtggctgtggcgcacgctcgggcggaataaaaagcctagactgtgcacacgcgaggagttcaccaagaaagtgcggacaaacgctgccatgggagccgtctttaccgaggaaaatcagtgggatagcgcgaaggctgccgtggaggacgaagatttctggaaacttgttgacagagagcgcgagctgcataagctcggcaaatgtgggtcctgcgtgtataacatgatgggcaagagagagaagaagctgggagagtttggcaaggccaaagggtctcgggctatttggtacatgtggcttggagcccgctacctggagttcgaggctctcggctttctgaatgaggatcactggttcagcagagaaaactcctattctggggtcgagggagaaggcctgcataagctcgggtacatcctgcgggacattagcaaaatccccggcggagccatgtatgcggatgacacggccggctgggacaccagaatcacagaggatgaccttcacaatgaagagaagattacccagcagatggatcctgagcaccggcaactggctaacgccatctttaaactcacataccagaataaggtggtcaaggtgcagcgccccaccccgacagggaccgttatggacattatctccagaaaagatcagcggggatctggccaagtggggacgtatggactgaacacattcaccaatatggaagctcagcttattcgccagatggagggcgaaggggtcctgagcaaggccgacctcgagaaccctcatctgcccgagaaaaagatcacccagtggctggagacaaaaggcgtggagagactcaagcggatggcgatctccggagatgactgcgtggttaagcccattgatgaccgctttgccaacgctctgcttgccctgaatgatatgggcaaagtgagaaaggacatccctcaatggcagccgagcaaagggtggcacgattggcagcaggtccccttctgttctcatcacttccacgaactcattatgaaggacggacggaaactggtggttccttgccgcccccaagacgagcttatcggcagagctcggatttcccagggggccggatggagcctgaaggaaaccgcttgtctcggcaaggcctacgcgcagatgtggtctctgatgtattttcatcgcagagatctgcggctcgcctccaacgctatctgcagcgccgtgcctgtccactgggtgcccacatctcgcacgacctggtccattcatgcccaccatcaatggatgacaaccgaggacatgctgacagtctggaatagagtgtggatcgaagataacccttggatggaggacaaaacccccgttacgacctgggagaatgtgccgtaccttgggaagcgggaagatcagtggtgtggcagcctgatcggactcacatccagagctacctgggcccagaacattcctacagcgatccagcaagtccgcagcctgattggcaatgaggagttccttgactacatgccctctatgaaacggtttagaaaggaggaggaaagcgagggggctatctggtga

SEQ ID NO: 20597 - RNA, 9873 nt, synthetic construct
  misc_feature 1..9873: note = derived and/or modified CDS sequence (opt5) from DENV-3__JF937621__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctcggggggccagacgcatggctatccttggagacaccgcctgggatttcggctccgtggggggagttctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaacgggccgctgacatcacatgggaggaagaggccgaacagacgggcgtgtcccacaacctcatgattaccgtcgacgatgacggcacaatgcgcatcaaggatgacgagaccgagaatatcctgacagtgcttctgaaaaccgcgctgctcattgtcagcgggatctttccgtactctattcctgctacgctgcttgtgtggcatacctggcagaagcagacacaaagatccggagttctgtgggatgtgcccagccctcccgaaacccagaaagccgagctcgaagagggcgtctaccggatcaagcagcaggggattttcggaaaaacacaagtgggcgttggggtgcagaaggagggagtctttcacaccatgtggcacgtgacacgcggcgccgtgctgacgtataacggcaagagactcgaaccgaattgggcttctgttaaaaaggacctgatctcctacgggggaggctggcggcttagcgcccagtggcaaaaaggggaggaagtccaggtgattgcggtggagcctggaaagaaccccaaaaatttccagaccatgcctggcacattccagaccaccacaggggaaatcggagctatcgccctggattttaagcccggcacgtctggctcccccattatcaaccgcgaggggaaggtcgtgggactgtatggcaatggggttgtgaccaaaaacggaggctacgtcagcgggattgcccaaacaaatgctgagcctgacggcccgacccccgaactcgaggaagagatgttcaagaaaagaaacctgacaatcatggatcttcatcctggatccggcaagacccggaaatatctgcccgccattgtgcgcgaagctatcaagagacggctcagaacgctgatcctcgcccctacacgcgttgtggcggccgagatggaggaagctctgaaggggcttcccattcggtaccagaccaccgccacaaaaagcgagcacaccggaagagaaatcgtcgacctgatgtgccatgctacatttaccatgcgcctgctctctcctgtgcgggttccgaattataacctgattatcatggatgaggcccacttcacggaccccgccagcattgctgcgagaggctacatctccacacgcgtggggatgggagaagccgctgccatctttatgaccgccacacctcccggcaccgctgatgccttccctcagtctaatgcgcccattcaggacgaggagcgggacatcccggaaagaagctggaactccgggaatgagtggattacggattttgctggcaagaccgtctggttcgtgccttctatcaaagccggaaacgacattgccaactgtcttcgcaagaatggcaaaaaggtgatccaactgagccggaagacatttgataccgaataccagaaaacaaagctcaacgactgggatttcgtcgttaccacagacatttccgagatgggggctaattttaaagccgatagagtgatcgacccccggcgctgcctgaagcccgtgatcctgaccgatggacctgagagagtcattctcgcgggccccatgcctgtgacggccgcttctgccgctcagcggcgcgggagagttggacggaacccgcagaaagaaaatgaccaatatatcttcacaggccagccccttaacaatgatgaggaccatgcccactggaccgaagctaagatgctgctggacaacattaatacccctgaggggatcattcccgccctcttcgaacctgagagagagaagagcgcggccatcgatggcgaataccgcctgaaaggagagtcccggaagacatttgtggaacttatgagacgcggcgacctgcccgtctggctcgctcacaaagtggccagcgaggggatcaagtataccgatcggaaatggtgcttcgacggacagagaaacaatcagattctggaagagaacatggatgttgagatctggacaaaggaaggcgagaaaaagaagctgcgcccgcggtggctcgacgctagaacgtactctgatcctcttgccctgaaagaatttaaggagttcgccgctgggcgcaaatccattgcgctggacctcgtgaccgaaatcggaagagtccccagccatctggcccaccggacacgcaatgctcttgataacctggtgatgctccatacctctgagcacggcggcagagcctatcggcacgccgtcgaggaactgcctgagacaatggaaaccctgctccttctggggctgatgattctcctgacgggaggcgctatgctttttctgatctccgggaagggaatcggcaaaaccagcattgggctcatctgtgtgattgcctcctctggaatgctgtggatggcggagatccccctgcaatggattgccagcgctatcgttctcgagttctttatgatggtgcttctgattcctgaacccgagaagcagcgcacaccgcaggacaatcaactggcctacgtggtcatcggcatcctcaccctggctgccattatcgcggccaacgaaatgggccttctggagacaaccaagagagatctcgggatgtccaaagaacctggagttgtgagccccacgtcttatctggacgtggatctgcatcccgcttccgcctggacactctacgctgtcgccaccacagtgattacccctatgcttcggcacaccatcgagaatagcacagctaacgtttctctggccgcgattgccaaccaggctgtggtcctgatgggcctcgacaaggggtggccgatcagcaaaatggacctgggagtgccccttctggccctcggctgctactcccaggtcaatcctctgacgctgaccgctgccgtgctccttctgatcacacattatgccattatcgggcccggactgcaggcgaaggctaccagagaggcccaaaaacgcacagctgccggcattatgaagaaccctaccgttgatggcatcatgacgattgacctcgatcccgtgatctacgactctaagttcgaaaaacagctggggcaggtcatgcttctggtgctctgtgccgttcagctgctgctcatgcggacaagctgggctctttgcgaggccctgaccctggcgaccggacctatcacaaccctctgggaaggctccccggggaagttttggaatacaacgattgccgtgtctatggctaacatcttcagaggaagctatctggccggcgctgggcttgccttttccattatgaaaagcgtcggaaccggcaagcgcggcacagggtctcaaggagagaccctgggcgaaaaatggaagaagaaactcaatcagctgtcccggaaggatttcgacctgtacaaaaagagcgggatcacagaggtggatagaaccgaggcgaaagaaggactcaagcggggcgagattacgcaccatgccgtgtcccgcgggtctgctaaacttcagtggtttgttgaaagaaacatggtcatccccgagggacgggtgattgacctgggctgtggccgcgggggatggagctattactgcgccggcctgaagaaggtgaccgaagtcagagggtatacaaaaggaggccctgggcacgaggagcccgttcctatgtccacctacggatggaatatcgtgaagctcatgtctggcaaagatgtgttctacctgcccccggaaaagtgtgacacacttctgtgcgatatcggcgagagctcccctagccccaccgtcgaagagtctcggacaattcgcgtgctcaaaatggttgagccctggctgaagaacaatcagttctgtatcaaggtgctgaacccttatatgcccaccgtcattgaacacctcgagagacttcaacggaaacatgggggaatgctggtgcgcaatcctctgtccagaaacagcacgcacgaaatgtactggatctctaatggcacagggaacattgttgcttccgtgaatatggtcagccggctcctgcttaacagatttaccatgacccatcgccggccgacaatcgagaaggacgtggatctgggagccggcacgagacacgtgaacgctgaacccgagacccctaatatggacgtcatcggggagcgcattaaacggatcaaggaagagcacaactctacatggcattatgacgatgaaaatccctacaaaacctgggcctatcacggaagctacgaggttaaggcgacaggctccgcctctagcatgattaacggcgtggtgaagctcctgaccaaaccttgggacgtcgtgcccatggttacacagatggctatgaccgatacgaccccgttcgggcagcaaagagtgtttaaggaaaaagtcgacacacgcacccctcggtccatgcccggaacaagacgcgtgatgggcatcaccgccgagtggctgtggcggacgctcgggagaaataagaaacctcgcctgtgcacacgggaggaattcaccaagaaggttagaacaaacgctgccatgggagccgtgtttaccgaggaaaatcagtgggatagcgcgaaagctgccgtcgaggacgaagatttctggaagcttgtggaccgcgagagagagctgcataaactcggcaagtgtgggtcctgcgtttataacatgatgggcaaacgggaaaagaaactgggagagtttggcaaggccaaggggtctcgcgctatttggtacatgtggcttggagccagatacctggaattcgaggctctcggctttctgaatgaggatcactggttcagccgggaaaactcctattctggggtggagggagaaggcctgcataaactcgggtacatcctgagagacatcagcaagattcccggcggagccatgtatgcggatgacacggccggctgggacacccggatcacagaggatgaccttcacaatgaagagaaaattacccagcagatggatcctgagcaccgccaactggctaacgccatctttaagctcacataccagaataaagtcgtgaaggtccagagacccaccccgacagggaccgtgatggacattatctcccggaaggatcagcgcggatctggccaagttgggacgtatggactgaacacattcaccaatatggaagctcagcttatcagacagatggagggcgaaggggtgctgagcaaagccgacctcgagaaccctcatctgcccgaaaagaaaattacccagtggctggagacaaagggcgtcgagcggctcaaacgcatggcgatctccggagatgactgcgtggtgaagcccattgatgacagatttgccaacgctctgcttgccctgaatgatatgggcaaggttcggaaagacatccctcaatggcagccgagcaaggggtggcacgattggcagcaggtgcccttctgttctcatcacttccacgaactcattatgaaagacggacgcaagctggtcgtgccttgcagaccccaagacgagcttatcggccgggctcgcatttcccagggggccggatggagcctgaaagaaaccgcttgtctcggcaaggcctacgcgcagatgtggtctctgatgtattttcatagacgggatctgcgcctcgcctccaacgctatctgcagcgccgttcctgtgcactgggtccccacatctagaacgacctggtccatccatgcccaccatcaatggatgacaaccgaggacatgctgacagtgtggaatcgggtctggattgaagataacccttggatggaggacaagacccccgtgacgacctgggagaatgttccgtaccttgggaaaagagaagatcagtggtgtggcagcctgatcggactcacatcccgcgctacctgggcccagaacattcctacagcgatccagcaagtgcggagcctgattggcaatgaggaattccttgactacatgccctctatgaagagatttcgcaaagaggaggaaagcgagggggctatctggtga

SEQ ID NO: 20598 - RNA, 9873 nt, synthetic construct
  misc_feature 1..9873: note = derived and/or modified CDS sequence (opt5) from DENV-3__JF937623__SS-prME
  source 1..9873: mol_type = other RNA
gcgagcctgtgcctcatgatgatcctgcccgctgcccttgcgttccacctgacctcccgggacggagaacctcggatgattgtggggaagaacgaacgcggaaaatctctcctgtttaagacagctagcggcatcaatatgtgtacgcttattgccatggatctgggggaaatgtgcgacgataccgtcacatacaaatgtccgcatatcaccgaagttgaacccgaagacattgattgctggtgtaacctcacatccacctgggtgacatatggaacctgcaatcaggccggcgaacaccggcgggacaagcgctctgtggctctggcccctcatgtcgggatgggactggatacgcggacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccagctggcgacacttcgcaaactgtgtatcgagggaaagattaccaacatcacaaccgattccagatgccctacgcagggcgaagccacactcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcattttctttacattcgttcttctgctcagcgggcagatcacctggcgcgatatggctcatacactgattatgatcggatccaatgccagcgacagaatgggcatgggggtgacctatctggcgcttatcgctacgtttaaaattcagcccttcctggccctcggatttttcctgcggaagctcacatctagagaaaacctgcttctgggcgtcgggctcgccatggctaccacactgcaactgcctgaggatatcgaacagatggccaatggaattgctcttggcctgatggccctcaaactgatcacccagtttgagacctaccagctctggacagcgctgatttcccttacgtgtagcaacaccatcttcacactgaccgtggcctggcgcacagctaccctcatcctggccggcgtgtccctgcttccggtctgccaatctagctccatgcggaagacggactggctgcccatggctgttgccgccatgggggtgcctcccctccctctgtttattttcggactcaaggatacactgaaaagacgctcttggccccttaatgagggcgtgatggctgtcgggctggtgagcatcctggcgtcctctctcctgagaaacgacgttcctatggccggaccccttgtggctggcgggctgctcattgcctgttatgtcatcaccggaaccagcgccgatctgacagtggaaaaggctgccgacatgacctgggaggaagaggcggaacagacaggcgtttcccacaacctcatgattacggtggacgatgacggcaccatgcggatcaaagatgacgagacagagaatatcctgaccgtccttctgaagacagctctgctcattgtgagcgggatctttccgtactctattcctgccaccctgcttgtctggcatacgtggcagaaacagacccaacgctccggagtgctgtgggatgttcccagccctcccgaaacacagaaggccgagctcgaagagggcatctacagaattaaacagcaggggatcttcggaaagacccaagtgggcgtcggggtgcagaaggagggagtttttcacacaatgtggcacgtgacccggggcgctgtcctgacatataacggcaaacgcctcgaaccgaattgggcctctgtgaagaaagacctgatttcctacgggggaggctggagacttagcgcgcagtggcaaaagggggaggaagtgcaggttatcgctgtcgagcctggcaagaaccccaagaatttccagacgatgcctggcaccttccagacaaccaccggggaaatcggagccattgccctggattttaagcccggcacatctggctcccccatcattaaccgggaggggaaagtggtgggactgtatggcaatggggtcgtgacgaagaacggaggctacgttagcgggatcgctcaaaccaatgccgagcctgacggcccgacacccgaactcgaggaagagatgttcaaaaagcgcaacctgaccattatggatcttcatcctggatccggcaaaacaagaaagtatctgcccgctatcgtgcgggaagccatcaagcgcagactccggaccctgattctcgcgcctacgagagtcgtggccgctgagatggaggaagccctgaaagggcttcccatccgctaccagacaaccgctaccaagagcgagcacacaggacgggaaattgttgacctgatgtgccatgccacctttacaatgagactgctctctcctgtgcgcgtcccgaattataacctgatcattatggatgaggcccacttcaccgaccccgctagcatcgcggcccggggctacatctccacgagagtggggatgggagaagctgccgccatttttatgacagctacccctcccggcacagccgatgcgttccctcagtctaatgctcccatccaggacgaggagcgcgacattccggaacggagctggaactccgggaatgagtggatcaccgattttgccggcaaaacggtttggttcgtgccttctattaaggccggaaacgacatcgctaactgtcttcgcaaaaatggcaagaaggtcattcaactgagcagaaaaacctttgatacagaataccagaagaccaaactcaacgactgggatttcgtggtgacaaccgacatctccgagatgggggccaattttaaggcggatcgggtcatcgaccccagacggtgcctgaaacccgttattctgacagatggacctgagcgcgtgatcctcgccggccccatgcctgtgaccgctgcctctgctgcccagagacgggggcgcgtcggaagaaacccgcagaaggaaaatgaccaatatattttcacgggccagccccttaacaatgatgaggaccatgctcactggacagaagccaagatgctgctggacaacatcaatacccctgaggggattatccccgccctcttcgaacctgagcgggagaaaagcgccgctatcgatggcgaatacagactgaagggagagtcccgcaaaacctttgtggaacttatgcggagaggcgacctgcccgtttggctcgcccacaaggtggctagcgaggggattaaatatacagatcgcaagtggtgcttcgacggacagcggaacaatcagatcctggaagagaacatggatgtcgagatttggaccaaagaaggcgagaagaagaaactgagaccgcgctggctcgacgcccggacatactctgatcctcttgccctgaaggaatttaaagagttcgctgcggggagaaagtccatcgccctggacctcgtgacggaaattggacgcgttcccagccatctggctcacagaacccggaatgcccttgataacctggtgatgctccatacatctgagcacggcggccgcgcctatagacacgctgtcgaggaactgcctgagaccatggaaacactgctccttctggggctgatgatcctcctgaccggaggcgccatgctttttctgatctccgggaaaggaattggcaagacgagcatcgggctcatttgtgtgatcgcgtcctctggaatgctgtggatggccgagattcccctgcaatggatcgctagcgccattgtcctcgagttctttatgatggtgcttctgatccctgaacccgagaagcagcggaccccgcaggacaatcaactggcttacgttgtgatcggcattctcacactggccgcgatcattgccgctaacgaaatgggccttctggagaccacaaaacgcgatctcgggatgtccaaggaacctggagtggtcagccccacctcttatctggacgttgatctgcatcccgcctccgcttggacgctctacgccgtggctacaaccgtgatcacacctatgcttagacacaccattgagaatagcaccgccaacgtctctctggcggccatcgctaaccaggccgtggttctgatgggcctcgacaaagggtggccgatcagcaagatggacctgggagtgccccttctggctctcggctgctactcccaggtcaatcctctgacactgacggccgccgtgctccttctgattacccattatgcgatcattgggcccggactgcaggctaaagccacacgggaggctcaaaagagaaccgccgccggcatcatgaagaaccctacagtcgatggcattatgaccatcgacctcgatcccgtgatctacgactctaaattcgaaaagcagctggggcaggttatgcttctggtgctctgtgctgtccagctgctgctcatgcgcacgagctgggccctttgcgaggcgctgacactggccaccggacctattaccacactctgggaaggctccccggggaaattttggaataccacaatcgctgtgtctatggccaacattttccggggaagctatctggctggcgccgggcttgcgttttccatcatgaaaagcgttggaacgggcaaaagaggcaccgggtctcaaggagagacactgggcgaaaagtggaagaaaaagctcaatcagctgtcccgcaaagatttcgacctgtacaagaaaagcgggattaccgaggtggatcggacagaggccaaggaaggactcaaaagaggcgagatcacccaccatgctgtctcccgggggtctgccaaacttcagtggtttgtggaacgcaacatggtgattcccgagggaagagttatcgacctgggctgtggcagagggggatggagctattactgcgctggcctgaagaaagtcacggaagtgcgcgggtataccaagggaggccctgggcacgaggagcccgtgcctatgtccacatacggatggaatatcgtcaaactcatgtctggcaaggatgttttctacctgcccccggaaaaatgtgacacccttctgtgcgatattggcgagagctcccctagccccacagtggaagagtctagaaccatccgggtgctcaagatggtcgagccctggctgaagaacaatcagttctgtattaaagtgctgaacccttatatgcccacagttatcgaacacctcgagcgccttcaaagaaagcatgggggaatgctggtgcggaatcctctgtcccgcaacagcacccacgaaatgtactggatttctaatggcacggggaacatcgtcgcctccgtgaatatggttagcagactcctgcttaaccggtttacaatgacccatagacgcccgaccatcgagaaagacgtggatctgggagctggcacacggcacgtcaacgccgaacccgagacgcctaatatggacgtgattggggagagaatcaagcgcattaaagaagaacacaactctacctggcattatgacgatgaaaatccctacaagacatgggcgtatcacggaagctacgaggtgaaggccaccggctccgcttctagcatgatcaacggcgtcgttaaactcctgacaaagccttgggacgtggtgcccatggtcacccagatggccatgacagataccacgccgttcgggcagcaacgggtgtttaaagaaaaggttgacaccagaacacctcgctccatgcccggaacccggagagtgatgggcattacagctgagtggctgtggcgcaccctcgggcggaataaaaagcctagactgtgcacgcgcgaggagttcacaaagaaagtccggaccaacgccgccatgggagcggtgtttacagaggaaaatcagtgggatagcgctaaggccgccgttgaggacgaagatttctggaaacttgtggacagagagcgcgagctgcataagctcggcaaatgtgggtcctgcgtctataacatgatgggcaagagagagaagaagctgggagagtttggcaaggctaaagggtctcgggccatctggtacatgtggcttggagctcgctacctggagttcgaggccctcggctttctgaatgaggatcactggttcagcagagaaaactcctattctggggtggagggagaaggcctgcataagctcgggtacatcctgcgggacattagcaaaatccccggcggagcgatgtatgccgatgacaccgctggctgggacacgagaattaccgaggatgaccttcacaatgaagagaagatcacacagcagatggatcctgagcaccggcaactggccaacgctatttttaaactcacctaccagaataaggttgtgaaggtccagcgccccacaccgaccgggacagtgatggacatcatctccagaaaagatcagcggggatctggccaagtcgggacctatggactgaacacgttcacaaatatggaagcccagcttattcgccagatggagggcgaaggggtgctgagcaaggcggacctcgagaaccctcatctgcccgagaaaaagatcacccagtggctggagaccaaaggcgttgagagactcaagcggatggccatttccggagatgactgcgtggtcaagcccatcgatgaccgctttgctaacgccctgcttgctctgaatgatatgggcaaagtgagaaaggacattcctcaatggcagccgagcaaagggtggcacgattggcaacaggtgcccttctgttctcatcacttccacgaactcatcatgaaggacggacggaaactggttgtgccttgccgcccccaagacgagcttattggcagagcccggatctcccagggggctggatggagcctgaaggaaacagcctgtctcggcaaggcgtacgcccagatgtggtctctgatgtattttcatcgcagagatctgcggctcgcttccaacgccatctgcagcgccgtccctgtgcactgggttcccacctctcgcacaacgtggtccattcatgctcaccatcaatggatgaccacagaggacatgctgaccgtgtggaatagagtctggatcgaagataacccttggatggaggacaaaacacccgtgaccacgtgggagaatgtcccgtaccttgggaagcgggaagatcagtggtgtggcagcctgattggactcacctccagagccacatgggcgcagaacatccctaccgctattcagcaagtgcgcagcctgatcggcaatgaggagttccttgactacatgccctctatgaaacggtttagaaaggaggaggaaagcgagggggccatctggtga

SEQ ID NO: 20599 - RNA, 9873 nt, synthetic construct
  misc_feature 1..9873: note = derived and/or modified CDS sequence (opt5) from DENV-3__JF937637__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacgcctttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgtctccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccatcgccccggatatcacacacaaaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatggctgtggccgccatgggggtgcctcccctccctctgtttatcttcggactcaaggatacactgaaaagacgctcttggccccttaatgagggcgtcatggctgtggggctggttagcattctggcgtcctctctcctgagaaacgacgtgcctatggccggaccccttgtcgctggcgggctgctcatcgcctgttatgtgattaccggaaccagcgccgatctgacagttgaaaaggctgccgacatcacctgggaggaagaggcggaacagacaggcgtgtcccacaacctcatgattacggtcgacgatgacggcaccatgcggatcaaagatgacgagacagagaatatcctgaccgtgcttctgaagacagctctgctcattgtcagcgggatctttccgtactctattcctgccaccctgcttgtgtggcatacgtggcagaaacagacccaacgctccggagttctgtgggatgtgcccagccctcccgaaacacagaaggccgagctcgaagagggcgtctacagaatcaaacagcaggggattttcggaaagacccaagtgggcgttggggtgcagaaggagggagtctttcacacaatgtggcacgtgacccggggcgctgtgctgacatataacggcaaacgcctcgaaccgaattgggcctctgttaagaaagacctgatctcctacgggggaggctggagacttagcgcgcagtggcaaaagggggaggaagtccaggtgattgctgtggagcctggcaagaaccccaagaatttccagacgatgcctggcaccttccagacaaccaccggggaaatcggagccatcgccctggattttaagcccggcacatctggctcccccattatcaaccgggaggggaaagtcgtgggactgtatggcaatggggttgtgacgaagaacggaggctacgtcagcgggattgctcaaaccaatgccgagcctgacggcccgacacccgaactcgaggaagagatgttcaaaaagcgcaacctgaccatcatggatcttcatcctggatccggcaaaacaagaaagtatctgcccgctattgtgcgggaagccatcaagcgcagactccggaccctgatcctcgcgcctacgagagttgtggccgctgagatggaggaagccctgaaagggcttcccattcgctaccagacaaccgctaccaagagcgagcacacaggacgggaaatcgtcgacctgatgtgccatgccacctttacaatgagactgctctctcctgtgcgcgttccgaattataacctgattatcatggatgaggcccacttcaccgaccccgctagcattgcggcccggggctacatctccacgagagtggggatgggagaagctgccgccatctttatgacagctacccctcccggcacagccgatgcgttccctcagtctaatgctcccattcaggacgaggagcgcgacatcccggaacggagctggaactccgggaatgagtggattaccgattttgccggcaaaacggtctggttcgtgccttctatcaaggccggaaacgacattgctaactgtcttcgcaaaaatggcaagaaggtgatccaactgagcagaaaaacctttgatacagaataccagaagaccaaactcaacgactgggatttcgtcgttacaaccgacatttccgagatgggggccaattttaaggcggatcgggtgatcgaccccagacggtgcctgaaacccgtgatcctgacagatggacctgagcgcgtcattctcgccggccccatgcctgtgaccgctgcctctgctgcccagagacgggggcgcgttggaagaaacccgcagaaggaaaatgaccaatatatcttcacgggccagccccttaacaatgatgaggaccatgctcactggacagaagccaagatgctgctggacaacattaatacccctgaggggatcattcccgccctcttcgaacctgagcgggagaaaagcgccgctatcgatggcgaatacagactgaagggagagtcccgcaaaacctttgtggaacttatgcggagaggcgacctgcccgtctggctcgcccacaaggtggctagcgaggggatcaaatatacagatcgcaagtggtgcttcgacggacagcggaacaatcagattctggaagagaacatggatgttgagatctggaccaaagaaggcgagaagaagaaactgagaccgcgctggctcgacgcccggacatactctgatcctcttgccctgaaggaatttaaagagttcgctgcggggagaaagtccattgccctggacctcgtgacggaaatcggacgcgtccccagccatctggctcacagaacccggaatgcccttgataacctggtgatgctccatacatctgagcacggcggccgcgcctatagacacgctgtcgaggaactgcctgagaccatggaaacactgctccttctggggctgatgattctcctgaccggaggcgccatgctttttctgatctccgggaaaggaatcggcaagacgagcattgggctcatctgtgtgattgcgtcctctggaatgctgtggatggccgagatccccctgcaatggattgctagcgccatcgttctcgagttctttatgatggtgcttctgattcctgaacccgagaagcagcggaccccgcaggacaatcaactggcttacgtggtcatcggcatcctcacactggccgcgattatcgccgctaacgaaatgggccttctggagaccacaaaacgcgatctcgggatgtccaaggaacctggagttgtgagccccacctcttatctggacgtggatctgcatcccgcctccgcttggacgctctacgccgtcgctacaaccgtgattacacctatgcttagacacaccatcgagaatagcaccgccaacgtttctctggcggccattgctaaccaggccgtggtcctgatgggcctcgacaaagggtggccgatcagcaagatggacctgggagtgccccttctggctctcggctgctactcccaggtcaatcctctgacactgacggccgccgtgctccttctgatcacccattatgcgattatcgggcccggactgcaggctaaagccacacgggaggctcaaaagagaaccgccgccggcattatgaagaaccctacagttgatggcatcatgaccattgacctcgatcccgtgatctacgactctaaattcgaaaagcagctggggcaggtcatgcttctggtgctctgtgctgttcagctgctgctcatgcgcacgagctgggccctttgcgaggcgctgacactggccaccggacctatcaccacactctgggaaggctccccggggaaattttggaataccacaattgctgtgtctatggccaacatcttccggggaagctatctggctggcgccgggcttgcgttttccattatgaaaagcgtcggaacgggcaaaagaggcaccgggtctcaaggagagacactgggcgaaaagtggaagaaaaagctcaatcagctgtcccgcaaagatttcgacctgtacaagaaaagcgggatcaccgaggtggatcggacagaggccaaggaaggactcaaaagaggcgagattacccaccatgctgtgtcccgggggtctgccaaacttcagtggtttgttgaacgcaacatggtcatccccgagggaagagtgattgacctgggctgtggcagagggggatggagctattactgcgctggcctgaagaaagtgacggaagtccgcgggtataccaagggaggccctgggcacgaggagcccgttcctatgtccacatacggatggaatatcgtgaaactcatgtctggcaaggatgtgttctacctgcccccggaaaaatgtgacacccttctgtgcgatatcggcgagagctcccctagccccacagtcgaagagtctagaaccattcgggtgctcaagatggttgagccctggctgaagaacaatcagttctgtatcaaagtgctgaacccttatatgcccacagtcattgaacacctcgagcgccttcaaagaaagcatgggggaatgctggtgcggaatcctctgtcccgcaacagcacccacgaaatgtactggatctctaatggcacggggaacattgttgcctccgtgaatatggtcagcagactcctgcttaaccggtttacaatgacccatagacgcccgaccatcgagaaagacgtggatctgggagctggcacacggcacgtgaacgccgaacccgagacgcctaatatggacgtcatcggggagagaattaagcgcatcaaagaagaacacaactctacctggcattatgacgatgaaaatccctacaagacatgggcgtatcacggaagctacgaggttaaggccaccggctccgcttctagcatgattaacggcgtggtgaaactcctgacaaagccttgggacgtcgtgcccatggttacccagatggccatgacagataccacgccgttcgggcagcaacgggtgtttaaagaaaaggtcgacaccagaacacctcgctccatgcccggaacccggagagtgatgggcatcacagctgagtggctgtggcgcaccctcgggcggaataaaaagcctagactgtgcacgcgcgaggagttcacaaagaaagttcggaccaacgccgccatgggagcggtgtttacagaggaaaatcagtgggatagcgctaaggccgccgtcgaggacgaagatttctggaaacttgtggacagagagcgcgagctgcataagctcggcaaatgtgggtcctgcgtttataacatgatgggcaagagagagaagaagctgggagagtttggcaaggctaaagggtctcgggccatttggtacatgtggcttggagctcgctacctggagttcgaggccctcggctttctgaatgaggatcactggttcagcagagaaaactcctattctggggtggagggagaaggcctgcataagctcgggtacatcctgcgggacatcagcaaaattcccggcggagcgatgtatgccgatgacaccgctggctgggacacgagaatcaccgaggatgaccttcacaatgaagagaagattacacagcagatggatcctgagcaccggcaactggccaacgctatctttaaactcacctaccagaataaggtcgtgaaggtccagcgccccacaccgaccgggacagtgatggacattatctccagaaaagatcagcggggatctggccaagttgggacctatggactgaacacgttcacaaatatggaagcccagcttatccgccagatggagggcgaaggggtgctgctcaaggcggacctggagaaccctcatctgcccgagaaaaagattacccagtggctcgagaccaaaggcgtcgagagactgaagcggatggccatcagcggagatgactgcgtggtgaagcccattgatgaccgctttgctaacgcccttctggctctcaatgatatgggcaaagttagaaaggacatccctcaatggcagccgtccaaagggtggcacgattggcaacaggtgcccttctgtagccatcacttccacgaactgattatgaaggacggacggaaacttgtcgtgccttgccgcccccaagacgagctgatcggcagagcccggatttctcagggggctggatggtccctcaaggaaacagcctgtctgggcaaggcgtacgcccagatgtggagcctgatgtattttcatcgcagagatctccggctggcttctaacgccatctgctccgccgttcctgtgcactgggtccccaccagccgcacaacgtggtctatccatgctcaccatcaatggatgaccacagaggacatgcttaccgtgtggaatagagtctggattgaagataacccttggatggaggacaaaacacccgtgaccacgtgggagaatgttccgtacctggggaagcgggaagatcagtggtgtggctccctcatcggactgaccagcagagccacatgggcgcagaacattcctaccgctatccagcaagtgcgctcccttattggcaatgaggagttcctggactacatgcccagcatgaaacggtttagaaaggaggaggaatctgagggggccatctggtga

SEQ ID NO: 20600 - RNA, 9873 nt, synthetic construct
  misc_feature 1..9873: note = derived and/or modified CDS sequence (opt5) from DENV-3__JF937638__SS-prME
  source 1..9873: mol_type = other RNA
acaagcctgtgcctgctgatgatccttcccgccgctctggccttccacctcacatccagagacggcgaacctcggatgattgtggggaagaacgaacgcggaaaatctctgctttttaagacggcgagcggcatcaatatgtgtaccctgattgctatggatctcggggaaatgtgcgacgatacagtgacctacaaatgtccgcatatcacagaagttgaacccgaagacattgattgctggtgtaacctgacctccacatgggtgacctatggaacgtgcaatcaggccggcgagcacagacgggacaagcgctctgtggccctggctcctcatgtcgggatgggactcgataccagaacacagacctggatgagcgccgagggcgcttggcggcaagtggaaaaagttgagacatgggccctgcgccaccccggcttcaccatccttgcgctgtttctcgcccattacatcgggacgtccctgacacagaaggtggtcattttcatccttctgatgctcgtgaccccttctatgacaatgagatgtgttggagtgggcaaccgggactttgtcgaagggctgagcggagctacctgggtggatgtggtcctggagcacggcgggtgcgttaccacaatggccaagaataaacccacgctcgacattgagctgcagaagaccgaagctacacagcttgccaccctgcgcaaactctgtatcgagggaaagattacaaacatcaccacggattccagatgccctacacagggcgaagcgaccctgccggaggaacaggaccagaattatgtgtgtaaacacacctacgtggatcggggctgggggaacggatgcggccttttcgggaagggaagcctggtcacatgcgccaagtttcagtgtctcgagcccattgagggcaaagtggttcagtatgaaaatctgaagtacaccgtgatcatcacagtccatacgggggaccagcaccaggtgggaaacgagacccaaggcgttacagctgaaattacccctcaggcctctacaaccgaggctatcctgcccgaatatggcacgctcgggctggagtgctcccctcgcaccggacttgacttcaatgagatgattctgctcacaatgaaaaacaaggcctggatggtgcatagacagtggtttttcgatctgccccttccgtggaccagcggcgccacaaccgaaacgcctacatggaatcggaaagagctgctcgtcacctttaagaacgctcacgcgaaaaagcaagaagtggtcgtgctggggtctcaggagggagccatgcacacagctctgaccggcgccaccgaaatccaaaattccgggggcacaagcattttcgccggacatctcaagtgtcgcctgaaaatggacaaacttgagctgaaaggcatgtcttacgctatgtgcacgaacacctttgttctcaagaaagaggtgtccgaaacacagcacgggaccatcctgatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgcccttaaaatcaattggtataagaagggatctagcattggcaaaatgtttgaagccacagctagaggggctagacgcatggctatcctcggagacaccgcctgggatttcggctccgtcgggggagttctgaacagcctgggcaagatggtccaccagatttttgggtctgcgtacaccgccctcttctccggcgtgagctgggtgatgaaaatcggaattggcgtcctgcttacatggatcgggctcaattctaagaacaccagcatgtccttttcttgcattgctatcggaatcattacactctatctgggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggcttgcgaccgccatcgctggcgcctgggagaatggagtttgtggcattagaagcacaacccgcatggaaaacctcctgtggaaacagatcgctaatgagctgaactatatcctctgggaaaataacattaagctgacggtggtcgtgggggacatcattggagttcttgagcagggcaaacggaccctgacacctcagcccatggagctcaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctgaaactgcgcgaagtttacacacagctttgtgaccaccggctcatgagcgcggccgtgaaggatgagagagctgtgcacgccgacatggggtactggattgagtcccagaaaaacggatcttggaagctggaaaaagccagcctgatcgaggtcaagacctgcacctggcctaagtcccatacactctggtctaatggcgtgctggaaagcgatatgattatccccaaatcccttgctgggcctattagccagcacaaccatcgccccggatatcacacccaaacggccggcccttggcacctggggaagctcgagctggactttaattactgcgagggaacaaccgttgtgatcacagaaaactgtggcacccggggcccctctctgagaacaaccacggtctccgggaaacttatccatgagtggtgctgtcgcagctgcaccctcccgcctctgcggtatatgggagaagatggctgttggtacgggatggagattagacccatctctgaaaaggaggagaatatggtgaaatccctggttagcgcgggatctggcaaggtggacaacttcacaatgggggtcctctgcctggctattctttttgaagaggtgatgcggggaaagttcggcaaaaagcacatgatcgccggcgttttctttaccttcgtgctgctcctgagcgggcagattacatggcgcgatatggcccataccctgatcatgattggatccaatgctagcgacagaatgggcatgggggtcacgtatcttgccctgatcgcgacatttaaaatccagcccttcctcgctctgggatttttcctccggagactgacctctcgcgaaaaccttctgctcggcgtggggctggccatggccacaaccctgcaacttcctgaggatattgaacagatggctaatggaatcgccctgggcctcatggctctgaagctcattacccagtttgagacataccagctgtggacggcccttatctccctgacctgtagcaacacaattttcaccctcacagtggcgtggcggaccgccacgctgatcctggctggcgtctcccttctgccggtttgcagatctagctccatgcgcaaaacagactggctccccatggccgtggctgccatgggggtgcctcccctgcctctctttatcttctctctgaaggatacccttaagagacggagctggcccctgaatgagggagtcatggccgtgggcctggtttccattctcgcttctagcctgcttcgcaacgacgtgcctatggcggggcccctggtcgccggaggcctcctgatcgcttgttatgtgattaccgggacatccgccgatctcaccgttgaaaaagccgctgacatcacatgggaggaagaggccgaacaaacgggagtgagccacaacctgatgattaccgtcgacgatgacggcacaatgagaatcaaggatgacgagaccgagaatatccttacagtgctgctgaaaaccgcgctcctgattgtctctggcatctttccgtactccattcctgctacgcttctggtgtggcatacctggcagaagcagacacagcggagcggggttctctgggatgtgccctctcctcccgaaacccaaaaagccgagctggaagagggagtctaccgcatcaagcagcagggcattttcgggaaaacacaggtgggagttggcgtgcaaaaggagggggtctttcacaccatgtggcacgtgacaagaggagccgtgctcacgtataacggcaagcggctggaaccgaattgggcttccgttaaaaaggaccttatcagctacggcgggggatggcgcctgtctgcccagtggcagaaaggcgaggaagtccaagtgattgcggtggagcctgggaagaaccccaaaaatttccagaccatgcctggaacattccagaccaccacaggcgaaatcggggctatcgccctggattttaagcccggaacgtccggcagccccattatcaacagagagggcaaggtcgtggggctctatggaaatggcgttgtgaccaaaaacgggggatacgtctccggcattgcccagacaaatgctgagcctgacgggccgacccccgaactggaggaagagatgttcaagaaacggaaccttacaatcatggatctgcatcctggcagcggaaagacccgcaaatatctccccgccattgtgagagaagctatcaagcggagactgcgcacgctcatcctggcccctacacgggttgtggcggccgagatggaggaagctcttaagggcctgcccattagataccaaaccaccgccacaaaatctgagcacaccgggcgcgaaatcgtcgacctgatgtgccatgctacatttaccatgcggctcctgagccctgtgagagttccgaattataaccttattatcatggatgaggcccacttcacggaccccgcctccattgctgcgcgcggatacatctctacacgggtgggcatgggggaagccgctgccatctttatgaccgccacacctcccggaaccgctgatgccttccctcagagcaatgcgcccattcaggacgaggagagagacatcccggaacgctcctggaactctggcaatgagtggattacggattttgctgggaagaccgtctggttcgtgcctagcatcaaagccggcaacgacattgccaactgtctgcggaagaatggcaaaaaggtgatccagctctccagaaagacatttgataccgaataccagaagacgaagctgaacgactgggatttcgtcgttaccacagacatttctgagatgggagctaattttaaagccgatcgggtgatcgacccccgcagatgcctgaagcccgtgatcctcaccgatgggcctgagcgggtcattcttgcgggacccatgcctgtgacggccgctagcgccgctcagcgcagaggccgggttgggagaaacccgcagaaagaaaatgaccagtatatcttcacaggacaacccctgaacaatgatgaggaccatgcccactggaccgaagctaagatgctgctcgacaacattaatacccctgagggcatcattcccgccctgttcgaacctgagcgcgagaagtccgcggccatcgatggggaataccggcttaaaggcgagagcagaaagacatttgtggaactgatgcgccggggagacctccccgtctggctggctcacaaagtggcctctgagggcatcaagtataccgatagaaaatggtgcttcgacgggcagcgcaacaatcagattctggaagagaacatggatgttgagatctggacaaaggaaggagagaaaaagaagctccggccgagatggcttgacgctcgcacgtactccgatcctctggccctgaaagaatttaaggagttcgccgctggcagaaaaagcattgcgctcgacctggtgaccgaaatcgggcgggtcccctctcatcttgcccaccgcacaagaaatgctctggataacctcgtgatgctgcatacctccgagcacggaggccgggcctatcgccacgccgtcgaggaactgcctgagacaatggaaaccctccttctgctgggcctcatgattctgcttacagggggagctatgctgtttctcatcagcggcaaggggatcggaaaaacctccattggcctgatctgtgtgattgcctctagcgggatgctgtggatggcggagatccccctccagtggattgcctccgctatcgttcttgagttctttatgatggtgctgctgattcctgaacccgagaagcaaagaacaccgcaggacaatcagctcgcctacgtggtcatcggaatcctgacccttgctgccattatcgcggccaacgaaatgggcctgctcgagacaaccaagcgggatctgggcatgagcaaagaacctggggttgtgtctcccacgtcctatctggacgtggatctccatcccgctagcgcctggacactttacgctgtcgccaccacagtgattacccctatgctgagacacaccatcgaaaattctacagctaacgttagcctggccgcgattgccaaccaagctgtggtcctcatgggactggacaagggctggccgatctccaaaatggaccttggggtgcccctgctcgccctgggatgctactctcaggtcaatcctctgacgctcaccgctgccgtgcttctgctgatcacacattatgccattatcggccccgggctccaggcgaaggctacccgcgaggcccagaaacggacagctgccggaattatgaagaaccctaccgttgatggcatcatgacgattgacctggatcccgtgatctacgacagcaagttcgaaaaacaacttggccaggtcatgctgctcgtgctgtgtgccgttcagctgctccttatgagaacatcctgggctctgtgcgaggccctgaccctcgcgaccgggcctatcacaaccctgtgggaaggatctccgggcaagttttggaatacaacgattgccgtgagcatggctaacatcttccgcgggtcctatcttgccggagctggcctggcctttagcattatgaaatctgtcgggaccggaaagcggggcacaggctcccagggggagaccctcggagaaaaatggaagagaaagctgaatcaactgagccggaaagatttcgacctctacaagaaatccggcatcacagaggtggatcgcaccgaggcgaaggaagggcttaaaagaggagagattacgcaccatgccgtgtctcggggcagcgctaagctgcagtggtttgttgaacgcaacatggtcacccccgaggggagagtgatcgacctgggatgtggccggggcgggtggtcctattactgcgccggactcaaaaaggtgacagaagtccgcggctataccaaagggggacctggccacgaggagcccgttcctatgtctacatacgggtggaatattgtgaaactgatgagcggaaaggatgtgttctaccttcccccggaaaaatgtgacaccctgctctgcgatatcggcgagtccagcccttctcccacagtcgaagagtccagaaccatccgggtgctgaagatggttgagccctggctgaaaaacaatcagttctgtattaaggtgctcaacccttatatgcccacggtcatcgaacaccttgagcgcctgcagagaaagcatggcgggatgctggtgcggaatcctctcagcagaaactctacacacgaaatgtactggatttccaatggaaccggcaacatcgttgctagcgtgaatatggtctctcgcctgcttctgaaccggtttaccatgacacatagacgcccgacgattgagaaagacgtggatctcggggccggaacccggcacgtgaacgctgaacccgagacacctaatatggacgtcatcggcgagagaatcaagcgcattaaagaagaacacaacctgacctggcattatgacgatgaaaatccctacaagacatgggcctatcacgggagctacgaggttaaagcgaccggatccgcctctagcatgatcaacggcgtggtgaagctgctcacaaagccttgggacgtcgtgcccatggttacccaaatggctatgacggataccacaccgttcggccagcagcgggtgtttaaagaaaaggtcgacaccagaacacctcgctccatgcccgggacccggagagtgatgggaattacggccgagtggctgtggcgcacacttggccggaataaaaagcctagactgtgcacccgcgaggagttcaccaagaaggttagaaccaacgctgccatgggggccgtgtttacggaggaaaatcaatgggatagcgcgaaggctgccgtcgaggacgaagatttctggaaactcgtggaccgggagcgcgagctgcataaacttggaaaatgtggctcctgcgtttataacatgatggggaagagagagaagaagctgggcgagtttggaaaagccaagggctctcgggctatctggtacatgtggctcggggccagatacctggagttcgaggctctgggatttctcaatgaggatcactggttcagccgggaaaactcctattctggcgtggagggggaaggactgcataaacttggctacattctgcgcgacatcagcaaaatccccgggggcgccatgtatgcggatgacaccgccggatgggacacaagaattaccgaggatgacctccacaatgaagagaagatcacacagcagatggatcctgagcaccggcagctggctaacgccatttttaaacttacctaccaaaataaggtcgtgaaagtccagcgccccacaccgaccggcacggtgatggacatcatttccagaaaggatcagcgggggtctggacaggttggcacatatgggctgaacaccttcaccaatatggaagctcaaatcatccgccagatggagggagaaggcgtgctcagcaaggccgacctggagaaccctcatctgcccgagaagaagattacacagtggctcgagaccaaaggggtcgagagactgaagcggatggcgatctccggcgatgactgcgtggtgaaacccattgatgaccgctttgccaacgcccttctggccctcaatgatatgggaaaggttagaaaggacatccctcagtggcaaccgagcaaaggctggcacgattggcaacaggtgcccttctgttctcatcacttccacgaactgattatgaaggacgggcggaaacttgtcgtgccttgccgcccccaggacgagctgatcggacgggctcggatttcccaaggcgccgggtggagcctcaaggaaacagcttgtctgggaaaagcctacgcgcagatgtggtctctgatgtattttcatcgcagagatctccggctggcctccaacgctatctgcagcgccgttcctgtgcactgggtccccacgtctagaaccacatggtccatccatgcccaccatcagtggatgaccacagaggacatgcttaccgtgtggaatcgcgtctggattgaagataacccttggatggaggacaagacgcccgtgaccacatgggagaatgttccgtacctgggcaagcgggaagatcaatggtgtgggagcctcatcggcctgacctccagagctacatgggcccagaacattcctaccgcgatccaacaggtgcgcagccttattggaaatgaggagttcctggactacatgccctctatgaaacggtttagaaaggaggaggaaagcgagggcgctatctggtga

SEQ ID NO: 20601 - RNA, 9873 nt, synthetic construct
  misc_feature 1..9873: note = derived and/or modified CDS sequence (opt5) from DENV-3__JF937639__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgccccctgtaaaattcctttcagcacagaggacggccaagggaaggcgcataacggaagactgatcaccgctaatcccgtggttacgaaaaaggaggaacccgtgaacattgaggccgaacctccgttcggcgagtccaatatcgtcattgggatcggcgataacgccctgaaaatcaattggtataagaagggatctagcattggcaaaatgtttgaagctacagcccggggggctagacgcatggccatccttggagacaccgcgtgggatttcggctccgtggggggagtgctcaacagcctgggcaagatggttcaccagatttttgggtctgcctacaccgctctgttctccggcgtcagctgggtgatgaaaatcggaattggcgtgctcctgacatggatcgggcttaattctcggaacaccagcatgtccttttcttgcattgccatcggaatcattacactgtatctcggcgctgtcgtgcaggccgacatggggtgtgttatcaattggaagggaaaagagctgaagtgcggcagcgggattttcgtgacgaacgaggtccatacctggacagaacagtacaagtttcaagcggattcccccaaaagactggccaccgctatcgccggcgcttgggagaatggagtgtgtggcattcgcagcacaacccggatggaaaaccttctctggaagcagatcgccaatgagctgaactatatcctgtgggaaaataacattaaactcacggttgtggtcggggacatcattggagtgctggagcagggcaagagaacccttacacctcagcccatggagctgaaatactcttggaagacctgggggaaagccaagatcgttacagctgaaacccaaaactccagcttcattatcgatggacctaatacacccgagtgcccgtctgtgtcccgcgcgtggaacgtctgggaagtggaggactatggctttggcgtgttcaccacgaatatctggctcaagctgcgggaagcctacacacagctgtgtgaccacagacttatgagcgctgccgtcaaagatgagcgcgccgttcacgctgacatggggtactggattgagtcccagaagaacggatcttggaaactcgaaaaggccagcctgatcgaggtgaaaacctgcacctggcctaagtcccatacaatttggtctaatggcgtgctggaaagcgatatgatcattcccaagtccctcgcggggcctatcagccagcacaaccatcggcccggatatcacacccaaacggctggcccttggcacctggggaaacttgagctggactttaattactgcgagggaacaaccgtcgtgatcacagaaaactgtggcaccagaggcccctctctccgcacaaccacggtttccgggaagctgattcatgagtggtgctgtcggagctgcaccctgccgcctcttagatatatgggagaagatggctgttggtacgggatggagatccggcccatttctgaaaaagaggagaatatggtgaagtccctcgtcagcgccggatctggcaaagtggacaacttcacaatgggggttctgtgcctggccatcctctttgaagaggtgatgcgcggaaagttcggcaagaaacacatgattgctggcgtcttcctgacctttgtgcttctgctcagcgggcagatcacatggagagatatggcccataccctgattatgatcggatccaatgcgagcgaccggatgggcatgggggttacgtatctggctcttatcgccacattcaagattcagccctttctggccctcggattctttctgagaaaactcacctctcgcgaaaacctgcttctgggcgtggggctcgctatggccacaaccctgcaactgcctgaggatatcgaacagatggctaatggaattgcccttggcctgatggcgctcaagctgatcacccagttcgagacataccagctctggacggccctgatttcccttacctgtagcaacacaatctttaccctgacagtcgcttggcggaccgccacgctcatcctggctggcgtgtccctgcttccggtgtgccaatctagctccatgagaaaaacagactggctgcccatggccgtcgccgctatgggggttcctcccctccctctgttcattttttctctcaaggataccctgaagcgcagaagctggccccttaatgagggagtgatggcggtgggcctggtctccatcctggcctctagcctcctgcggaacgacgtgcctatggctgggccccttgttgccggaggcctgctcattgcctgttatgtgatcaccgggacatccgctgatctgaccgtcgaaaaagccgcggacattacatgggaggaagaggctgaacagacgggagtgagccacaacctcatgatcaccgttgacgatgacggcacaatgcgcatcaaggatgacgagaccgagaatattctgacagtgcttctgaaaaccgccctgctcatcgtctctggcattttcccgtactccatccctgccacgctgcttgtgtggcatacctggcagaagcagacaaaaagaagcggggtcctgtgggatgtgccctctcctcccgaaacccaaaaggctgagctcgaagagggagtttaccggattaaacagcagggcatctttgggaagacacaggtgggagtcggcgtgcaaaaggagggggttttccacaccatgtggcacgtgacacgcggagccgtcctgacgtataacggcaaaagactcgaaccgaattgggcgtccgtgaagaaagacctgattagctacggcgggggatggcggctttctgctcagtggcagaagggcgaggaagtgcaagttatcgccgtcgagcctgggaaaaaccccaagaattttcagaccatgcctggaacattccagaccaccacaggcgaaatcggggccattgctctggatttcaagcccggaacgtccggcagccccatcattaaccgcgagggcaaagtggtggggctgtatggaaatggcgtcgtgaccaagaacgggggatacgtttccggcatcgcccagacaaatgctgagcctgacgggccgacccccgaactcgaggaagagatgtttaaaaagagaaacctgacaattatggatcttcatcctggcagcggaaaaacccggaagtatctgcccgccatcgtgcgcgaagcgatcaagagacggctcagaacgctgattctcgcccctacacgcgtcgtggctgccgagatggaggaagctctgaaaggccttcccatccggtaccaaaccaccgccacaaagtctgagcacaccgggagagaaattgttgacctgatgtgccatgccacattcaccatgcgcctgctcagccctgtgcgggtcccgaattataacctgatcattatggatgaggctcactttacggaccccgcgtccatcgccgctagaggatacatctctacacgcgtgggcatgggggaagccgccgctattttcatgaccgccacacctcccggaaccgcggatgcttttcctcagagcaatgcccccatccaggacgaggagcgggacattccggaaagatcctggaactctggcaatgagtggatcacggatttcgccgggaaaaccgtttggtttgtgcctagcattaaggctggcaacgacatcgccaactgtcttcgcaaaaatggaaagaaggtcattcagctgtcccggaaaacattcgataccgaataccaaaagacaaaactcaacgactgggattttgtggtgaccacagacatctctgagatgggcgcgaatttcaaggccgatagagtcatcgacccccggcgctgcctgaaacccgttattctgaccgatgggcctgagagagtgatcctcgctggacccatgcctgtgacggccgctagcgccgctcagcggcgcggcagagtcgggcggaacccgcagaaggaaaatgaccagtatatttttacaggacaaccccttaacaatgatgaggaccatgcccactggaccgaagcgaagatgctgctggacaacatcaatacccctgagggcattatccccgccctcttcgaacctgagagagagaaatccgctgccatcgatggggaataccgcctgaagggcgagagccggaaaacattcgtggaacttatgagacgcggagacctgcccgtttggctcgctcacaaggtggcctctgagggcattaaatataccgatcggaagtggtgctttgacgggcagagaaacaatcagatcctggaagagaacatggatgtcgagatttggacaaaagaaggagagaagaagaaactgcgcccgcggtggctcgacgccagaacgtactccgatcctcttgctctgaaggaattcaaagagtttgcggccggccgcaagagcatcgctctggacctcgtgaccgaaattgggagagttccctctcatctggcccaccggacacgcaatgcccttgataacctggtgatgctccatacctccgagcacggaggcagagcttatcggcacgccgtcgaggaactgcctgagacaatggaaaccctgctccttctgggcctgatgatcctcctgacggggggagcgatgcttttcctgatcagcggcaaagggattggaaagacctccatcggcctcatttgtgtgatcgcctctagcgggatgctgtggatggctgagattcccctgcagtggatcgcctccgctattgtcctcgagtttttcatgatggtgcttctgatccctgaacccgagaagcaacgcacaccgcaggacaatcagctggcctacgttgtgatcggaattctcaccctggcggccatcattgctgccaacgaaatgggccttctggagacaaccaaaagagatctcggcatgagcaaggaacctggggtggtctctcccacgtcctatctggacgttgatctgcatcccgctagcgcctggacactctacgctgtggccaccacagtgatcacccctatgcttcggcacaccattgagaattctacagcgaacgtcagcctggccgctatcgccaaccaagctgtggttctgatgggactcgacaaaggctggccgatctccaagatggacctgggggtgccccttctggccctcggatgctactctcaggtcaatcctctgacgctgaccgccgcggtgctccttctgattacacattatgctatcattggccccgggctgcaggccaaagctaccagagaggcccagaagcgcacagccgctggaatcatgaagaaccctaccgtcgatggcattatgacgatcgacctcgatcccgtgatctacgacagcaaatttgaaaagcaactgggccaggttatgcttctggtgctctgtgccgtccagctgctgctcatgcggacatcctgggcgctttgcgaggccctgaccctggctaccgggcctattacaaccctctgggaaggatctccgggcaaattctggaatacaacgatcgccgtgagcatggctaacatttttagagggtcctatctggccggagcgggccttgccttcagcatcatgaagtctgttgggaccggaaaacgcggcacaggctcccagggggagaccctgggagaaaagtggaagaaaaagctcaatcaactgagccggaaagattttgacctgtacaagaaatccggcattacagaggtggatagaaccgaggctaaggaagggctcaaacggggagagatcacgcaccatgccgtctctcgcggcagcgctaagcttcagtggttcgtggaaagaaacatggtgattcccgaggggcgggttatcgacctgggatgtggccgcggcgggtggtcctattactgcgccggactgaagaaagtcaccgaagtgagaggctatacaaaggggggacctggccacgaggagcccgtgcctatgtctacctacgggtggaatatcgtcaaactcatgagcggaaaggatgttttttacctgcccccggaaaaatgtgacacacttctgtgcgatattggcgagtccagcccttctcccaccgtggaagagtcccggacaatccgcgtgctcaagatggtcgagccctggctgaagaacaatcagttctgtattaaagtgctgaacccttatatgcccaccgttatcgaacacctcgagagacttcagcggaagcatggcgggatgctggtgcgcaatcctctgagcagaaactctacgcacgaaatgtactggatttccaatggaacaggcaacatcgtcgctagcgtgaatatggtttctcggctcctgcttaacagattcaccatgacccatcgccggccgacaatcgagaaagacgtggatctgggggccggaacgagacacgtcaacgcggaacccgagacccctaatatggacgtgattggcgagcgcatcaagcggattaaagaagagcacaacagcacatggcattatgacgatgaaaatccctacaagacctgggcctatcacgggtcctacgaggtgaaggctacaggatctgccagctccatgatcaacggcgtcgttaaactcctgaccaagccttgggacgtggtgcccatggtcacacaaatggctatgaccgatacgaccccgtttggccagcagagagtgttcaaagaaaaggttgacacacgcacccctcggagcatgcccgggacaagacgcgtgatgggaattaccgccgagtggctgtggcggacgctcggcagaaataaaaagcctcgcctgtgcacacgggaggaatttaccaagaaagtcagaacaaacgccgcgatgggggctgtgttcaccgaggaaaatcaatgggattccgccaaggccgctgttgaggacgaagatttttggaaacttgtggaccgcgagagagagctgcataagctcggaaaatgtggctcttgcgtctataacatgatggggaagcgggaaaaaaagctgggcgagttcggaaaggccaaaggcagccgcgctatctggtacatgtggcttggggccagatacctggaatttgaggcgctcggattcctgaatgaggatcactggttttcccgggaaaactcttatagcggcgtggagggggaaggactgcataagctcggctacatcctgagagacatttccaaaatccccgggggcgccatgtatgctgatgacacggccggatgggacacccggattacagaggatgaccttcacaatgaagagaagatcacccagcagatggatcctgagcaccgccagctggctaacgccattttcaaactcacataccaaaataaggttgtgaaggtccagagacccaccccgacaggcaccgtgatggacatcatctctcggaaagatcagcgcgggagcggacaggtcggcacgtatgggctgaacacatttaccaatatggaagcgcaacttattagacagatggagggagaaggcgtgctgtccaaggccgacctcgagaaccctcatctgcccgaaaaaaagatcacccagtggctggagacaaaaggggttgagcggctcaagcgcatggctattagcggcgatgactgcgtggtcaagcccatcgatgacagattcgccaacgctctgcttgccctgaatgatatgggaaaagtgcggaaggacattcctcagtggcaaccgtctaaaggctggcacgattggcagcaggtgcccttttgttcccatcacttccacgaactcatcatgaaggacgggcgcaaactggttgtgccttgcagaccccaggacgagcttattggacgggctcgcatcagccaaggcgccgggtggtctctgaaggaaaccgcgtgtctcggaaaggcctacgctcagatgtggtccctgatgtatttccatagacgggatctgcgcctcgccagcaacgccatctgctctgctgtccctgtgcactgggttcccacatccagaacgacctggagcattcatgcccaccatcagtggatgacaaccgaggacatgctgacagtgtggaatcgggtctggatcgaagataacccttggatggaggacaaaacccccgtgacgacctgggagaatgtcccgtaccttggcaagagagaagatcaatggtgtgggtccctgattggcctcacaagccgcgcgacctgggctcagaacatccctacagccattcagcaggtgcggtctctgatcggaaatgaggaatttcttgactacatgcccagcatgaaaagattccgcaaggaggaggaatccgagggcgccatctggtga

SEQ ID NO: 20602 - RNA, 9873 nt, synthetic construct
  misc_feature 1..9873: note = derived and/or modified CDS sequence (opt5) from DENV-3__JF937627__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccagaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaacgggaggaacccgtcaacattgaggctgaacctccgttcggcgagtccaatatcgtgattgggatcggcgataacgccctgaagatcaattggtacaaaaagggatctagcattggcaagatgtttgaagccacagctagaggggcccgccggatggctatccttggagacaccgcctgggatttcggctccgtggggggagttctcaacagcctgggcaaaatggtccatcagatttttgggtctgcgtataccgccctgttctccggcgtgagctgggtgatgaagatcggaattggcgtcctcctgacatggatcgggcttaattctaaaaacaccagcatgtccttttcttgcattgctatcggaatcattacactgtacctcggcgccgtggttcaggctgacatggggtgtgtgatcaattggaagggaaaagagctgaagtgcggcagcgggattttcgtcacgaacgaggtgcacacctggacagaacagtataagtttcaagccgattcccccaaaagactggcgaccgccatcgctggcgcctgggagaatggagtttgtggcattcgcagcacaacccggatggaaaaccttctctggaagcagatcgctaatgagctgaactacatcctgtgggaaaataacattaaactcacggtggtcgtgggggacatcattggagttctggagcagggcaagagaacccttacacctcagcccatggagctgaaatattcttggaagacctgggggaaagccaagatcgtgacagccgaaacccaaaactccagcttcattatcgatggacctaatacacccgagtgcccgtctgtctcccgcgcttggaacgtgtgggaagtggaggactacggctttggcgtcttcaccacgaatatctggctcaagctgcgggaagtttatacacagctgtgtgaccacagacttatgagcgcggccgtgaaagatgagcgcgctgtgcatgccgacatggggtactggattgagtcccagaagaacggatcttggaaactcgaaaaggccagcctgatcgaggtcaaaacctgcacctggcctaagtcccacacactgtggtctaatggcgtgctcgaaagcgatatgattatccccaagtccctggctgggcctattagccagcataaccaccggcccggataccacacccaaacggccggcccttggcatcttgggaaactggagctcgactttaattattgcgagggaacaaccgttgtgatcacagaaaactgtggcaccagaggcccctctctgcgcacaaccacggtctccgggaagctgatccacgagtggtgctgtcggagctgcacccttccgcctctcagatacatgggagaagatggctgttggtatgggatggagattcggcccatctctgaaaaagaggagaatatggtgaagtccctggttagcgcgggatctggcaaagtggacaacttcacaatgggggtcctgtgcctcgctattctgtttgaagaggtgatgcgcggaaagttcggcaagaaacatatgatcgccggcgttttctttaccttcgtgcttctgctcagcgggcagattacatggagagatatggcccacaccctgatcatgattggatccaatgctagcgaccggatgggcatgggggtcacgtacctggcccttatcgcgacatttaagatccagcccttcctggctctcggatttttcctgagaaaactcacctctcgcgaaaacctgcttctgggcgtggggctcgccatggccacaaccctgcaactgcctgaggatattgaacagatggctaatggaatcgcccttggcctgatggctctcaagctgattacccagtttgagatctatcagctctggacagccctgatttcccttacgtgtagcaacaccatcttcacactgaccgtggcgtggcggacagccaccctcatcctggctggcgtctccctgcttccgatgtgccaatctagctccatgagaaaaacggactggctgcccatggccgttgctgccatgggggtgcctcccctccctctgtttattttctctctcaaggatacactgaagcgcagaagctggccccttaatgagggagtgatggccgtcggcctggtgtccatcctggcttctagcctcctgcggaacgacgttcctatggcggggccccttgtggccggaggcctgctcattgcttgttacgtcatcaccgggacctccgccgatctgacagtggaaaaagccgctgacattacctgggaggaagaggccgaacagacaggagttagccataacctcatgatcacggtggacgatgacggcaccatgcgcatcaaggatgacgagacagagaatattctgaccgtccttctgaaaacagcgctgctcatcgtgtctggcatttttccgtattccatccctgctaccctgcttgtctggcacacgtggcagaagcagacccaaagaagcggggtgctgtgggatgttccctctcctcccgaaacacagaaagccgagctcgaagagggagtgtaccggattaagcagcagggcatcttcgggaaaacccaagtcggagtgggcgttcagaaggagggggtgtttcacacaatgtggcatgtcacccgcggagccgtgctgacatacaacggcaagagactcgaaccgaattgggcttccgtgaaaaaggacctgattagctatggcgggggatggcggctttctgcccagtggcaaaaaggcgaggaagttcaggtcatcgcggtggagcctgggaagaaccccaaaaatttccagacgatgcctggaaccttccagacaaccaccggcgaaatcggggctattgccctggattttaagcccggaacatccggcagccccatcattaaccgcgagggcaaggtggtcgggctgtacggaaatggcgtggttacgaaaaacgggggatatgtgtccggcatcgcccaaaccaatgctgagcctgacgggccgacacccgaactcgaggaagagatgttcaagaaaagaaacctgaccattatggatcttcaccctggcagcggaaagacacggaaatacctgcccgccatcgtccgcgaagctatcaagagacggctcagaaccctgattctcgcccctacgcgcgtggttgcggccgagatggaggaagctctgaagggccttcccatccggtatcagacaaccgccaccaaatctgagcatacagggagagaaattgtggacctgatgtgccacgctacctttacaatgcgcctgctcagccctgtccgggtgccgaattacaacctgatcattatggatgaggcccatttcaccgaccccgcctccatcgctgcgagaggatatatctctacgcgcgttggcatgggggaagccgctgccatttttatgacagccacccctcccggaacagctgatgccttccctcagagcaatgcgcccatccaggacgaggagcgggacattccggaaagatcctggaactctggcaatgagtggatcaccgattttgctgggaagacggtgtggttcgtccctagcattaaagccggcaacgacatcgccaactgtcttcgcaagaatggaaaaaaggtgattcaactgtcccggaagacctttgatacagaataccagaaaaccaagctcaacgactgggatttcgtggtcacaaccgacatctctgagatgggcgctaattttaaagccgatagagttatcgacccccggcgctgcctgaagcccgtgattctgacagatgggcctgagagagtgatcctcgcgggacccatgcctgtcaccgccgctagcgccgctcagcggcgcggcagagtggggcggaacccgcagaaagaaaatgaccaatacattttcacgggacagccccttaacaatgatgaggaccacgcccactggacagaagctaagatgctgctggacaacatcaatacccctgagggcattatccccgccctcttcgaacctgagagagagaagtccgcggccatcgatggggaatatcgcctgaaaggcgagagccggaagacctttgttgaacttatgagacgcggagacctgcccgtgtggctcgctcataaagtcgcctctgagggcattaagtacacagatcggaaatggtgcttcgacgggcagagaaacaatcagatcctggaagagaacatggatgtggagatttggaccaaggaaggagagaaaaagaagctgcgcccgcggtggctcgacgctagaacatattccgatcctcttgccctgaaagaatttaaggagttcgccgctggccgcaaaagcatcgcgctggacctcgttacggaaattgggagagtgccctctcacctggcccatcggacccgcaatgctcttgataacctggtcatgctccacacatccgagcacggaggcagagcctaccggcatgccgtggaggaactgcctgagaccatggaaacactgctccttctgggcctgatgatcctcctgaccgggggagctatgctttttctgatcagcggcaaggggattggaaaaacgtccatcggcctcatttgtgtcatcgcctctagcgggatgctgtggatggcggagattcccctgcaatggatcgcctccgctattgtgctcgagttctttatgatggttcttctgatccctgaacccgagaagcagcgcaccccgcaggacaatcaactggcctatgtggtgatcggaattctcacactggctgccatcattgcggccaacgaaatgggccttctggagaccacaaagagagatctcggcatgagcaaagaacctggggtcgtttctcccacctcctacctggacgtggatctgcaccccgctagcgcctggacgctctatgctgtggccacaaccgtcatcacacctatgcttcggcataccattgagaattctaccgctaacgtgagcctggccgcgatcgccaaccaggctgttgtgctgatgggactcgacaagggctggccgatctccaaaatggacctgggggtcccccttctggccctcggatgctactctcaggtgaatcctctgacactgacggctgccgtcctccttctgattacccactacgccatcattggccccgggctgcaggcgaaggctacaagagaggcccaaaaacgcaccgctgccggaatcatgaagaaccctacagtggatggcattatgaccatcgacctcgatcccgttatctatgacagcaagttcgaaaaacagctgggccaggtgatgcttctggtcctctgtgtggttcagctgctgctcatgcggacgtcctgggccctttgcgaggctctgacactggccaccgggcctattaccacactctgggaaggatctccgggcaagttttggaataccacaatcgcggtgagcatggccaacattttcagagggtcctacctggctggagccggccttgcttttagcatcatgaaatctgtcgggacgggaaagcgcggcaccggctcccaaggggagacactgggagaaaaatggaagaagaaactcaatcagctgagccggaaggatttcgacctgtataaaaagtccggcattaccgaggtggatagaacagaggccaaagaagggctcaagcggggagagatcacccatcacgcggtgtctcgcggcagcgccaaacttcagtggtttgttgaaagaaacatggtcattcccgaggggcgggtgatcgacctgggatgtggccgcggcgggtggtcctactattgcgctggactgaagaaggtgacggaagtcagaggctacaccaaagggggacctggccacgaggagcccgttcctatgtctacatatgggtggaatatcgtgaagctcatgagcggaaaagatgtgttctacctgcccccggaaaagtgtgacacccttctgtgcgatattggcgagtccagcccttctcccacagtcgaagagtcccggaccatccgcgtgctcaaaatggttgagccctggctgaagaacaatcagttctgtattaaggtgctgaacccttacatgcccacagtcatcgaacatctcgagagacttcaacggaaacacggcgggatgctggtgcgcaatcctctgagcagaaactctacccatgaaatgtattggatttccaatggaacgggcaacatcgttgccagcgtgaatatggtctctcggctcctgcttaacagatttacaatgacccaccgccggccgaccatcgagaaggacgtggatctgggggctggaacaagacacgtgaacgccgaacccgagacgcctaatatggacattatcggcgagcgcattaaacggatcaaggaagagcataacagcacctggcactacgacgatgaaaatccctataaaacatgggcttaccatgggtcctatgaggtcaaggccaccggatctgcgagctccatgattaacggcgttgtgaagctcctgacaaaaccttgggacgtggtccccatggtgacccagatggccatgacagataccacgccgttcggccagcaaagagtttttaaggaaaaagtggacacccgcacacctcggagcatgcccgggaccagacgcgtcatgggaatcacagctgagtggctgtggcggaccctcggcagaaataagaaacctcgcctgtgcacgcgggaggaattcacaaagaaggtgagaaccaacgccgctatgggggccgtttttacagaggaaaatcagtgggattccgccaaagcggctgtggaggacgaagatttctggaagcttgtcaacaaagagcgcgagctgcacaagctcggaaaatgtggctcttgcgtgtacaatatgatggggaagagagaaaaaaagctgggcgagtttggaaaggccaaaggcagccgggccatctggtatatgtggcttggggctcgctacctggaattcgaggccctcggatttctgaacgaggaccattggttctccagagaaaattcttacagcggcgttgagggggaaggactgcacaagctcggctatattctgcgggatatctccaaaattcccgggggcgctatgtacgccgacgataccgcgggatgggacacgagaatcaccgaggacgatcttcacaacgaagagaagattacacagcagatggaccctgagcatcggcaactggccaatgctatctttaaactcacctatcagaacaaggtggtcaaggtgcagcgccccacaccgaccggcacagtcatggatatcatttctagaaaagaccagcgggggagcggacaagtgggcacctacgggctgaatacgttcacaaacatggaagcccagcttatccgccagatggagggagaaggcgttctgtccaaggctgatctcgagaaccctcacctgcccgaaaaaaagattacccagtggctggagaccaaaggggtggagagactcaagcggatggccatcagcggcgacgattgcgtcgtgaagcccattgacgatcgctttgcgaatgccctgcttgctctgaacgacatgggaaaagtgagaaaggatatccctcaatggcagccgtctaaaggctggcatgactggcagcaggttcccttctgttcccaccacttccatgaactcattatgaaggatgggcggaaactggtggtcccttgccgcccccaagacgagcttatcggaagagcccggatcagccagggcgctgggtggtctctgaaggaaacagcctgtctcggaaaggcttatgcccagatgtggtccctgatgtactttcaccgcagagacctgcggctcgcgagcaatgccatttgctctgctgtgcctgttcattgggtgcccacctcccgcacaacgtggagcatccacgcccatcaccaatggatgaccacagaggatatgctgaccgtctggaacagagtgtggattgaagacaatccttggatggaggataaaacacccgtcaccacgtgggagaacgtgccgtatcttggcaagcgggaagaccagtggtgtgggtccctgatcggcctcaccagcagagccacatgggctcagaatattcctaccgccatccagcaagttcgctctctgatcggaaacgaggaattccttgattacatgcccagcatgaaacggtttagaaaggaggaggaatccgagggcgcgatttggtga

SEQ ID NO: 20603 - RNA, 9873 nt, synthetic construct
  misc_feature 1..9873: note = derived and/or modified CDS sequence (opt5) from DENV-3__KF973476__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcggcggggttctcaacagcctggggaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatattggagaagatggctgttggtacgggatggagatcagacccatttctgaaaaggaggagaatatggtgaaatccctggttagcgcgggatctggcaaggtggacaacttcacaatgggggtcctgtgcctcgctatcctgtttgaagaggtgatgcggggaaagttcggcaaaaagcacatgattgccggcgttttctttaccttcgtgcttctgctcagcgggcagatcacatggcgcgatatggcccataccctgattatgatcggatccaatgctagcgacagaatgggcatgggggtcacgtatctggcccttatcgcgacatttaaaattcagcccttcctggctctcggatttttcctgcggagactcacctctcgcgaaaacctgcttctgggcgtggggctcgccatggccacaaccctgcaactgcctgaggatatcgaacagatggctaatggaattgcccttggcctgatggctctcaagctgatcacccagtttgagacataccagctctggacggccctgatttcccttacctgtagcaacacaatcttcaccctgacagtggcgtggcggaccgccacgctcatcctggctggcgtctccctgcttccggtttgccaatctagctccatgagaaaaacagactggctgcccatggccgtggctgccatgggggtgcctcccctccctctgtttattttctctctcaaggataccctgaagcgcagaagctggccccttaatgagggagtcatggccgtgggcctggtttccatcctggcttctagcctcctgcggaacgacgtgcctatggcggggccccttgtcgccggaggcctgctcattgcttgttatgtgatcaccgggacatccgccgatctgaccgttgaaaaagccgctgacattacatgggaggaagaggccgaacagacgggagtgagccacaacctcatgatcaccgtcgacgatgacggcacaatgcgcatcaaggatgacgagaccgagaatattctgacagtgcttctgaaaaccgcgctgctcatcgtctctggcatttttccgtactccatccctgctacgctgcttgtgtggcatacctggcagaagcagacacaaagaagcggggttctgtgggatgtgccctctcctcccgaaacccagaaagccgagctcgaagagggagtctaccggattaagcagcagggcatcttcgggaaaacacaagtgggagttggcgtgcagaaggagggggtctttcacaccatgtggcacgtgacacgcggagccgtgctgacgtataacggcaagagactcgaaccgaattgggcttccgttaaaaaggacctgattagctacggcgggggatggcggctttctgcccagtggcaaaaaggcgaggaagtccaggtgatcgcggtggagcctgggaagaaccccaaaaatttccagaccatgcctggaacattccagaccaccacaggcgaaatcggggctattgccctggattttaagcccggaacgtccggcagccccatcattaaccgcggcgggaaggtcgtgggactgtatggcaatggggttgtgaccaaaaacggaggctacgtctccgggatcgcccaaacaaatgctgagcctgacggcccgacccccgagctcgaagaggaaatgttcaagaaaagaaacctgacaattatggatcttcatcctggaagcggcaagacccggaaatatctgcccgccatcgtgcgcgaggctatcacgagacggctcagaacactgattctcgcccctacccgcgttgtggcggccgaaatggaggaggctctgaaggggcttcccatccggtaccagaccacagccaccaagtctgaacacacaggaagagagattgtcgacctgatgtgccatgctacctttacgatgcgcctgctcagccctgtgcgggttccgaattataacctgatcattatggatgaagcccacttcacagaccccgcctccatcgctgcgagaggctacatctctacccgcgtggggatgggagaggccgctgccatttttatgacagccacccctcccggcacggctgatgccttccctcagagcaatgcgcccatccaggacgaagaacgggacattccggagagatcctggaactctgggaatgaatggatcaccgattttgctggcaaaacagtctggttcgtgcctagcattaaggccggaaacgacatcgccaactgtcttcgcaaaaatggcaagaaagtgattcaactgtcccggaagacctttgatacagagtaccagaagaccaaactcaacgactgggatttcgtcgttacaaccgacatctctgaaatgggggctaattttaaggccgatagagtgatcgacccccggcgctgcctgaaacccgtgattctgacggatggacctgagagagtcatcctcgcgggccccatgcctgtgacagccgctagcgccgctcagcggcgcgggagagttggacggaacccgcagaaggagaatgaccaatatattttcaccggccagccccttaacaatgatgaagaccatgcccactggaccgaggctaaaatgctgctggacaacatcaatacacctgaagggattatccccgccctcttcgagcctgaaagagagaagtccgcggccgtggatggcgagtaccgcctgaagggagaaagccggaaaacctttgtcgagcttatgagacgcggcgacctgcccgtgtggctcgctcacaaggttgcctctgaagggatcaaatatacagatcggaagtggtgcttcgacggacagagaaacaatcagattctggaggaaaacatggatgtggagatctggacgaaagagggcgaaaagaaaaagctgcgcccgcggtggctcgacgctagaacctactccgatcctcttgccctgaaggagtttaaagagttcgccgctgggcgcaagagcattgcgctggacctcgtcacagagatcggaagagtgccctctcatctggcccaccggacccgcaatgctcttgataacctggtcatgctccatacatccgaacacggcggcagagcctatcggcacgccgtggaggagctgcctgaaaccatggagacgctgctccttctggggctgatgattctcctgaccggaggcgctatgctttttctgatcagcgggaaaggaatcggcaagacatccattgggctcatctgtgttattgcctctagcggaatgctgtggatggcggaaatccccctgcaatggattgcctccgctatcgtgctcgagttctttatgatggtgcttctgattcctgagcccgaaaaacagcgcaccccgcaggacaatcaactggcctacgtcgttatcggcatcctcacactggctgccattatcgcggccaacgagatgggccttctggaaaccacgaagagagatctcgggatgagcaaggagcctggagtggtgtctcccacatcctatctggacgtcgatctgcatcccgctagcgcctggaccctctacgctgtggccacaaccgttattacccctatgcttcggcacacaatcgaaaattctacggctaacgtgagcctggccgcgattgccaaccaggctgtcgtgctgatgggcctcgacaaagggtggccgatctccaagatggacctgggagtcccccttctggccctcggctgctactctcaggtgaatcctctgaccctgacagctgccgttctccttctgatcacccattatgccattatcgggcccggactgcaggcgaaagctacaagagaggcccaaaagcgcaccgctgccggcattatgaaaaaccctacggtggatggcatcatgacaattgacctcgatcccgtcatctacgacagcaagttcgagaagcagctgggacaggtgatgcttctggttctctgtgccgtgcagctgctgctcatgcggacctcctgggctctttgcgaagccctgaccctggcgacaggacctatcaccacactctgggagggctctccggggaaattttggaatacgaccattgccgtcagcatggctaacatcttcagaggatcctatctggccggcgctgggcttgcctttagcattatgaagtctgtgggaacaggcaaacgcggcaccgggtcccaaggagaaacactgggcgagaagtggaaacggaagctcaatcagctgagcagaaaggatttcgacctgtacaaaaagtccgggatcaccgaagtggatcggacggaggcgaaagagggactcaagcgcggcgaaattacccaccatgccgtttctagagggagcgctaaacttcagtggtttgtcgagcggaacatggtgatccccgaaggacgcgtgattgacctgggctgtggcagagggggatggtcctattactgcgccggcctgaagaaagtcacagaggttcgggggtataccaagggaggccctgggcacgaagaacccgtgcctatgtctacatacggatggaatatcgtgaagctcatgagcggcaaagatgtcttctacctgcccccggagaagtgtgacacccttctgtgcgatatcggcgaatccagcccttctcccacagtggaggaatcccgcaccattagagttctcaaaatggtggagccctggctgaagaacaatcagttctgtatcaaagtcctgaacccttatatgcccacggtgattgagcacctcgaacggcttcaacgcaagcatgggggaatgctggttagaaatcctctgagccggaactctacacacgagatgtactggatctccaatggcaccgggaacattgtggctagcgtcaatatggtgtctagactcctgcttaaccgctttaccatgacacatcggagaccgacgatcgaaaaggacgtggatctgggagccggcacccgccacgtcaacgctgagcccgaaacacctaatatggacgttatcggggagcggattaaaagaatcaaggaggaacacaacagcacctggcattatgacgatgagaatccctacaaaacatgggcctatcacggatcctacgaagtgaaggcgaccggctctgccagctccatgattaacggcgtggtcaaactcctgacaaagccttgggacgtggttcccatggtgacccagatggctatgacggataccacaccgttcgggcagcaacgcgtctttaaggagaaagtggacacccggacacctagaagcatgcccggaacccgccgggttatgggcatcacggccgaatggctgtggagaacactcgggcgcaataagaaacctcggctgtgcaccagagaggagttcacaaagaaagtgcgcaccaacgctgccatgggagccgtctttacggaagagaatcagtgggattccgcgaaggctgccgtggaagacgaggatttctggaaacttgttgacagagaacgggagctgcataaactcggcaagtgtgggtcttgcgtgtataacatgatgggcaaacgcgagaagaaactgggagaatttggcaaggccaaagggagcagagctatttggtacatgtggcttggagcccggtacctggagttcgaagctctcggctttctgaatgaggatcactggttctccagagagaactcttatagcggggtcgaaggagagggcctgcataagctcgggtacatcctgcgggacatctccaagattcccggcggagccatgtatgcggatgacaccgccggctgggacacacgcatcaccgaagatgaccttcacaatgaggagaagattacacagcagatggatcctgagcacagacaactggctaacgccatctttaagctcacctaccagaataaagtggtcaaggtgcagcggcccacaccgaccgggacggttatggacattatctctcgcaaagatcagagaggaagcggccaagtggggacatatggactgaacaccttcaccaatatggaggctcagcttatccggcagatggaaggcgagggggtcctgtccaaggccgacctcgaaaacccttacctgcccgagaagaaaattacacagtggctggaaaccaagggcgtggagcgcctcaaaagaatggcgatcagcggagatgactgcgtggttaagcccattgatgaccggtttgccaacgctctgcttgccctgaatgatatgggcaaagtgcgcaaggacatccctcaatggcagccgtctaaggggtggcatgattggcagcaggtccccttctgttcccaccatttccacgagctcattatgaaagacggaagaaagctggtggttccttgccggccccaagacgaacttatcggccgcgctagaattagccagggggccggatggtctctgaaagagacagcttgtctcggcaaggcctatgcgcagatgtggtccctgatgtactttcaccggcgcgatctgagactcgccagcaacgctatctgctctgccgtgcctgtccattgggtgcccacgtcccggaccacatggagcatccacgcccatcaccaatggatgaccacagaagacatgctgaccgtctggaatagagtgtggattgaggataacccttggatggaagacaaaacgcccgttaccacatgggagaatgtgccgtaccttgggaagcgcgaggatcagtggtgtggctccctgatcggactcaccagccgggctacatgggcccagaacattcctaccgcgatccagcaagtcagatctctgattggcaatgaagagttccttgactatatgcccagcatgaagcgctttcggaaagaagaggagtccgaaggggctatctggtga

SEQ ID NO: 20604 - RNA, 9873 nt, synthetic construct
  misc_feature 1..9873: note = derived and/or modified CDS sequence (opt5) from DENV-3__KF973478__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagcatgaaaatctcaagtataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctcgcaccggactggacttcaatgagatgattcttctgacaatgaaaaacaaggcctggatggtgcacagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaagtgtcgcctcaaaatggacaagctggagcttaaaggcatgtcttatgctatgtgcacgaacacctttgttctgaagaaagaggtgtccgaaacacagcatgggaccatcctcatcaaggtcgagtacaagggagaagatgtgccctgtaaaattcctttcagcacagaggacggccaagggaaggcccacaacggaagactgatcaccgcgaatcccgttgtgacgaaaaaggaggaacccgtcaacattgaggctgaacctccgttcggcgagtccaatatcgtgattgggatcggcgataacgccctgaaaatcaattggtacaagaagggatctagcattggcaaaatgtttgaagccacagctagaggggccagacgcatggctatccttggagacaccgcctgggatttcggctccgtcgggggagttctcaacagcctgggcaagatggtccatcagatttttgggtctgcgtataccgccctgttctccggcgtgagctgggtgatgaaaatcggaattggcgtcctcctgacatggatcgggcttaattctaagaacaccagcatgtccttttcttgcattgctatcggaatcattacactgtacctcggcgccgtggttcaggctgacatggggtgtgtgatcaattggaaaggaaaggagctgaagtgcggcagcgggattttcgtcacgaacgaggtgcacacctggacagaacagtataaatttcaagccgattcccccaagcggctggcgaccgccatcgctggcgcctgggagaatggagtttgtggcattagaagcacaacccgcatggaaaaccttctctggaaacagatcgctaatgagctgaactacatcctgtgggaaaataacattaagctcacggtggtcgtgggggacatcattggagttctggagcagggcaaacggacccttacatctcagcctatggagctgaagtattcctggaaaacctgggggaaggccaagatcgtgacagccgaaacccaaaacagctctttcattatcgatggacccaatacacctgagtgcccctccgtcagcagagcttggaacgtgtgggaagtggaggactacggctttggcgtcttcaccacgaatatctggctcaaactgcgcgaagtttatacacagctgtgtgaccaccggcttatgtccgcggccgtgaaggatgagagagctgtgcatgccgacatggggtactggattgagtctcagaaaaacggaagctggaagctcgaaaaagcctccctgatcgaggtcaagacctgcacctggccgaagtctcacacactgtggagcaatggcgtgctcgaatccgatatgattatccctaaaagcctggctgggcccatttctcagcataaccaccgccctggataccacacccaaacggccggcccctggcatcttgggaagctggagctcgactttaattattgcgagggaacaaccgttgtgatcacagaaaactgtggcacccggggcccttccctgagaacaaccacggtcagcgggaaactgatccacgagtggtgctgtcgctcttgcacccttcccccgctccggtacatgggagaagatggctgttggtatgggatggagattagacctatctccgaaaaggaggagaatatggtgaaaagcctggtttctgcgggaagcggcaaggtggacaacttcacaatgggggtcctgtgcctcgctattctgtttgaagaggtgatgcggggaaagttcggcaaaaagcatatgatcgccggcgttttctttaccttcgtgcttctgctctccgggcagattacatggcgcgatatggcccacaccctgatcatgattggaagcaatgcttctgacagaatgggcatgggggtcacgtacctggcccttatcgcgacatttaaaatccagcccttcctggctctcggatttttcctgcggaagctcacctccagagaaaacctgcttctgggcgtggggctcgccatggccacaaccctgcaactgcccgaggatattgaacagatggctaatggaatcgcccttggcctgatggctctcaaactgattacccagtttgagacatatcagctctggacggccctgatcagccttacctgttccaacacaattttcaccctgacagtggcgtggcgcaccgccacgctcatcctggctggcgtctctctgcttcctgtttgccaaagctcctctatgcggaagacagactggctgccgatggccgtggctgccatgggggtgccccctctccccctgtttatcttcggactcaaggataccctgaaaagacgcagctggcctcttaatgagggcgtcatggccgtggggctggtttccattctggcttctagcctcctgagaaacgacgtgcccatggcgggacctcttgtcgccggcgggctgctcatcgcttgttacgtgattaccggaacatccgccgatctgaccgttgaaaaggccgctgacatcacatgggaggaagaggccgaacagacgggcgtgagccataacctcatgattaccgtcgacgatgacggcacaatgcggatcaaagatgacgagaccgagaatatcctgacagtgcttctgaagaccgcgctgctcattgtctctgggatctttccctattccattccggctacgctgcttgtgtggcacacctggcagaaacagacacaacgcagcggagttctgtgggatgtgccttctccccctgaaacccagaaggccgagctcgaagagggcgtctacagaatcaaacagcaggggattttcggaaagacacaagtgggcgttggggtgcagaaggagggagtctttcacaccatgtggcatgtgacacggggcgccgtgctgacgtacaacggcaaacgcctcgaacccaattgggcttccgttaagaaagacctgatcagctatgggggaggctggagactttctgcccagtggcaaaagggggaggaagtccaggtgattgcggtggagccgggcaagaaccctaagaatttccagaccatgcccggcacattccagaccaccacaggggaaatcggagctatcgccctggattttaagcctggcacgtccggcagccccattatcaaccgggaggggaaagtcgtgggactgtacggcaatggggttgtgaccaagaacggaggctatgtctccgggattgcccaaacaaatgctgagcccgacggccctaccccggaactcgaggaagagatgttcaaaaagcgcaacctgacaatcatggatcttcaccccggaagcggcaaaaccagaaagtacctgcctgccattgtgcgggaagctatcaagcgcagactccggacgctgatcctcgcccccacaagagttgtggcggccgagatggaggaagctctgaaagggcttcctattcgctatcagaccaccgccacaaagtctgagcataccggacgggaaatcgtcgacctgatgtgccacgctacatttaccatgagactgctcagccccgtgcgcgttcctaattacaacctgattatcatggatgaggcccatttcacggacccggcctccattgctgcgcggggctatatctctacaagagtggggatgggagaagccgctgccatctttatgaccgccacaccccctggcaccgctgatgccttcccccagagcaatgcgcctattcaggacgaggagcgcgacatccccgaacggtcctggaactctgggaatgagtggattacggattttgctggcaaaaccgtctggttcgtgccgagcatcaaggccggaaacgacattgccaactgtcttcgcaaaaatggcaagaaggtgatccaactgtccagaaaaacatttgataccgaataccagaagacaaaactcaacgactgggatttcgtcgttaccacagacatttctgagatgggggctaattttaaggccgatcgggtgatcgaccctagacggtgcctgaaacccgtgatcctgaccgatggacccgagcgcgtcattctcgcgggccctatgcccgtgacggccgctagcgccgctcagagacgggggcgcgttggaagaaaccctcagaaggaaaatgaccaatacatcttcacaggccagccgcttaacaatgatgaggaccacgcccactggaccgaagctaagatgctgctggacaacattaatacccccgaggggatcattcctgccctcttcgaacccgagcgggagaaatccgcggccatcgatggcgaatatagactgaagggagagagccgcaaaacatttgtggaacttatgcggagaggcgacctgcctgtctggctcgctcataaggtggcctctgaggggatcaaatacaccgatcgcaagtggtgcttcgacggacagcggaacaatcagattctggaagagaacatggatgttgagatctggacaaaagaaggcgagaagaagaaactgagaccccgctggctcgacgctcggacgtattccgatccgcttgccctgaaggaatttaaagagttcgccgctgggagaaagagcattgcgctggacctcgtgaccgaaatcggacgcgtcccttctcacctggcccatagaacacggaatgctcttgataacctggtgatgctccacacctccgagcacggcggccgcgcctacagacatgccgtcgaggaactgcccgagacaatggaaaccctgctccttctggggctgatgattctcctgacgggaggcgctatgctttttctgatcagcgggaaaggaatcggcaagacctccattgggctcatctgtgtgattgcctctagcggaatgctgtggatggcggagatccctctgcaatggattgcctccgctatcgttctcgagttctttatgatggtgcttctgattcccgaacctgagaagcagcggacaccccaggacaatcaactggcctatgtggtcatcggcatcctcaccctggctgccattatcgcggccaacgaaatgggccttctggagacaaccaaacgcgatctcgggatgagcaaggaaccgggagttgtgtctcctacgtcctacctggacgtggatctgcaccccgctagcgcctggacactctatgctgtcgccaccacagtgattacccccatgcttagacataccatcgaaaattctacagctaacgttagcctggccgcgattgccaaccaggctgtggtcctgatgggcctcgacaaagggtggcctatctccaagatggacctgggagtgccgcttctggccctcggctgctactctcaggtcaatcccctgacgctgaccgctgccgtgctccttctgatcacacactacgccattatcgggcctggactgcaggcgaaagctacccgggaggcccaaaagagaacagctgccggcattatgaagaaccccaccgttgatggcatcatgacgattgacctcgatcctgtgatctatgacagcaaattcgaaaagcagctggggcaggtcatgcttctggtgctctgtgccgttcagctgctgctcatgcgcacatcctgggctctttgcgaggccctgaccctggcgaccggacccatcacaaccctctgggaaggctctcctgggaaattttggaatacaacgattgccgtgagcatggctaacatcttccggggatcctacctggccggcgctgggcttgcctttagcattatgaagtctgtcggaaccggcaaaagaggcacagggtcccaaggagagaccctgggcgaaaagtggaagaaaaagctcaatcagctgagccgcaaagatttcgacctgtataagaaatccgggatcacagaggtggatcggaccgaggcgaaggaaggactcaaaagaggcgagattacgcatcacgccgtgtctcgggggagcgctaaacttcagtggtttgttgaacgcaacatggtcatcccggagggaagagtgattgacctgggctgtggcagagggggatggtcctactattgcgccggcctgaagaaagtgaccgaagtccgcgggtacacaaagggaggccccgggcacgaggagcctgttcccatgtctacctatggatggaatatcgtgaaactcatgagcggcaaggatgtgttctacctgcctcccgaaaaatgtgacacacttctgtgcgatatcggcgagtccagcccgtctcctaccgtcgaagagtccagaacaattcgggtgctcaagatggttgagccctggctgaagaacaatcagttctgtatcaaagtgctgaacccctacatgcctaccgtcattgaacatctcgagcgccttcaaagaaagcacgggggaatgctggtgcggaatcccctgagccgcaactctacgcatgaaatgtattggatctccaatggcacagggaacattgttgctagcgtgaatatggtctctagactcctgcttaaccggtttaccatgacccacagacgccctacaatcgagaaagacgtggatctgggagccggcacgcggcacgtgaacgctgaaccggagacccccaatatggacgtcatcggggagagaattaagcgcatcaaagaagaacacaacagcacatggcactacgacgatgaaaatccttataagacctgggcctaccatggatcctatgaggttaaggcgacaggctctgccagctccatgattaacggcgtggtgaaactcctgaccaagccctgggacgtcgtgcctatggttacacagatggctatgaccgatacgacccccttcgggcagcaacgggtgtttaaagaaaaggtcgacacaagaaccccgcgcagcatgcctggaacacggagagtgatgggcatcaccgccgagtggctgtggcgcacgctcgggcggaataaaaagcccagactgtgcacacgcgaggagttcaccaagaaagttcggacaaacgctgccatgggagccgtgtttaccgaggaaaatcagtgggattccgcgaaggctgccgtcgaggacgaagatttctggaaacttgtggacagagagcgcgagctgcacaagctcggcaaatgtgggtcttgcgtttacaacatgatgggcaagagagagaaaaagctgggagagtttggcaaggccaaagggagccgggctatttggtatatgtggcttggagcccgctacctggagttcgaggctctcggctttctgaatgaggatcattggttctccagagaaaactcttacagcggggtggagggagaaggcctgcaccggctcgggtatatcctgagagacatctccaagattcctggcggagccatgtacgcggatgacacggccggctgggacacccggatcacagaggatgaccttcacaatgaagagaaaattacccagcagatggatcccgagcatcgccaactggctaacgccatctttaagctcacatatcagaataaagtcgtgaaggtccagagacctacccccacagggaccgtgatggacattatctctcggaaggatcagcgcggaagcggccaagttgggacgtacggactgaacacattcaccaatatggaagctcagcttatcagacagatggagggcgaaggggtgctgtccaaagccgacctcgagaacccgcatctgcctgaaaagaaaattacccagtggctggagacaaagggcgtcgagcggctcaaacgcatggcgatcagcggagatgactgcgtggtgaagcccattgatgacagatttgccaacgctctgcttgccctgaatgatatgggcaaggttcggaaagacatcccccaatggcagccttctaaggggtggcatgattggcaacaggtgccgttctgttcccaccacttccatgaactcattatgaaagacggacgcaagctggtcgtgccctgcagacctcaagacgagcttatcggccgggctcgcattagccagggggccggatggtctctgaaagaaaccgcttgtctcggcaaggcctatgcgcagatgtggtccctgatgtactttcacagacgggatctgcgcctcgccagcaacgctatctgctctgccgttcccgtgcattgggtccctacatccagaacgacctggagcatccacgcccatcaccaatggatgacaaccgaggacatgctgacagtgtggaatcgggtctggattgaagataacccctggatggaggacaagacccctgtgacgacctgggagaatgttccctatcttgggaaaagagaagatcagtggtgtggctccctgatcggactcacaagccgcgctacctgggcccagaacattccgacagcgatccagcaagtgcggtctctgattggcaatgaggagttccttgactacatgcctagcatgaagagatttcgcaaagaggaggaatccgagggggctatctggtga

SEQ ID NO: 20605 - RNA, 9873 nt, synthetic construct
  misc_feature 1..9873: note = derived and/or modified CDS sequence (opt5) from DENV-3__KF973479__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccagaatctcgggggaacatccattttcgccggacatctgaagtgtcgcctgaaaatggacaaacttgagctgaaaggcatgagctacgctatgtgcacgaacacctttgttctcaagaaagaggtgtctgaaacacagcacgggaccatcctgatcaaggtcgagtacaagggagaagatgccccctgtaaaattcctttctccacagaggacggccaagggaaggcgcataacggaagactgatcaccgctaatcccgtggttacgaaaaaggaggaacccgtgaacattgaggccgaacctccgttcggcgagagcaatatcgtcattgggatcggcgataacgcccttaaaatcaattggtataagaagggatcctctattggcaaaatgtttgaagctacagccagaggggctagacgcatggccatcctcggagacaccgcgtgggatttcggcagcgtcggcggggtgctgaactccctggggaagatggttcaccagatttttgggagcgcctacaccgctctcttctctggcgtctcctgggtgatgaaaatcggaattggcgtgctgcttacatggatcgggctgaatagcaagaacacctctatgagcttttcctgcattgccatcggaatcattacactctatctgggcgctgtcgtgcaggccgacatggggtgtgttatcaattggaaaggaaaggagctgaagtgcggctctgggattttcgtgacgaacgaggtccatacctggacagaacagtacaaatttcaagcggatagccccaagcggcttgccaccgctatcgccggcgcttgggagaatggagtgtgtggcattagatccacaacccgcatggaaaacctcctgtggaaacagatcgccaatgagctgaactatatcctctgggaaaataacattaagctgacggttgtggtcggggacatcattggagtgcttgagcagggcaaacggaccctgacacctcagcccatggagctcaagtacagctggaaaacctgggggaaggccaagatcgttacagctgaaacccaaaactcttccttcattatcgatggacctaatacacccgagtgcccgagcgtgtctagagcgtggaacgtctgggaagtggaggactatggctttggcgtgttcaccacgaatatctggctgaaactgcgcgaagtctacacacagctttgtgaccaccggctcatgtccgccgctgttaaggatgagagagccgtgcacgccgacatggggtactggattgagagccagaaaaacggatcctggaagctggaaaaggcttctctgatcgaggtgaagacctgcacctggcctaagagccatacactctggtccaatggcgtcctggaatctgatatgattatccccaaaagccttgccgggcctatttcccagcacaaccatcgccccggatatcacacccaaacggcgggcccttggcacctggggaagctcgagctggactttaattactgcgagggaacaaccgtggttatcacagaaaactgtggcacccggggccccagcctgagaacaaccacggtgtctgggaaacttatccatgagtggtgctgtcgctcctgcaccctcccgcctctgcggtatatgggagaagatggctgttggtacgggatggagattagacccatcagcgaaaaggaggagaatatggtcaaatctctggtgtccgctggaagcggcaaggttgacaacttcacaatgggggtgctctgcctggccattctttttgaagaggtcatgcggggaaagttcggcaaaaagcacatgatcgccggcgtgttctttaccttcgttctgctcctgtctgggcagattacatggcgcgatatggctcataccctgatcatgattggaagctccgccagcgacagaatgggcatgggggtgacgtatcttgcgctgatcgctacatttaaaatccagcccttcctcgccctgggatttttcctccggaagctgacctctagagaaaatcttctgctcggcgtcgggctggccatggctacaaccctgcaacttcctgaggatattgaacagatggccaacggaatcgctctgggcctcatggccctgaaactcattacccagtttgagacataccagctgtggacggcgcttatctccctgacctgtagcaatacaattttcaccctcacagtggcctggcgcaccgctacgctgatcctggccggcgtgtcccttctgccggtctgccaatctagctccatgcggaagacagactggctccccatggctgttgccgccatgggggtgcctcccctgcctctctttatcttcggactgaaggatacccttaaaagacgctcttggcccctgaacgagggcgtgatggctgtcgggctggtgagcattctcgcgtcctctctgcttagaaatgacgttcctatggccggacccctggtggctggcgggctcctgatcgcctgttatgtcattaccggaacaagcgccgatctcaccgtggaaaaggctgccgacatcacatgggaggaagaggcggaacagacgggcgtttcccacaacctgatgattaccgtggacgatgacggcacaatgcggatcaaagatgacgagaccgagaacatccttacagtcctgctgaagaccgctctcctgattgtgagcgggatctttccgtactctattcctgccacgcttctggtctggcatacctggcagaaacagacacaacgctccggagtgctctgggatgttcccagccctcccgaaacccagaaggccgagctggaagagggcgtgtacagaatcaaacagcaggggattttcggaaagacacaagtcggcgtgggggttcagaaggagggagtgtttcacaccatgtggcacgtcacacggggcgctgtgctcacgtataatggcaaacgcctggaaccgaactgggcctctgtgaagaaagaccttatctcctacgggggaggctggagactgagcgcgcagtggcaaaagggggaggaagttcaggtcattgctgtggagcctggcaagaatcccaagaacttccagaccatgcctggcacattccagaccaccacaggggaaatcggagccatcgccctggattttaagcccggcacgtctggctcccccattatcaatcgggaggggaaagtggtcggactctatggcaacggggtggttaccaagaatggaggctacgtgagcgggattgctcaaacaaacgccgagcctgacggcccgacccccgaactggaggaagagatgttcaaaaagcgcaatcttacaatcatggatctgcatcctggatccggcaaaaccagaaagtatctccccgctattgtccgggaagccatcaagcgcagactgcggacgctcatcctggcgcctacaagagtggttgccgctgagatggaggaagcccttaaagggctgcccattcgctaccagaccaccgctacaaagagcgagcacaccggacgggaaatcgtggacctgatgtgccatgccacatttaccatgagactcctgtctcctgtccgcgtgccgaactataatcttattatcatggatgaggcccacttcacggaccccgctagcattgcggcccggggctacatctccacaagagttgggatgggagaagctgccgccatctttatgaccgctacacctcccggcaccgccgatgcgttccctcagtctaacgctcccattcaggacgaggagcgcgacatcccggaacggagctggaactccgggaacgagtggattacggattttgccggcaaaaccgtgtggttcgtcccttctatcaaggccggaaatgacattgctaactgtctgcgcaaaaacggcaagaaggtgatccaactcagcagaaaaacatttgataccgaataccagaagacaaaactgaatgactgggatttcgtggtcaccacagacatttccgagatgggggccaactttaaggcggatcgggttatcgaccccagacggtgcctgaaacccgtgatcctcaccgatggacctgagcgcgtgattcttgccggccccatgcctgtcacggctgcctctgctgcccagagacgggggcgcgtgggaagaaatccgcagaaggaaaacgaccaatatatcttcacaggccagcccctgaataacgatgaggaccatgctcactggaccgaagccaagatgctgctcgacaatattaacacccctgaggggatcattcccgcgctgttcgaacctgagcgggagaaaagcgccgctatcgatggcgaatacagacttaagggagagtcccgcaaaacatttgttgaactgatgcggagaggcgacctccccgtgtggctggcccacaaggtcgctagcgaggggatcaaatataccgatcgcaagtggtgcttcgacggacagcggaataaccagattctggaagagaatatggatgtggagatctggacaaaagaaggcgagaagaagaaactcagaccgcgctggcttgacgcccggacgtactctgatcctctggccctgaaggaatttaaagagttcgctgcggggagaaagtccattgccctcgacctggttaccgaaatcggacgcgtgcccagccatcttgctcacagaacacggaacgccctggataatctcgtcatgctgcatacctctgagcacggcggccgcgcctatagacacgctgtggaggaactgcctgagacaatggaaaccctccttctgctggggctcatgattctgcttacgggaggcgccatgctgtttctcatctccgggaaaggaatcggcaagaccagcattgggctgatctgtgtcattgcgtcctctggaatgctgtggatggccgagatccccctccaatggattgctagcgccatcgtgcttgagttctttatgatggttctgctgattcctgaacccgagaagcagcggacaccgcaggacaaccaactcgcttacgtggtgatcggcatcctgacccttgccgcgattatcgccgctaatgaaatgggcctgctcgagacaaccaaacgcgatctggggatgtccaaggaacctggagtcgttagccccacgtcttatctggacgtggatctccatcccgcctccgcttggacactttacgccgtggctaccacagtcattacccctatgctgagacacaccatcgagaacagcacagccaatgtgtctctggcggccattgctaaccaggccgttgtgctcatgggcctggacaaagggtggccgatcagcaagatggaccttggagtccccctgctcgctctgggctgctactcccaggtgaaccctctgacgctcaccgccgccgtccttctgctgatcacacattatgcgattatcgggcccggactccaggctaaagccacccgggaggctcaaaagagaacagccgccggcattatgaagaatcctaccgtggatggcatcatgacgattgacctggatcccgttatctacgactctaaattcgaaaagcagcttggacaggtgatgctgctcgtcctgtgtgctgtgcagctgctccttatgcgcacaagctgggccctgtgcgaggcgctgaccctcgccaccggacctatcacaaccctgtgggaaggctccccggggaaattttggaacacaacgattgctgtttctatggccaatatcttccggggaagctatcttgctggcgccgggctggcgttttccattatgaaaagcgtgggaaccggcaaaagaggcacagggtctcaaggagagaccctcggcgaaaagtggaagaaaaagctgaaccagctgtcccgcaaagatttcgacctctacaagaaaagcgggatcacagaggtcgatcggaccgaggccaaggaaggacttaaaagaggcgagattacgcaccatgctgtgtcccgggggtctgccaagctgcagtggtttgtggaacgcaatatggttatccccgagggaagagtcattgacctgggctgtggcagagggggatggagctattactgcgctggcctcaagaaagtgaccgaagtgcgcgggtatacaaagggaggccctgggcacgaggagcccgtccctatgtccacctacggatggaacatcgttaaactgatgtctggcaaggatgtgttctaccttcccccggaaaaatgtgacacactgctctgcgatatcggcgagagctcccctagccccaccgtggaagagtctagaacaattcgggtcctgaagatggtggagccctggctgaagaataaccagttctgtatcaaagttctcaatccttatatgcccaccgtgattgaacaccttgagcgcctgcaaagaaagcatgggggaatgctggtccggaaccctctctcccgcaatagcacgcacgaaatgtactggatctctaacggcacagggaatattgtggcctccgttaacatggtgagcagactgcttctgaatcggtttaccatgacccatagacgcccgacaatcgagaaagacgtcgatctcggagctggcacgcggcacgtgaacgccgaacccgagacccctaacatggacgtgatcggggagagaattaagcgcatcaaagaagaacacaattctacatggcattatgacgatgaaaacccctacaagacctgggcgtatcacggaagctacgaggtcaaggccacaggctccgcttctagcatgattaatggcgttgtgaaactgctgaccaagccttgggacgtggtccccatggtgacacagatggccatgaccgatacgaccccgttcgggcagcaacgggtttttaaagaaaaggtggacacaagaacccctcgctccatgcccggaacacggagagtcatgggcatcaccgctgagtggctctggcgcacgctggggcggaacaaaaagcctagactttgcacacgcgaggagttcaccaagaaagtgcggacaaatgccgccatgggagcggtttttaccgaggaaaaccagtgggatagcgctaaggccgccgtggaggacgaagatttctggaaactggtcgacagagagcgcgagctccataagctgggcaaatgtgggtcctgcgtgtataatatgatgggcaagagagagaagaaacttggagagtttggcaaggctaaagggtctcgggccatttggtacatgtggctgggagctcgctacctcgagttcgaggccctgggctttctgaacgaggatcactggttcagcagagaaaattcctattctggggttgagggagaaggcctccataagctggggtacatccttcgggacatcagcaaaattcccggcggagcgatgtatgccgatgacacggctggctgggacaccagaatcacagaggatgacctgcacaacgaagagaagattacccagcagatggatcctgagcaccggcaactcgccaatgctatctttaaactgacataccagaacaaggtggtcaaggtgcagcgccccaccccgacagggaccgtcatggacattatctccagaaaagatcagcggggatctggccaagtggggacgtatggacttaatacattcaccaacatggaagcccagctgatccgccagatggagggcgaaggggttctcagcaaggcggacctggagaatcctcatctgcccgagaaaaagattacccagtggctcgagacaaaaggcgtggagagactgaagcggatggccatctccggagatgactgcgtcgtgaagcccattgatgaccgctttgctaacgcccttctggctctcaacgatatgggcaaagtgagaaaggacatccctcaatggcagccgagcaaagggtggcacgattggcagcaggttcccttctgttctcatcacttccacgaactgattatgaaggacggacggaaacttgtggtcccttgccgcccccaagacgagctgatcggcagagcccggatttcccagggggctggatggagcctcaaggaaaccgcctgtctgggcaaggcgtacgcccagatgtggtctctgatgtattttcatcgcagagatctccggctggcttccaatgccatctgcagcgccgtgcctgttcactgggtgcccacatctcgcacgacctggtccatccatgctcaccatcaatggatgacaaccgaggacatgcttacagtctggaacagagtgtggattgaagataatccttggatggaggacaaaacccccgtcacgacctgggagaacgtgccgtacctggggaagcgggaagatcagtggtgtggcagcctcatcggactgacatccagagccacctgggcgcagaatattcctacagctatccagcaagttcgcagccttattggcaacgaggagttcctggactacatgccctctatgaaacggtttagaaaggaggaggaaagcgagggggccatctggtga

SEQ ID NO: 20606 - RNA, 9873 nt, synthetic construct
  misc_feature 1..9873: note = derived and/or modified CDS sequence (opt5) from DENV-3__KF973480__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcgaccctcccggaggaacaggaccagaattatgtgtgtaaacacacatacgtggatcggggctgggggaacggatgcggcctgttcgggaagggaagccttgtgacatgcgccaagtttcaatgtctggagcccatcgagggcaaagtggttcagtatgaaaatctcaagtacacagtgattatcacggtccataccggggaccagcaccaggtgggaaacgagacacaaggcgttaccgctgaaatcacacctcaggcctctaccacggaggctattctgcccgaatatggcaccctggggctcgagtgctcccctcgcacaggactggacttcaatgagatgatccttctgaccatgaaaaacaaggcctggatggtgcatagacagtggtttttcgatctccccctgccgtggacaagcggcgccaccacggaaacacctacctggaatcggaaagagcttctggtcacatttaagaacgctcacgcgaaaaagcaagaagtggtcgtgctcgggtctcaggagggagccatgcacaccgctctgaccggcgccacagaaattcaaaattccgggggcacgagcatcttcgccggacatctgaagtgtcgcctcaaaatggacaagctggagcttaaaggcatgtcttacgctatgtgcaccaacacatttgttctgaagaaagaggtgtccgaaacccagcacgggacaattctcatcaaggtcgagtacaagggagaagatgtgccctgtaaaatccctttcagcaccgaggacggccaagggaaggcccataacggaagactgattacggcgaatcccgttgtgaccaagaaggaggaacccgtcaacatcgaggctgaacctccgttcggcgagtccaatattgtgatcgggattggcgataacgccctgaaaatcaattggtataagaagggatctagcatcggcaaaatttttgaagccaccgctagaggggcgagacgcatggctatccttggagacaccgcctgggatttcggctccgtcggcggggttctcaacagcctggggaagatggtccaccagatttttgggtctgcgtacacagccctgttctccggcgtgagctgggtgatgaaaatcggaattggcgtcctcctgacctggatcgggcttaattctaagaacacaagcatgtccttttcttgcattgctatcggaatcattacgctgtatctcggcgccgtggttcaggctgacatggggtgtgtgatcaattggaaaggaaaggagctgaagtgcggcagcgggattttcgtcaccaacgaggtgcatacatggaccgaacagtacaaatttcaagccgattcccccaagcggctggcgacagccatcgctggcgcctgggagaatggagtttgtggcattagaagcaccacgcgcatggaaaaccttctctggaaacagatcgctaatgagctgaactatatcctgtgggaaaataacattaagctcaccgtggtcgtgggggacatcattggagttctggagcagggcaaacggacacttacccctcagcccatggagctgaagtactcttggaaaacatgggggaaggccaagatcgtgaccgccgaaacacaaaactccagcttcattatcgatggacctaatacccccgagtgcccgtctgtctccagagcttggaacgtgtgggaagtggaggactatggctttggcgtcttcacgacaaatatctggctcaaactgcgcgaagtttacacccagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacatggcctaagtcccataccctgtggtctaatggcgtgctcgaaagcgatatgattatccccaaatccctggctgggcctattagccagcacaaccatcgccccggatatcacacgcaaacagccggcccttggcaccttgggaagctggagctcgactttaattactgcgagggaaccacagttgtgatcaccgaaaactgtggcacacggggcccctctctgagaaccacgaccgtctccgggaaactgatccatgagtggtgctgtcgcagctgcacacttccgcctctccggtatatgggagaagatggctgttggtacgggatggagattagacccatctctgaaaaggaggagaatatggtgaaatccctggttagcgcgggatctggcaaggtggacaacttcaccatgggggtcctgtgcctcgctattctgtttgaagaggtgatgcggggaaagttcggcaaaaagcacatgatcgccggcgttttctttacattcgcccttctgctcagcgggcagattacctggcgcgatatggctcatacgctgatcatgattggatccaatgccagcgacagaatgggcatgggggtgacatatctggcgcttatcgctacctttaaaatccagcccttcctggccctcggatttttcctgcggaagctcacatctagagaaaacctgcttctgggcgtcgggctcgccatggctaccaccctgcaactgcctgaggatattgaacagatggccaatggaatcgctcttggcctgatggccctcaaactgattacacagtttgagacgtaccagctctggaccgcgctgatctcccttacatgtagcaacaccattttcacactgaccgtggcctggcgcacggctacactcatcctggccggcgtgtccctgcttccggtctgccaatctagctccatgcggaagaccgactggctgcccatggctgttgccgccatgggggtgcctcccctccctctgtttatcttcggactcaaggataccctgaaaagacgctcttggccccttaatgagggcgtgatggctgtcgggctggtgagcattctggcgtcctctctcctgagaaacgacgttcctatggccggaccccttgtggctggcgggctgctcatcgcctgttatgtcattacaggaaccagcgccgatctgacagtggaaaaggctgccgacatcacgtgggaggaagaggcggaacagaccggcgtttcccacaacctcatgattacagtggacgatgacggcaccatgcggatcaaagatgacgagacagagaatatcctgaccgtccttctgaagacggctctgctcattgtgagcgggatctttccgtactctattcctgccaccctgcttgtctggcatacatggcagaaacagacccaacgctccggagtgctgtgggatgttcccagccctcccgaaacacagaaggccgagctcgaagagggcgtgtacagaatcaaacagcaggggattttcggaaagacccaagtcggcgtgggggttcagaaggagggagtgtttcacacaatgtggcacgtcacgcggggcgctgtgctgacctataacggcaaacgcctcgaaccgaattgggcctctgtgaagaaagacctgatctcctacgggggaggctggagacttagcgcgcagtggcaaaagggggaggaagttcaggtcattgctgtggagcctggcaagaaccccaagaatttccagacaatgcctggcaccttccagaccacaacgggggaaatcggagccatcgccctggattttaagcccggcacctctggctcccccattatcaaccgggaggggaaagtggtcggactgtatggcaatggggtggttacaaagaacggaggctacgtgagcgggattgctcaaaccaatgccgagcctgacggcccgacacccgaactcgaggaagagatgttcaaaaagcgcaacctgaccatcatggatcttcatcctggatccggcaaaacgagaaagtatctgcccgctattgtccgggaagccatcaagcgcagactccggacactgatcctcgcgcctaccagagtggttgccgctgagatggaggaagccctgaaagggcttcccattcgctaccagaccacagctaccaagagcgagcacacaggacgggaaatcgtggacctgatgtgccatgccacctttacgatgagactgctctctcctgtccgcgtgccgaattataacctgattatcatggatgaggcccacttcacagaccccgctagcattgcggcccggggctacatctccaccagagttgggatgggagaagctgccgccatctttatgacagctacccctcccggcacggccgatgcgttccctcagtctaatgctcccattcaggacgaggagcgcgacatcccggaacggagctggaactccgggaatgagtggattaccgattttgccggcaaaacagtgtggttcgtcccttctatcaaggccggaaacgacattgctaactgtcttcgcaaaaatggcaagaaggtgatccaactgagcagaaaaacctttgatacagaataccagaagaccaaactcaacgactgggatttcgtggtcacaaccgacatttccgagatgggggccaattttaaggcggatcgggttatcgaccccagacggtgcctgaaacccgtgatcctgacggatggacctgagcgcgtgattctcgccggccccatgcctgtcacagctgcctctgctgcccagagacgggggcgcgtgggaagaaacccgcagaaggaaaatgaccaatatatcttcaccggccagccccttaacaatgatgaggaccatgctcactggaccgaagccaagatgctgctggacaacattaatacacctgaggggatcattcccgccctcttcgaacctgagcgggagaaaagcgccgctatcgatggcgaatacagactgaagggagagtcccgcaaaacctttgttgaacttatgcggagaggcgacctgcccgtgtggctcgcccacaaggtcgctagcgaggggatcaaatatacagatcgcaagtggtgcttcgacggacagcggaacaatcagattctggaagagaacatggatgtggagatctggacgaaagaaggcgagaagaagaaactgagaccgcgctggctcgacgcccggacctactctgatcctcttgccctgaaggaatttaaagagttcgctgcggggagaaagtccattgccctggacctcgttacagaaatcggacgcgtgcccagccatctggctcacagaacccggaatgcccttgataacctggtcatgctccatacatctgagcacggcggccgcgcctatagacacgctgtggaggaactgcctgagaccatggaaacgctgctccttctggggctgatgattctcctgaccggaggcgccatgctttttctgatctccgggaaaggaatcggcaagacaagcattgggctcatctgtgtcattgcgtcctctggaatgctgtggatggccgagatccccctgcaatggattgctagcgccatcgtgctcgagttctttatgatggttcttctgattcctgaacccgagaagcagcggaccccgcaggacaatcaactggcttacgtggtgatcggcatcctcacactggccgcgattatcgccgctaacgaaatgggccttctggagaccacgaaacgcgatctcgggatgtccaaggaacctggagtcgttagccccacatcttatctggacgtggatctgcatcccgcctccgcttggaccctctacgccgtggctacaaccgtcattacccctatgcttagacacacaatcgagaatagcacggccaacgtgtctctggcggccattgctaaccaggccgttgtgctgatgggcctcgacaaagggtggccgatcagcaagatggacctgggagtcccccttctggctctcggctgctactcccaggtgaatcctctgaccctgacagccgccgtcctccttctgatcacccattatgcgattatcgggcccggactgcaggctaaagccacacgggaggctcaaaagagaaccgccgccggcattatgaagaaccctacggtggatggcatcatgacaattgacctcgatcccgttatctacgactctaaattcgaaaagcagctgggacaggtgatgcttctggtcctctgtgctgtgcagctgctgctcatgcgcaccagctgggccctttgcgaggcgctgaccctggccacaggacctatcaccacactctgggaaggctccccggggaaattttggaatacgaccattgctgtttctatggccaacatcttccggggaagctatctggctggcgccgggcttgcgttttccattatgaaaagcgtgggaacaggcaaaagaggcaccgggtctcaaggagagacactgggcgaaaagtggaagaaaaagctcaatcagctgtcccgcaaagatttcgacctgtacaagaaaagcgggatcaccgaggtcgatcggacggaggccaaggaaggactcaaaagaggcgagattacccaccatgctgtgtcccgggggtctgccaaacttcagtggtttgtggaacgcaacatggttatccccgagggaagagtcattgacctgggctgtggcagagggggatggagctattactgcgctggcctgaagaaagtgacagaagtgcgcgggtataccaagggaggccctgggcacgaggagcccgtccctatgtccacatacggatggaatatcgttaaactcatgtctggcaaggatgtgttctacctgcccccggaaaaatgtgacacccttctgtgcgatatcggcgagagctcccctagccccacagtggaagagtctagaaccattcgggtcctcaagatggtggagccctggctgaagaacaatcagttctgtatcaaagttctgaacccttatatgcccacggtgattgaacacctcgagcgccttcaaagaaagcatgggggaatgctggtccggaatcctctgtcccgcaacagcacacacgaaatgtactggatctctaatggcaccgggaacattgtggcctccgttaatatggtgagcagactcctgcttaaccggtttaccatgacacatagacgcccgacgatcgagaaagacgtcgatctgggagctggcacccggcacgtgaacgccgaacccgagacacctaatatggacgtgatcggggagagaattaagcgcatcaaagaagaacacaactctacctggcattatgacgatgaaaatccctacaagacatgggcgtatcacggaagctacgaggtcaaggccaccggctccgcttctagcatgattaacggcgttgtgaaactcctgacaaagccttgggacgtggtccccatggtgacccagatggccatgacggataccacaccgttcgggcagcaacgggtttttaaagaaaaggtggacaccagaacacctcgctccatgcccggaacccggagagtcatgggcatcacggctgagtggctgtggcgcacactcgggcggaataaaaagcctagactgtgcacccgcgaggagttcacaaagaaagtgcggaccaacgccgccatgggagcggtttttacggaggaaaatcagtgggatagcgctaaggccgccgtggaggacgaagatttctggaaacttgtcgacagagagcgcgagctgcataagctcggcaaatgtgggtcctgcgtgtataacatgatgggcaagagagagaaaaagctgggagagtttggcaaggctaaagggtctcgggccatttggtacatgtggcttggagctcgctacctggagttcgaggccctcggctttctgaatgaggatcactggttcagcagagaaaactcctattctggggttgagggagaaggcctgcataagctcgggtacatcctgcgggacatcagcaaaattcccggcggagcgatgtatgccgatgacaccgctggctgggacacaagaatcaccgaggatgaccttcacaatgaagagaagattacacagcagatggatcctgagcaccggcaactggccaacgctatctttaaactcacctaccagaataaggtggtcaaggtgcagcgccccacaccgaccgggacggtcatggacattatctccagaaaagatcagcggggatctggccaagtggggacatatggactgaacaccttcaccaatatggaagcccagcttatccgccagatggagggcgaaggggttctgagcaaggcggacctcgagaaccctcatctgcccgagaaaaagattacacagtggctggagaccaaaggcgtggagagactcaagcggatggccatctccggagatgactgcgtcgtgaagcccattgatgaccgctttgctaacgccctgcttgctctgaatgatatgggcaaagtgagaaaggacatccctcaatggcagccgagcaaagggtggcacgattggcagcaggttcccttctgttctcatcacttccacgaactcattatgaaggacggacggaaactggtggtcccttgccgcccccaagacgagcttatcggcagagcccggatttcccagggggctggatggagcctgaaggaaacagcctgtctcggcaaggcgtacgcccagatgtggtctctgatgtattttcatcgcagagatctgcggctcgcttccaacgccatctgcagcgccgtgcctgttcactgggtgcccacgtctcgcaccacatggtccatccatgctcaccatcaatggatgaccacagaggacatgctgaccgtctggaatagagtgtggattgaagataacccttggatggaggacaaaacgcccgtcaccacatgggagaatgtgccgtaccttgggaagcgggaagatcagtggtgtggcagcctgatcggactcacctccagagccacatgggcgcagaacattcctaccgctatccagcaagttcgcagcctgattggcaatgaggagttccttgactacatgccctctatgaaacggtttagaaaggaggaggaaagcgagggggccatctggtga

SEQ ID NO: 20607 - RNA, 9873 nt, synthetic construct
  misc_feature 1..9873: note = derived and/or modified CDS sequence (opt5) from DENV-3__KF973481__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccatcatcattacagtgcatacgggggaccagcaccaggtcggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggttcatagacagtggtttttcgatctccccctgccgtggaccagcggcgccacaaccgaaacgcctacatggaatcggaaagagcttctggtgacctttaagaacgctcacgcgaaaaagcaagaagtcgtggtcctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtttccgaaacacagcacgggaccatcctcattaaggtggagtacaagggagaagatgtcccctgtaaaatccctttcagcacagaggacggccaagggaaggcccataacggaagactgattaccgcgaatcccgtggttacgaaaaaggaggaacccgtgaacatcgaggctgaacctccgttcggcgagtccaatattgtcatcgggatcggcgataacgccctgaaaattaattggtataagaagggatctagcatcggcaaaatgtttgaagccacagctagaggggccagacgcatggctattcttggagacaccgcctgggatttcggctccgtcgggggagtgctcaacagcctgggcaagatggttcaccagatctttgggtctgcgtacaccgccctgttctccggcgtcagctgggtgatgaaaattggaatcggcgtgctcctgacatggattgggcttaattctaagaacaccagcatgtccttttcttgcatcgctatcggaattatcacactgtatctcggcgccgtcgtgcaggctgacatggggtgtgttattaattggaaaggaaaggagctgaagtgcggcagcgggatcttcgtgacgaacgaggtccatacctggacagaacagtacaaatttcaagccgattcccccaagcggctggcgaccgccattgctggcgcctgggagaatggagtgtgtggcatcagaagcacaacccgcatggaaaaccttctctggaaacagatcgctaatgagctgaactatattctgtgggaaaataacatcaagctcacggttgtggtcggggacattatcggagtgctggagcagggcaaacggacccttacacctcagcccatggagctgaagtactcttggaaaacctgggggaaggccaagattgttacagccgaaacccaaaactccagcttcatcatcgatggacctaatacacccgagtgcccgtctgtgtccagagcttggaacgtctgggaagtggaggactatggctttggcgtgttcaccacgaatatttggctcaaactgcgcgaagtctacacacagctgtgtgaccaccggcttatgagcgcggccgttaaggatgagagagctgtgcacgccgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggctgggcctatcagccagcacaaccatcgccccggatatcacacccaaacggccggcccttggcaccttgggaagctggagctcgactttaattactgcgagggaacaaccgtggttatcacagaaaactgtggcacccggggcccctctctgagaacaaccacggtgtccgggaaactgattcatgagtggtgctgtcgcagctgcacccttccgcctctccggtatatgggagaagatggctgttggtacgggatggagatcagacccatttctgaaaaggaggagaatatggtcaaatccctggtgagcgcgggatctggcaaggttgacaacttcacagtgggggtcctgtgcctcgctatcctgtttgaagaggtgatgcggggaaagttcggcaaaaagcacatgattgccggcgttttctttaccttcgtgcttctgctcagcgggcagatcacatggcgcgatatggcccataccctgattatgatcggatccaatgctagcgacagaatgggcatgggggtcacgtatctggcccttatcgcgacatttaaaattcagcccttcctggctctcggatttttcctgcggaagctcacctctagagaaaacctgcttctgggcgtggggctcgccatggccacaaccctgcaactgcctgaggatatcgaacagatggctaatggaattgcccttggcctgatggctctcaaactgatcacccagtttgagacataccagctctggacggccctgatttcccttacctgtagcaacacaatcttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttattttcggactcaaggataccctgaaaagacgctcttggccccttaatgagggcgtcatggccgtggggctggttagcatcctggcttcctctctcctgagaaacgacgtgcctatggcgggaccccttgtcgccggcgggctgctcattgcttgttatgtgatcaccggaacaagcgccgatctgaccgttgaaaaggccgctgacattacatgggaggaagaggccgaacagacgggcgtgtcccacaacctcatgatcaccgtcgacgatgacggcacaatgcggatcaaagatgacgagaccgagaatattctgacagtgcttctgaagaccgcgctgctcatcgtcagcgggatttttccgtactctatccctgctacgctgcttgtgtggcatacctggcagaaacagacacaacgctccggagttctgtgggatgtgcccagccctcccgaaacccagaaggccgagctcgaagagggcgtctacagaattaaacagcaggggatcttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatttcctacgggggaggctggagacttagcgcccagtggcaaaagggggaggaagtccaggtgatcgcggtggagcctggcaagaaccccaagaatttccagaccatgcctggcacattccagaccaccacaggggaaatcggagctattgccctggattttaagcccggcacgtctggctcccccatcattaaccgggaggggaaagtcgtgggactgtatggcaatggggttgtgaccaagaacggaggctacgtcagcgggatcgcccaaacaaatgctgagcctgacggcccgacccccgaactcgaggaagagatgttcaaaaagcgcaacctgacaattatggatcttcatcctggatccggcaaaaccagaaagtatctgcccgccatcgtgcgggaagctatcaagcgcagactccggacgctgattctcgcccctacaagagttgtggcggccgagatggaggaagctctgaaagggcttcccatccgctaccagaccaccgccacaaagagcgagcacaccggacgggaaattgtcgacctgatgtgccatgctacatttaccatgagactgctctctcctgtgcgcgttccgaattataacctgatcattatggatgaggcccacttcacggaccccgccagcatcgctgcgcggggctacatctccacaagagtggggatgggagaagccgctgccatttttatgaccgccacacctcccggcaccgctgatgccttccctcagtctaatgcgcccatccaggacgaggagcgcgacattccggaacggagctggaactccgggaatgagtggatcacggattttgctggcaaaaccgtctggttcgtgccttctattaaggccggaaacgacatcgccaactgtcttcgcaaaaatggcaagaaggtgattcaactgagcagaaaaacatttgataccgaataccagaagacaaaactcaacgactgggatttcgtcgttaccacagacatctccgagatgggggctaattttaaggccgatcgggtgatcgaccccagacggtgcctgaaacccgtgattctgaccgatggacctgagcgcgtcatcctcgcgggccccatgcctgtgacggccgcttctgccgctcagagacgggggcgcgttggaagaaacccgcagaaggaaaatgaccaatatattttcacaggccagccccttaacaatgatgaggaccatgcccactggaccgaagctaagatgctgctggacaacatcaatacccctgaggggattatccccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggattaaatataccgatcgcaagtggtgcttcgacggacagcggaacaatcagatcctggaagagaacatggatgttgagatttggacaaaagaaggcgagaagaagaaactgagaccgcgctggctcgacgctcggacgtactctgatcctcttgccctgaaggaatttaaagagttcgccgctgggagaaagtccatcgcgctggacctcgtgaccgaaattggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgatcctcctgacgggaggcgctatgctttttctgatctccgggaaaggaattggcaagaccagcatcgggctcatttgtgtgatcgcctcctctggaatgctgtggatggcggagattcccctgcaatggatcgccagcgctattgttctcgagttctttatgatggtgcttctgatccctgaacccgagaagcagcggacaccgcaggacaatcaactggcctacgtggtcatcggcattctcaccctggctgccatcattgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgatcacccctatgcttagacacaccattgagaatagcacagctaacgtttctctggccgcgatcgccaaccaggctgtggtcctgatgggcctcgacaaagggtggccgatcagcaagatggacctgggagtgccccttctggccctcggctgctactcccaggtcaatcctctgacgctgaccgctgccgtgctccttctgattacacattatgccatcattgggcccggactgcaggcgaaagctacccgggaggcccaaaagagaacagctgccggcatcatgaagaaccctaccgttgatggcattatgacgatcgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctattacaaccctctgggaaggctccccggggaaattttggaatacaacgatcgccgtgtctatggctaacattttccggggaagctatctggccggcgctgggcttgccttttccatcatgaaaagcgtcggaaccggcaaaagaggcacagggtctcaaggagagaccctgggcgaaaagtggaagaaaaagctcaatcagctgtcccgcaaagatttcgacctgtacaagaaaagcgggattacagaggtggatcggaccgaggcgaaggaaggactcaaaagaggcgagatcacgcaccatgccgtgtcccgggggtctgctaaacttcagtggtttgttgaacgcaacatggtcattcccgagggaagagtgatcgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatattggcgagagctcccctagccccaccgtcgaagagtctagaacaatccgggtgctcaagatggttgagccctggctgaagaacaatcagttctgtattaaagtgctgaacccttatatgcccaccgtcatcgaacacctcgagcgccttcaaagaaagcatgggggaatgctggtgcggaatcctctgtcccgcaacagcacgcacgaaatgtactggatttctaatggcacagggaacatcgttgcttccgtgaatatggtcagcagactcctgcttaaccggtttaccatgacccatagacgcccgacaatcgagaaagacgtggatctgggagccggcacgcggcacgtgaacgctgaacccgagacccctaatatggacgtcattggggagagaatcaagcgcattaaagaagaacacaactctacatggcattatgacgatgaaaatccctacaagacctgggcctatcacggaagctacgaggttaaggcgacaggctccgcctctagcatgatcaacggcgtggtgaaactcctgaccaagccttgggacgtcgtgcccatggttacacagatggctatgaccgatacgaccccgttcgggcagcaacgggtgtttaaagaaaaggtcgacacaagaacccctcgctccatgcccggaacacggagagtgatgggcattaccgccgagtggctgtggcgcacgctcgggcggaataaaaagcctagactgtgcacacgcgaggagttcaccaagaaagttcggacaaacgctgccatgggagccgtgtttaccgaggaaaatcagtgggatagcgcgaaggctgccgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggctatctggtacatgtggcttggagcccgctacctggagttcgaggctctcggctttctgaatgaggatcactggttcagcagagaaaactcctattctggggtggagggagaaggcctgcataagctcgggtacatcctgcgggacattagcaaaatccccggcggagccatgtatgcggatgacacggccggctgggacaccagaattacagaggatgaccttcacaatgaagagaagatcacccagcagatggatcctgagcaccggcaactggctaacgccatttttaaactcacataccagaataaggtcgtgaaggtccagcgccccaccccgacagggaccgtgatggacatcatctccagaaaagatcagcggggatctggccaagttgggacgtatggactgaacacattcaccaatatggaagctcagcttattcgccagatggagggcgaaggggtgctgagcaaggccgacctcgagaaccctcatctgcccgagaaaaagatcacccagtggctggagacaaaaggcgtcgagagactcaagcggatggcgatttccggagatgactgcgtggtgaagcccatcgatgaccgctttgccaacgctctgcttgccctgaatgatatgggcaaagttagaaaggacattcctcaatggcagccgagcaaagggtggcacgattggcaacaggtgcccttctgttctcatcacttccacgaactcatcatgaaggacggacggaaactggtcgtgccttgccgcccccaagacgagcttattggcagagctcggatctcccagggggccggatggagcctgaaggaaaccgcttgtctcggcaaggcctacgcgcagatgtggtctctgatgtattttcatcgcagagatctgcggctcgcctccaacgctatctgcagcgccgttcctgtgcactgggtccccacatctcgcacgacctggtccattcatgcccaccatcaatggatgacaaccgaggacatgctgacagtgtggaatagagtctggatcgaagataacccttggatggaggacaaaacccccgtgacgacctgggagaatgttccgtaccttgggaagcgggaagatcagtggtgtggcagcctgattggactcacatccagagctacctgggcccagaacatccctacagcgattcagcaagtgcgcagcctgatcggcaatgaggagttccttgactacatgccctctatgaaacggtttagaaaggaggaggaaagcgagggggctatctggtga

SEQ ID NO: 20608 - RNA, 9873 nt, synthetic construct
  misc_feature 1..9873: note = derived and/or modified CDS sequence (opt5) from DENV-3__KF973482__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccatcatcattacagtgcatacgggggaccagcaccaggtcggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggttcatagacagtggtttttcgatctccccctgccgtggaccagcggcgccacaaccgaaacgcctacatggaatcggaaagagcttctggtgacctttaagaacgctcacgcgaaaaagcaagaagtcgtggtcctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtttccgaaacacagcacgggaccatcctcattaaggtggagtacaagggagaagatgtcccctgtaaaatccctttcagcacagaggacggccaagggaaggcccataacggaagactgattaccgcgaatcccgtggttacgaaaaaggaggaacccgtgaacatcgaggctgaacctccgttcggcgagtccaatattgtcatcgggatcggcgataacgccctgaaaattaattggtataagaagggatctagcatcggcaaaatgtttgaagccacagctagaggggccagacgcatggctattcttggagacaccgcctgggatttcggctccgtcgggggagtgctcaacagcctgggcaagatggttcaccagatctttgggtctgcgtacaccgccctgttctccggcgtcagctgggtgatgaaaattggaatcggcgtgctcctgacatggattgggcttaattctaagaacaccagcatgtccttttcttgcatcgctatcggaattatcacactgtatctcggcgccgtcgtgcaggctgacatggggtgtgttattaattggaaaggaaaggagctgaagtgcggcagcgggatcttcgtgacgaacgaggtccatacctggacagaacagtacaaatttcaagccgattcccccaagcggctggcgaccgccattgctggcgcctgggagaatggagtgtgtggcatcagaagcacaacccgcatggaaaaccttctctggaaacagatcgctaatgagctgaactatattctgtgggaaaataacatcaagctcacggttgtggtcggggacattatcggagtgctggagcagggcaaacggacccttacacctcagcccatggagctgaagtactcttggaaaacctgggggaaggccaagattgttacagccgaaacccaaaactccagcttcatcatcgatggacctaatacacccgagtgcccgtctgtgtccagagcttggaacgtctgggaagtggaggactatggctttggcgtgttcaccacgaatatttggctcaaactgcgcgaagtctacacacagctgtgtgaccaccggcttatgagcgcggccgttaaggatgagagagctgtgcacgccgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggctgggcctatcagccagcacaaccatcgccccggatatcacacccaaacggccggcccttggcaccttgggaagctggagctcgactttaattactgcgagggaacaaccgtggttatcacagaaaactgtggcacccggggcccctctctgagaacaaccacggtgtccgggaaactgattcatgagtggtgctgtcgcagctgcacccttccgcctctccggtatatgggagaagatggctgttggtacgggatggagatcagacccatttctgaaaaggaggagaatatggtcaaatccctggtgagcgcgggatctggcaaggttgacaacttcacagtgggggtcctgtgcctcgctatcctgtttgaagaggtgatgcggggaaagttcggcaaaaagcacatgattgccggcgttttctttaccttcgtgcttctgctcagcgggcagatcacatggcgcgatatggcccataccctgattatgatcggatccaatgctagcgacagaatgggcatgggggtcacgtatctggcccttatcgcgacatttaaaattcagcccttcctggctctcggatttttcctgcggaagctcacctctagagaaaacctgcttctgggcgtggggctcgccatggccacaaccctgcaactgcctgaggatatcgaacagatggctaatggaattgcccttggcctgatggctctcaaactgatcacccagtttgagacataccagctctggacggccctgatttcccttacctgtagcaacacaatcttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttattttcggactcaaggataccctgaaaagacgctcttggccccttaatgagggcgtcatggccgtggggctggttagcatcctggcttcctctctcctgagaaacgacgtgcctatggcgggaccccttgtcgccggcgggctgctcattgcttgttatgtgatcaccggaacaagcgccgatctgaccgttgaaaaggccgctgacattacatgggaggaagaggccgaacagacgggcgtgtcccacaacctcatgatcaccgtcgacgatgacggcacaatgcggatcaaagatgacgagaccgagaatattctgacagtgcttctgaagaccgcgctgctcatcgtcagcgggatttttccgtactctatccctgctacgctgcttgtgtggcatacctggcagaaacagacacaacgctccggagttctgtgggatgtgcccagccctcccgaaacccagaaggccgagctcgaagagggcgtctacagaattaaacagcaggggatcttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatttcctacgggggaggctggagacttagcgcccagtggcaaaagggggaggaagtccaggtgatcgcggtggagcctggcaagaaccccaagaatttccagaccatgcctggcacattccagaccaccacaggggaaatcggagctattgccctggattttaagcccggcacgtctggctcccccatcattaaccgggaggggaaagtcgtgggactgtatggcaatggggttgtgaccaagaacggaggctacgtcagcgggatcgcccaaacaaatgctgagcctgacggcccgacccccgaactcgaggaagagatgttcaaaaagcgcaacctgacaattatggatcttcatcctggatccggcaaaaccagaaagtatctgcccgccatcgtgcgggaagctatcaagcgcagactccggacgctgattctcgcccctacaagagttgtggcggccgagatggaggaagctctgaaagggcttcccatccgctaccagaccaccgccacaaagagcgagcacaccggacgggaaattgtcgacctgatgtgccatgctacatttaccatgagactgctctctcctgtgcgcgttccgaattataacctgatcattatggatgaggcccacttcacggaccccgccagcatcgctgcgcggggctacatctccacaagagtggggatgggagaagccgctgccatttttatgaccgccacacctcccggcaccgctgatgccttccctcagtctaatgcgcccatccaggacgaggagcgcgacattccggaacggagctggaactccgggaatgagtggatcacggattttgctggcaaaaccgtctggttcgtgccttctattaaggccggaaacgacatcgccaactgtcttcgcaaaaatggcaagaaggtgattcaactgagcagaaaaacatttgataccgaataccagaagacaaaactcaacgactgggatttcgtcgttaccacagacatctccgagatgggggctaattttaaggccgatcgggtgatcgaccccagacggtgcctgaaacccgtgattctgaccgatggacctgagcgcgtcatcctcgcgggccccatgcctgtgacggccgcttctgccgctcagagacgggggcgcgttggaagaaacccgcagaaggaaaatgaccaatatattttcacaggccagccccttaacaatgatgaggaccatgcccactggaccgaagctaagatgctgctggacaacatcaatacccctgaggggattatccccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggattaaatataccgatcgcaagtggtgcttcgacggacagcggaacaatcagatcctggaagagaacatggatgttgagatttggacaaaagaaggcgagaagaagaaactgagaccgcgctggctcgacgctcggacgtactctgatcctcttgccctgaaggaatttaaagagttcgccgctgggagaaagtccatcgcgctggacctcgtgaccgaaattggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgatcctcctgacgggaggcgctatgctttttctgatctccgggaaaggaattggcaagaccagcatcgggctcatttgtgtgatcgcctcctctggaatgctgtggatggcggagattcccctgcaatggatcgccagcgctattgttctcgagttctttatgatggtgcttctgatccctgaacccgagaagcagcggacaccgcaggacaatcaactggcctacgtggtcatcggcattctcaccctggctgccatcattgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgatcacccctatgcttagacacaccattgagaatagcacagctaacgtttctctggccgcgatcgccaaccaggctgtggtcctgatgggcctcgacaaagggtggccgatcagcaagatggacctgggagtgccccttctggccctcggctgctactcccaggtcaatcctctgacgctgaccgctgccgtgctccttctgattacacattatgccatcattgggcccggactgcaggcgaaagctacccgggaggcccaaaagagaacagctgccggcatcatgaagaaccctaccgttgatggcattatgacgatcgacctcgatcccgtgatctacgactctaaattcgaaaagcagctggggcaggtcatgcttctggtgctctgtgccgttcagctgctgctcatgcgcacaagctgggctctttgcgaggccctgaccctggcgaccggacctattacaaccctctgggaaggctccccggggaaattttggaatacaacgatcgccgtgtctatggctaacattttccggggaagctatctggccggcgctgggcttgccttttccatcatgaaaagcgtcggaaccggcaaaagaggcacagggtctcaaggagagaccctgggcgaaaagtggaagaaaaagctcaatcagctgtcccgcaaagatttcgacctgtacaagaaaagcgggattacagaggtggatcggaccgaggcgaaggaaggactcaaaagaggcgagatcacgcaccatgccgtgtcccgggggtctgctaaacttcagtggtttgttgaacgcaacatggtcattcccgagggaagagtgatcgacctgggctgtggcagagggggatggagctattactgcgccggcctgaagaaagtgaccgaagtccgcgggtatacaaagggaggccctgggcacgaggagcccgttcctatgtccacctacggatggaatatcgtgaaactcatgtctggcaaggatgtgttctacctgcccccggaaaaatgtgacacacttctgtgcgatattggcgagagctcccctagccccaccgtcgaagagtctagaacaatccgggtgctcaagatggttgagccctggctgaagaacaatcagttctgtattaaagtgctgaacccttatatgcccaccgtcatcgaacacctcgagcgccttcaaagaaagcatgggggaatgctggtgcggaatcctctgtcccgcaacagcacgcacgaaatgtactggatttctaatggcacagggaacatcgttgcttccgtgaatatggtcagcagactcctgcttaaccggtttaccatgacccatagacgcccgacaatcgagaaagacgtggatctgggagccggcacgcggcacgtgaacgctgaacccgagacccctaatatggacgtcattggggagagaatcaagcgcattaaagaagaacacaactctacatggcattatgacgatgaaaatccctacaagacctgggcctatcacggaagctacgaggttaaggcgacaggctccgcctctagcatgaccaacggcgtggtgaaactcctgacaaagccttgggacgtcgtgcccatggttacccagatggctatgacggataccacaccgttcgggcagcaacgggtgtttaaagaaaaggtcgacaccagaacacctcgctccatgcccggaacccggagagtgatgggcatcacggccgagtggctgtggcgcacactcgggcggaataaaaagcctagactgtgcacccgcgaggagttcacaaagaaagttcggaccaacgctgccatgggagccgtgtttacggaggaaaatcagtgggatagcgcgaaggctgccgtcgaggacgaagatttctggaaacttgtggacagagagcgcgagctgcataagctcggcaaatgtgggtcctgcgtttataacatgatgggcaagagagagaagaagctgggagagtttggcaaggccaaagggtctcgggctatttggtacatgtggcttggagcccgctacctggagttcgaggctctcggctttctgaatgaggatcactggttcagcagagaaaactcctattctggggtggagggagaaggcctgcataagctcgggtacatcctgcgggacatcagcaaaattcccggcggagccatgtatgcggatgacaccgccggctgggacacaagaatcaccgaggatgaccttcacaatgaagagaagattacacagcagatggatcctgagcaccggcaactggctaacgccatctttaaactcacctaccagaataaggtcgtgaaggtccagcgccccacaccgaccgggacggtgatggacattatctccagaaaagatcagcggggatctggccaagttgggacatatggactgaacaccttcaccaatatggaagctcagcttatccgccagatggagggcgaaggggtgctgagcaaggccgacctcgagaaccctcatctgcccgagaaaaagattacacagtggctggagaccaaaggcgtcgagagactcaagcggatggcgatctccggagatgactgcgtggtgaagcccattgatgaccgctttgccaacgctctgcttgccctgaatgatatgggcaaagttagaaaggacatccctcaatggcagccgagcaaagggtggcacgattggcaacaggtgcccttctgttctcatcacttccacgaactcattatgaaggacggacggaaactggtcgtgccttgccgcccccaagacgagcttatcggcagagctcggatttcccagggggccggatggagcctgaaggaaacagcttgtctcggcaaggcctacgcgcagatgtggtctctgatgtattttcatcgcagagatctgcggctcgcctccaacgctatctgcagcgccgttcctgtgcactgggtccccacgtctcgcaccacatggtccatccatgcccaccatcaatggatgaccacagaggacatgctgaccgtgtggaatagagtctggattgaagataacccttggatggaggacaaaacgcccgtgaccacatgggagaatgttccgtaccttgggaagcgggaagatcagtggtgtggcagcctgatcggactcacctccagagctacatgggcccagaacattcctaccgcgatccagcaagtgcgcagcctgattggcaatgaggagttccttgactacatgccctctatgaaacggtttagaaaggaggaggaaagcgagggggctatctggtga

SEQ ID NO: 20609 - RNA, 9873 nt, synthetic construct
  misc_feature 1..9873: note = derived and/or modified CDS sequence (opt5) from DENV-3__KF973483__SS-prME
  source 1..9873: mol_type = other RNA
acaagcctgtgcctcatgatgattctgcccgccgctcttgccttccacctgacatcccgggacggagagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgccccctgtaaaattcctttcagcacagaggacggccaagggaaggcgcataacggaagactgatcaccgctaatcccgtggttacgaaaaaggaggaacccgtgaacattgaggccgaacctccgttcggcgagtccaatatcgtcattgggatcggcgataacgccctgaaaatcaattggtataagaagggatctagcattggcaaaatgtttgaagctacagccagaggggctagacgcatggccatccttggagacaccgcgtgggatttcggctccgtcgggggagtgctcaacagcctgggcaagatggttcaccagatttttgggtctgcctacaccgctctgttctccggcgtcagctgggtgatgaaaatcggaattggcgtgctcctgacatggatcgggcttaattctcggaacaccagcatgtccttttcttgcattgccatcggaatcattacactgtatctcggcgctgtcgtgcaggccgacatggggtgtgttatcaattggaagggaaaagagctgaagtgcggcagcgggattttcgtgacgaacgaggtccatacctggacagaacagtacaagtttcaagcggattcccccaaaagactggccaccgctatcgtgggcgcctgggagaatggagtttgtggcattcgcagcacaacccggatggaaaaccttctctggaagcagatcgctaatgagctgaactatatcctgtgggaaaataacattaaactcacggtggtcgtgggggacatcattggagttctggagcagggcaagagaacccttacacctcagcccatggagctgaaatactcttggaagacctgggggaaagccaagatcgtgacagccgaaacccaaaactccagcttcattatcgatggacctaatacacccgagtgcccgtctgtctcccgcgcttggaacgtgtgggaagtggaggactatggctttggcgtcttcaccacgaatatctggctcaagctgcgggaaacatacacccagctgtgtgaccacagacttatgagcgcggccgttaaagatgagcgcgctgtgcacgccgacatggggtactggattgagtcccagaagaacggatcttggaaactcgaaaaggccagcctgatcgaggtgaaaacctgcacatggcctaagtcccataccatttggtctaatggcgtcctggaaagcgatatgatcattcccaagtccctcgctgggcctatcagccagcacaaccatcggcccggatatcacacgcaaacagccggcccttggcacctggggaaacttgagctggactttaattactgcgagggaaccacagtggttatcaccgaaaactgtggcacaagaggcccctctctccgcaccacgaccgtgtccgggaagctgattcatgagtggtgctgtcggagctgcacactgccgcctcttagatatatgggagaagatggctgttggtacgggatggagatccggcccatttctgaaaaagaggagaatatggtcaagtccctcgtgagcgcgggatctggcaaagttgacaacttcaccatgggggtgctgtgcctggctatcctctttgaagaggtcatgcgcggaaagttcggcaagaaacacatgattgccggcgtgttcctgacatttgttcttctgctcagcgggcagatcacctggagagatatggcccatacgctgattatgatcggatccaatgctagcgaccggatgggcatgggggtgacatatctggcccttatcgcgaccttcaagattcagccctttctggctctcggattctttctgagaaaactcacatctcgcgaaaacctgcttctgggcgtcgggctcgccatggccaccaccctgcaactgcctgaggatatcgaacagatggctaatggaattgcccttggcctgatggctctcaagctgatcacacagttcgagacgtaccagctctggaccgccctgatttcccttacatgtagcaacaccatctttacactgaccgtggcgtggcggacggccacactcatcctggctggcgtgtccctgcttccggtctgccaatctagctccatgagaaaaaccgactggctgcccatggccgttgctgccatgggggtgcctcccctccctctgttcatcttttctctcaaggataccctgaagcgcagaagctggccccttaatgagggagtgatggccgtcggcctggtgtccatcctggcttctagcctcctgcggaacgacgttcctatggcggggccccttgtggccggaggcctgctcattgcttgttatgtcatcacagggacctccgccgatctgacagtggaaaaagccgctgacattacgtgggaggaagaggccgaacagaccggagttagccacaacctcatgatcacagtggacgatgacggcaccatgcgcatcaaggatgacgagacagagaatattctgaccgtccttctgaaaacggcgctgctcatcgtgtctggcattttcccgtactccatccctgctaccctgcttgtctggcatacatggcagaagcagacccaaagaagcggggtgctgtgggatgttccctctcctcccgaaacacagaaagccgagctcgaagagggagtgtaccggattaagcagcagggcatctttgggaaaacccaagtcggagtgggcgttcagaaggagggggtgttccacacaatgtggcacgtcacgcgcggagccgtgctgacctataacggcaagagactcgaaccgaattgggcttccgtgaaaaaggacctgattagctacggcgggggatggcggctttctgcccagtggcaaaaaggcgaggaagttcaggtcatcgcggtggagcctgggaagaaccccaaaaattttcagacaatgcctggaaccttccagaccacaacgggcgaaatcggggctattgccctggatttcaagcccggaacctccggcagccccatcattaaccgcgagggcaaggtggtcgggctgtatggaaatggcgtggttaccaagaacgggggatacgtgtccggcatcgcccaaaccaatgctgagcctgacgggccgacacccgaactcgaggaagagatgtttaagaaaagaaacctgaccattatggatcttcatcctggcagcggaaagacgcggaaatatctgcccgccatcgtccgcgaagctatcaagagacggctcagaacactgattctcgcccctacccgcgtggttgcggccgagatggaggaagctctgaagggccttcccatccggtaccagaccacagccaccaaatctgagcacacagggagagaaattgtggacctgatgtgccatgctaccttcacgatgcgcctgctcagccctgtccgggtgccgaattataacctgatcattatggatgaggcccactttacagaccccgcctccatcgctgcgagaggatacatctctacccgcgttggcatgggggaagccgctgccattttcatgacagccacccctcccggaacggctgatgcctttcctcagagcaatgcgcccatccaggacgaggagcgggacattccggaaagatcctggaactctggcaatgagtggatcaccgatttcgctgggaagacagtgtggtttgtccctagcattaaagccggcaacgacatcgccaactgtcttcgcaagaatggcaaaaaggtgattcaactgtcccggaagaccttcgatacagaataccagaaaaccaagctcaacgactgggattttgtggtcacaaccgacatctctgagatgggagctaatttcaaagccgatagagttatcgacccccggcgctgcctgaagcccgtgattctgacggatgggcctgagagagtgatcctcgcgggacccatgcctgtcacagccgctagcgccgctcagcggcgcggcagagtggggcggaacccgcagaaagaaaatgaccaatatatttttaccggacagccccttaacaatgatgaggaccatgcccactggaccgaagctaagatgctgctggacaacatcaatacacctgagggcattatccccgccctcttcgaacctgagagagagaagtccgcggccatcgatggggaataccgcctgaaaggcgagagccggaagaccttcgttgaacttatgagacgcggagacctgcccgtgtggctcgctcacaaagtcgcctctgagggcattaagtatacagatcggaaatggtgctttgacgggcagagaaacaatcagatcctggaagagaacatggatgtggagatttggacgaaggaaggagagaaaaagaagctgcgcccgcggtggctcgacgctagaacctactccgatcctcttgccctgaaagagttcaaggagtttgccgctggccgcaaaagcatcgcgctggacctcgttacagaaattgggagagtgccctctcatctggcccaccggacccgcaatgctcttgataacctggtcatgctccatacatccgagcacggaggcagagcctatcggcacgccgtggaggaactgcctgagaccatggaaacgctgctccttctgggcctgatgatcctcctgaccgggggagctatgcttttcctgatcagcggcaaggggattggaaaaacatccatcggcctcatttgtgtcatcgcctctagcgggatgctgtggatggcggagattcccctgcaatggatcgcctccgctattgtgctcgagtttttcatgatggttcttctgatccctgaacccgagaagcagcgcaccccgcaggacaatcaactggcctacgtggtgatcggcattctcacactggctgccatcattgcggccaacgaaatgggccttctggagaccacgaagagagatctcggcatgagcaaagaacctggggtcgtttctcccacatcctatctggacgtggatctgcatcccgctagcgcctggaccctctacgctgtggccacaaccgtcatcacccctatgcttcggcacacaattgaaaattctacggctaacgtgagcctggccgcgatcgccaaccaggctgttgtgctgatgggactcgacaagggctggccgatctccaaaatggacctgggggtcccccttctggccctcggatgctactctcaggtgaatcctctgaccctgacagctgccgtcctccttctgattacccattatgccatcattggccccgggctgcaggcgaaggctacaagagaggcccaaaaacgcaccgctgccggaatcatgaagaaccctacggtggatggcattatgacaatcgacctcgatcccgttatctacgacagcaagtttgaaaaacagctgggccaggtgatgcttctggtcctctgtgccgtgcagctgctgctcatgcggacctcctgggctctttgcgaggccctgaccctggcgacagggcctattaccacactctgggaaggatctccgggcaagttctggaatacgaccatcgccgttagcatggctaacatttttagagggtcctatctggccggagctggccttgccttcagcatcatgaaatctgtggggacaggaaagcgcggcaccggctcccaaggggagacactgggagaaaaatggaagaagaaactcaatcagctgagccggaaggattttgacctgtacaaaaagtccggcattaccgaggtcgatagaacggaggcgaaagaagggctcaagcggggagagatcacccaccatgccgtgtctcgcggcagcgctaaacttcagtggttcgtggaaagaaacatggttattcccgaggggcgggtcatcgacctgggatgtggccgcggcgggtggtcctattactgcgccggactgaagaaggtgacagaagtgagaggctataccaaagggggacctggccacgaggagcccgtccctatgtctacatacgggtggaatatcgttaagctcatgagcggaaaagatgtgttttacctgcccccggaaaagtgtgacacccttctgtgcgatattggcgagtccagcccttctcccacagtggaagagtcccggaccatccgcgtcctcaaaatggtggagccctggctgaagaacaatcagttctgtattaaggttctgaacccttatatgcccacggtgatcgaacacctcgagagacttcaacggaaacatggcgggatgctggtccgcaatcctctgagcagaaactctacacacgaaatgtactggatttccaatggaaccggcaacatcgtggctagcgttaatatggtgtctcggctcctgcttaacagattcaccatgacacatcgccggccgacgatcgagaaggacgtcgatctgggggccggaaccagacacgtgaacgctgaacccgagacacctaatatggacgtgattggcgagcgcatcaaacggattaaggaggaacacaacagcacctggcattatgacgatgaaaatccctacaaaacatgggcctatcacgggtcctacgaggtcaaggcgaccggatctgccagctccatgatcaacggcgttgtgaagctcctgacaaaaccttgggacgtggtccccatggtgacccagatggctatgacggataccacaccgtttggccagcaaagagttttcaaggaaaaagtggacacccgcacacctcggagcatgcccgggaccagacgcgtcatgggaattacggccgagtggctgtggcggacactcggcagaaataagaaacctcgcctgtgcacccgggaggaatttacaaagaaggtgagaaccaacgctgccatgggggccgttttcacggaggaaaatcagtgggattccgcgaaagctgccgtggaggacgaagatttttggaaacttgtcgaccgcgagagagagctgcataaactcggaaagtgtggctcttgcgtgtataacatgatggggaaacgggaaaagaaactgggcgagttcggaaaggccaagggcagccgcgctatctggtacatgtggcttggggccagatacctggaatttgaggctctcggattcctgaatgaggatcactggttttcccgggaaaactcttatagcggcgttgagggggaaggactgcataaactcggctacatcctgagagacatttccaagatccccgggggcgccatgtatgcggatgacaccgccggatgggacacacggattaccgaggatgaccttcacaatgaagagaaaatcacacagcagatggatcctgagcaccgccaactggctaacgccattttcaagctcacctaccagaataaagtggtcaaggtgcagagacccacaccgaccggcacggtcatggacatcatctctcggaaggatcagcgcgggagcggacaagtgggcacatatgggctgaacacctttaccaatatggaagctcagcttattagacagatggagggagaaggcgttctgtccaaagccgacctcgagaaccctcatctgcccgaaaagaaaatcacacagtggctggagaccaagggggtggagcggctcaaacgcatggcgattagcggcgatgactgcgtcgtgaagcccatcgatgacagattcgccaacgctctgcttgccctgaatgatatgggaaaggtgcggaaagacattcctcaatggcagccgtctaagggctggcacgattggcagcaggttcccttttgttcccatcacttccacgaactcatcatgaaagacgggcgcaagctggtggtcccttgcagaccccaagacgagcttattggacgggctcgcatcagccagggcgccgggtggtctctgaaagaaacagcttgtctcggaaaggcctacgcgcagatgtggtccctgatgtatttccatagacgggatctgcgcctcgccagcaacgctatctgctctgccgtgcctgttcactgggtgcccacgtccagaaccacatggagcattcatgcccaccatcaatggatgaccacagaggacatgctgaccgtctggaatcgggtgtggatcgaagataacccttggatggaggacaagacgcccgtcaccacatgggagaatgtgccgtaccttggcaaaagagaagatcagtggtgtgggtccctgattggcctcaccagccgcgctacatgggcccagaacatccctaccgcgattcagcaagttcggtctctgatcggaaatgaggaatttcttgactacatgcccagcatgaagagattccgcaaagaggaggaatccgagggcgctatctggtga

SEQ ID NO: 20610 - RNA, 9873 nt, synthetic construct
  misc_feature 1..9873: note = derived and/or modified CDS sequence (opt5) from DENV-3__KF973485__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaataaaaaggagcttctggtcacctttaaaaacgctcacgcgaagaagcaagaagtggtcgtgctcgggtctcaggagggagccatgcacacagctctgaccggcgccaccgaaatccaaaattccgggggcacaagcattttcgccggacatctgaaatgtcggctcaagatggacaaactggagcttaagggcatgtcttacgctatgtgcacgaacacctttgttctgaaaaaggaggtgtccgaaacacagcacgggaccatcctcatcaaggtcgagtacaaaggagaagatgtgccctgtaagattcctttcagcacagaggacggccaagggaaagcccataacggacgcctgatcaccgcgaatcccgttgtgacgaagaaagaggaacccgtcaacattgaggctgaacctccgttcggcgagtccaatatcgtgattgggatcggcgataacgccctgaagatcaattggtataagaaaggatctagcattggcaagatgtttgaagccacagctagaggggcccggagaatggctatccttggagacaccgcctgggatttcggctccgtcggcggggttctcaacagcctggggaaaatggtccaccagatttttgggtctgcgtacaccgccctgttctccggcgtgagctgggtgatgaagatcggaattggcgtcctcctgacatggatcgggcttaattctaaaaacaccagcatgtccttttcttgcattgctatcggaatcattacactgtatctcggcgccgtggttcaggctgacatggggtgtgtgatcaattggaagggaaaggagctgaaatgcggcagcgggattttcgtcacgaacgaggtgcatacctggacagaacagtacaagtttcaagccgattcccccaaacgcctggcgaccgccatcgctggcgcctgggagaatggagtttgtggcattcggagcacaaccagaatggaaaaccttctctggaagcagatcgctaatgagctgaactatatcctgtgggaaaataacattaaactcacggtggtcgtgggggacatcattggagttctggagcagggcaagcgcacccttacacctcagcccatggagctgaaatactcttggaagacctgggggaaggccaaaatcgtgacagccgaaacccaaaactccagcttcattatcgatggacctaatacacccgagtgcccgtctgtctcccgggcttggaacgtgtgggaagtggaggactatggctttggcgtcttcaccacgaatatctggctcaagctgagagaagttcacacacagctgtgtgaccaccgccttatgagcgcggccgtgaaagatgagcgggctgtgcatgccgacatggggtactggattgagtcccagaagaacggatcttggaaactcgaaaaggccagcctgatcgaggtcaagacctgcacctggcctaaatcccacacactgtggtctaatggcgtgctcgaaagcgatatgattatccccaagtccctggctgggcctattagccagcataaccacagacccggataccacacccaaacggccggcccttggcatcttgggaaactggagctcgactttaattattgcgagggaacaaccgttgtgatcacagaaaactgtggcacccgcggcccctctctgcggacaaccacggtctccgggaagctgatccacgagtggtgctgtagaagctgcacccttccgcctctccgctacatgggagaagatggctgttggtatgggatggagattcggcccatctctgaaaaagaggagaatatggtgaagtccctggttagcgcgggatctggcaaggtggacaacttcacaatgggggtcctgtgcctcgctattctgtttgaagaggtgatgagaggaaaattcggcaagaaacatatgatcgccggcgttttctttaccttcgtgcttctgctcagcgggcagattacatggcgggatatggcccacaccctgatcatgattggatccaatgctagcgaccgcatgggcatgggggtcacgtacctggcccttatcgcgacatttaagatccagcccttcctggctctcggatttttcctgagaaaactcacctctcgggaaaacctgcttctgggcgtggggctcgccatggccacaaccctgcaactgcctgaggatattgaacagatggctaatggaatcgcccttggcctgatggctctcaagctgattacccagtttgagacatatcagctctggacggccctgatctcccttacctgtagcaacacaattttcaccctgacagtggcgtggagaaccgccacgctcatcctggctggcgtctccctgcttccggtttgccaatctagctccatgcgcaagacagactggctgcccatggccgtggctgccatgggggtgcctcccctccctctgtttatcttcggactcaaagataccctgaagcggagatcttggccccttaatgagggcgtcatggccgtggggctggttagcattctggcttcctctctcctgcgcaacgacgtgcctatggcgggaccccttgtcgccggcgggctgctcatcgcttgttacgtgattaccggaacaagcgccgatctgaccgttgaaaaagccgctgacatcacatgggaggaagaggccgaacagacgggcgtgtcccataacctcatgattaccgtcgacgatgacggcacaatgagaatcaaggatgacgagaccgagaatatcctgacagtgcttctgaaaaccgcgctgctcattgtcagcgggatctttccgtattctattcctgctacgctgcttgtgtggcacacctggcagaagcagacacaacggtccggagttctgtgggatgtgcccagccctcccgaaacccagaaagccgagctcgaagagggcgtctaccgcatcaagcagcaggggattttcggaaagacacaagtgggcgttggggtgcagaaagagggagtctttcacaccatgtggcatgtgacaagaggcgccgtgctgacgtacaacggcaagcggctcgaaccgaattgggcttctgttaaaaaggacctgatctcctatgggggaggctggcgccttagcgcccagtggaaaaagggggaggaagtccaagtgattgcggtggagcctggaaagaaccccaaaaatttccagaccatgcctggcacattccagaccaccacaggggaaatcggagctatcgccctggattttaagcccggcacgtctggctcccccattatcaacagagaggggaaagtcgtgggactgtacggcaatggggttgtgaccaagaacggaggctatgtcagcgggattgcccagacaaatgctgagcctgacggcccgacccccgaactcgaggaagagatgttcaaaaagcggaacctgacaatcatggatcttcaccctggatccggcaagacccgcaaatacctgcccgccattgtgagagaagctatcaagcggcgcctcagaacgctgatcctcgcccctacacgggttgtggcggccgagatggaggaagctctgaaagggcttcccattagatatcaaaccaccgccacaaagagcgagcataccggacgcgaaatcgtcgacctgatgtgccacgctacatttaccatgcggctgctctctcctgtgagagttccgaattacaacctgattatcatggatgaggcccatttcacggaccccgccagcattgctgcgcgcggctatatctccacacgggtggggatgggagaagccgctgccatctttatgaccgccacacctcccggcaccgctgatgccttccctcagtctaatgcgcccattcaggacgaggagagagacatcccggaacgcagctggaactccgggaatgagtggattacggattttgctggcaaaaccgtctggttcgtgccttctatcaaggccggaaacgacattgccaactgtcttcggaagaatggcaaaaaggtgatccagctgagcagaaaaacatttgataccgaataccaaaagacaaaactcaacgactgggatttcgtcgttaccacagacatttccgagatgggggctaattttaaggccgatcgcgtgatcgacccccggagatgcctgaagcccgtgatcctgaccgatggacctgagcgggtcattctcgcgggccccatgcctgtgacggttgcctctgctgcccagcgcagagggcgggtgggacgcaacccgcagaaagaaaatgaccagtacatcttcacaggccaaccccttaacaatgatgaggaccacgctcactggaccgaagccaagatgctgctggacaacattaatacccctgaggggatcattcccgctctcttcgaacctgagagagagaaaagcgccgcgatcgatggcgaatatcggctgaagggagagtccagaaaaacatttgtcgaacttatgcgccggggcgacctgcccgtgtggctcgcccataaggttgctagcgaggggatcaaatacaccgatagaaagtggtgcttcgacggacagcgcaacaatcagattctggaagagaacatggatgtggagatctggacaaaggaaggcgagaaaaagaaactgcggccgagatggctcgacgcccgcacgtattctgatcctcttgctctgaaggaatttaaagagttcgccgccgggcggaagtccattgctctggacctcgtcaccgaaatcggaagagtgcccagccacctggcgcatcgcacaagaaatgcccttgataacctggtcatgctccacacctctgagcacggcggccgggcttaccgccatgccgtggaggaactgcctgagacaatggaaaccctgctccttctggggctgatgattctcctgacgggaggcgccatgctttttctgatctccgggaagggaatcggcaaaaccagcattgggctcatctgtgttattgcttcctctggaatgctgtggatggccgagatccccctgcagtggattgcgagcgccatcgtgctcgagttctttatgatggtgcttctgattcctgaacccgagaagcaaagaacaccgcaggacaatcagctggcttatgtcgttatcggcatcctcaccctggccgctattatcgccgcgaacgaaatgggccttctggagacaaccaaacgggatctcgggatgtccaaggaacctggagtggtgagccccacgtcttacctggacgtcgatctgcaccccgcctccgcttggacactctatgccgtggctaccacagttattacccctatgcttcgccataccatcgagaatagcacagccaacgtgtctctggctgccattgcgaaccaagccgtcgtgctgatgggcctcgacaaagggtggccgatcagcaagatggacctgggagtcccccttctggctctcggctgctactcccaggtgaatcctctgacgctgaccgccgctgttctccttctgatcacacactacgccattatcgggcccggactgcaggccaaggcgaccagagaggctcagaaacggacagccgctggcattatgaagaaccctaccgtggatggcatcatgacgattgacctcgatcccgtcatctatgactctaaattcgaaaagcaactgggacaggtgatgcttctggttctctgtgtggtccagctgctgctcatgagaacaagctgggccctttgcgaggccctgaccctggctaccggacctatcacaaccctctgggaaggctccccggggaaattttggaatacaacgattgccgtgtctatggcgaacatcttccgcggaagctacctggccggcgctgggcttgccttttccattatgaaaagcgtgggaaccggcaagcggggcacagggtctcagggagagaccctgggcgaaaaatggaagaaaaagctcaatcaactgtccagaaaagatttcgacctgtataagaaaagcgggatcacagaggttgatcgcaccgaggctaaggaaggactcaagcggggcgagattacgcatcacgccgtctccagagggtctgcgaaacttcagtggtttgtggaacggaacatggtgatccccgagggacgcgtcattgacctgggctgtggcagagggggatggagctactattgcgccggcctgaagaaagttaccgaagtgcgggggtacacaaagggaggccctgggcacgaggagcccgtgcctatgtccacctatggatggaatatcgtcaaactcatgtctggcaaggatgtgttctacctgcccccggaaaagtgtgacacacttctgtgcgatatcggcgagagctcccctagccccaccgttgaagagtctcgcacaattagagtgctcaaaatggtcgagccctggctgaagaacaatcagttctgtatcaaagtgctgaacccttacatgcccaccgttattgaacatctcgagcggcttcagcgcaagcacgggggaatgctggtgagaaatcctctgtcccggaacagcacgcatgaaatgtattggatctctaatggcacagggaacattgtcgcttccgtgaatatggtgagccgcctcctgcttaacagatttaccatgacccaccggagaccgacaatcgagaaagacgtcgatctgggagccggcacgcgccacgttaacgctgaacccgagacccctaatatggaggtgatcggggaacggattaagagaatcaaggaggaacataactctacatggcactacgacgacgagaatccctataaaacctgggcctaccatggaagctatgaagtgaaggctacaggctccgcctctagcatgattaacggcgtcgtgaaactcctgaccaagccttgggatatggttcccatggtgacacaaatggcgatgaccgacacgaccccgttcgggcagcagcgcgtctttaaagagaaggtggatacacggacccctagatccatgcccggaacacgccgggttatgggcatcaccgccgagtggctgtggagaacgctcgggcgcaataagaaacctcggctgtgcacaagagaagagttcaccaagaaagtgcgcacaaacgctgccatgggagctgtctttaccgaagagaatcaatgggacagcgccaaggccgcggtggaagatgaggacttctggaaacttgttgatcgggagagagaactgcacaagctcggcaaatgtgggtcctgcgtgtacaacatgatgggcaagcgcgagaagaaactgggagaatttggcaaggctaaagggtctagagccatttggtatatgtggcttggagcccggtacctggagttcgaggctctcggctttctgaatgaagaccattggttcagccgcgagaactcctactctggggtcgaaggagagggcctgcacaagctcgggtatatcctgagagatatcagcaaaattcccggcggagccatgtacgctgacgatacggccggctgggacacccggatcacagaagacgatcttcacaatgaggagaagattacccagcagatggaccctgaacatagacagctggcggatgccatctttaagctcacatatcaaaacaaagtggtcaaggtgcagcggcccaccccgacagggaccgttatggacattatctcccgcaaagatcagagaggatctggccaggtggggacgtacggactgaatacattcaccaacatggaggctcaacttatccggcagatggaaggcgagggggtcctgagcaaggccgacctcgaaaatcctcatctgcccgagaaaaagattacccagtggctggagacaaagggcgtggaacgcctcaaaagaatggctatctccggagatgactgcgtggttaagcccattgatgaccggtttgccaacgcgctgcttgccctgaacgatatgggcaaagtgcgcaaggacatccctcagtggcaaccgagcaaagggtggcatgattggcagcaggtccccttctgttctcaccacttccatgagctcattatgaaggacggaagaaagctggtggttccttgccggccccaggacgaacttatcggccgcgctagaatttcccaaggggccggatggagcctgaaagagaccgcttgtctcggcaaggcctatgctcagatgtggtctctgatgtactttcaccggcgcgatctgagactcgcctccaatgcgatctgcagcgccgtgcctgtccattgggtgcccacatctcggacgacctggtccatccacgctcatcaccagtggatgacaaccgaagacatgctgacagtctggaaccgcgtgtggattgaggataatccttggatggaggacaaaacccccgttacgacctgggaaaacgtgccgtatcttgggaagagagaggatcaatggtgtggcagcctgatcggactcacatcccgggccacctgggcccagaatattcctacagctatccagcaggtcagaagcctgattggcaacgaagagttccttgactacatgccctctatgaaacgctttcggaaggaggaagagagcgaaggggccatctggtga

SEQ ID NO: 20611 - RNA, 9873 nt, synthetic construct
  misc_feature 1..9873: note = derived and/or modified CDS sequence (opt5) from DENV-3__KF973486__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggccagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaagggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggccagacgcatggctatccttggagacaccgcctgggatttcggctccgtcggcggggttctcaacagcctggggaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgggatctggcaaggtggacaacttcacaatgggggtcctgtgcctcgctattctgtttgaagaggtgatgcggggaaagttcggcaaaaagcacatgatcgccggcgttttctttaccttcgtgcttctgctcagcgggcagattacatggcgcgatatggcccataccctgatcatgattggatccaatgctagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatggccgtggctgccatgggggtgcctcccctccctctgtttatcttcggactcaaggataccctgaaaagacgctcttggccccttaatgagggcgtcatggccgtggggctggttagcattctggcttcctctctcctgagaaacgacgtgcctatggcgggaccccttgtcgccggcgggctgctcatcgcttgttatgtgattaccggaacaagcgccgatctgaccgttgaaaaggccgctgacatcacatgggaggaagaggccgaacagacgggcgtgtcccacaacctcatgattaccgtcgacgatgacggcacaatgcggatcaaagatgacgagaccgagaatatcctgacagtgcttctgaagaccgcgctgctcattgtcagcgggatctttccgtactctattcctgctacgctgcttgtgtggcatacctggcagaaacagacacaacgctccggagttctgtgggatgtgcccagccctcccgaaacccagaaggccgagctcgaagagggcgtctacagaatcaaacagcaggggattttcggaaagacacaagtgggcgttggggtgcagaaggagggagtctttcacaccatgtggcacgtgacacggggcgccgtgctgacgtataacggcaaacgcctcgaaccgaattgggcttctgttaagaaagacctgatctcctacgggggaggctggagacttagcgcccagtggcaaaagggggaggaagtccaggtgattgcggtggagcctggcaagaaccccaagaatttccagaccatgcctggcacattccagaccaccacaggggaaatcggagctatcgccctggattttaagcccggcacgtctggctcccccattatcaaccgggaggggaaagtcgtgggactgtatggcaatggggttgtgaccaagaacggaggctacgtcagcgggattgcccaaacaaatgctgagcctgacggcccgacccccgaactcgaggaagagatgttcaaaaagcgcaacctgacaatcatggatcttcatcctggatccggcaaaaccagaaagtatctgcccgccattgtgcgggaagctatcaagcgcagactccggacgctgatcctcgcccctacaagagttgtggcggccgagatggaggaagctctgaaagggcttcccattcgctaccagaccaccgccacaaagagcgagcacaccggacgggaaatcgtcgacctgatgtgccatgctacatttaccatgagactgctctctcctgtgcgcgttccgaattataacctgattatcatggatgaggcccacttcacggaccccgccagcattgctgcgcggggctacatctccacaagagtggggatgggagaagccgctgccatctttatgaccgccacacctcccggcaccgctgatgccttccctcagtctaatgcgcccattcaggacgaggagcgcgacatcccggaacggagctggaactccgggaatgagtggattacggattttgctggcaaaaccgtctggttcgtgccttctatcaaggccggaaacgacattgccaactgtcttcgcaaaaatggcaagaaggtgatccaactgagcagaaaaacatttgataccgaataccagaagacaaaactcaacgactgggatttcgtcgttaccacagacatttccgagatgggggctaattttaaggccgatcgggtgatcgaccccagacggtgcctgaaacccgtgatcctgaccgatggacctgagcgcgtcattctcgcgggccccatgcctgtgacggccgcttctgccgctcagagacgggggcgcgttggaagaaacccgcagaaggaaaatgaccaatatatcttcacaggccagccccttaacaatgatgaggaccatgcccactggaccgaagctaagatgctgctggacaacattaatacccctgaggggatcattcccgccctcttcgaacctgagcgggagaaaagcgcggccatcgatggcgaatacagactgaagggagagtcccgcaaaacatttgtggaacttatgcggagaggcgacctgcccgtctggctcgctcacaaggtggccagcgaggggatcaaatataccgatcgcaagtggtgcttcgacggacagcggaacaatcagattctggaagagaacatggatgttgagatctggacaaaagaaggcgagaagaagaaactgagaccgcgctggctcgacgctcggacgtactctgatcctcttgccctgaaggaatttaaagagttcgccgctgggagaaagtccattgcgctggacctcgtgaccgaaatcggacgcgtccccagccatctggcccacagaacacggaatgctcttgataacctggtgatgctccatacctctgagcacggcggccgcgcctatagacacgccgtcgaggaactgcctgagacaatggaaaccctgctccttctggggctgatgattctcctgacgggaggcgctatgctttttctgatctccgggaaaggaatcggcaagaccagcattgggctcatctgtgtgattgcctcctctggaatgctgtggatggcggagatccccctgcaatggattgccagcgctatcgttctcgagttctttatgatggtgcttctgattcctgaacccgagaagcagcggacaccgcaggacaatcaactggcctacgtggtcatcggcatcctcaccctggctgccattatcgcggccaacgaaatgggccttctggagacaaccaaacgcgatctcgggatgtccaaggaacctggagttgtgagccccacgtcttatctggacgtggatctgcatcccgcttccgcctggacactctacgctgtcgccaccacagtgattacccctatgcttagacacaccatcgagaatagcacagctaacgtttctctggccgcgattgccaaccaggctgtggtcctgatgggcctcgacaaagggtggccgatcagcaagatggacctgggagcgccccttctggctctcggctgctactcccaggtgaatcctctgacgctgaccgccgccgtcctccttctgatcacacattatgcgattatcgggcccggactgcaggctaaagccacccgggaggctcaaaagagaacagccgccggcattatgaagaaccctaccgtggatggcatcatgacgattgacctcgatcccgttatctacgactctaaattcgaaaagcagctgggacaggtgatgcttctggtcctctgtgctgtgcagctgctgctcatgcgcacaagctgggccctttgcgaggcgctgaccctggccaccggacctatcacaaccctctgggaaggctccccggggaaattttggaatacaacgattgctgtttctatggccaacatcttccggggaagctatctggctggcgccgggcttgcgttttccattatgaaaagcgtgggaaccggcaaaagaggcacagggtctcaaggagagaccctgggcgaaaagtggaagaaaaagctcaatcagctgtcccgcaaagatttcgacctgtacaagaaaagcgggatcacagaggtcgatcggaccgaggccaaggaaggactcaaaagaggcgagattacgcaccatgctgtgtcccgggggtctgccaaacttcagtggtttgtggaacgcaacatggttatccccgagggaagagtcattgacctgggctgtggcagagggggatggagctattactgcgctggcctgaagaaagtgaccgaagtgcgcgggtatacaaagggaggccctgggcacgaggagcccgtccctatgtccacctacggatggaatatcgttaaactcatgtctggcaaggatgtgttctacctgcccccggaaaaatgtgacacacttctgtgcgatatcggcgagagctcccctagccccaccgtggaagagtctagaacaattcgggtcctcaagatggtggagccctggctgaagaacaatcagttctgtatcaaagttctgaacccttatatgcccaccgtgattgaacacctcgagcgccttcaaagaaagcatgggggaatgctggtccggaatcctctgtcccgcaacagcacgcacgaaatgtactggatctctaatggcacagggaacattgtggcctccgttaatatggtgagcagactcctgcttaaccggtttaccatgacccatagacgcccgacaatcgagaaagacgtcgatctgggagctggcacgcggcacgtgaacgccgaacccgagacccctaatatggacgtgatcggggagagaattaagcgcatcaaagaagaacacaactctacatggcattatgacgatgaaaatccctacaagacctgggcgtatcacggaagctacgaggtcaaggccacaggctccgcttctagcatgattaacggcgttgtgaaactcctgaccaagccttgggacgtggtccccatggtgacacagatggccatgaccgatacgaccccgttcgggcagcaacgggtttttaaagaaaaggtggacacaagaacccctcgctccatgcccggaacacggagagtcatgggcatcaccgctgagtggctgtggcgcacgctcgggcggaataaaaagcctagactgtgcacacgcgaggagttcaccaagaaagtgcggacaaacgccgccatgggagcggtttttaccgaggaaaatcagtgggatagcgctaaggccgccgtggaggacgaagatttctggaaacttgtcgacagagagcgcgagctgcataagctcggcaaatgtgggtcctgcgtgtataacatgatgggcaagagagagaagaagctgggagagtttggcaaggctaaagggtctcgggccatttggtacatgtggcttggagctcgctacctggagttcgaggccctcggctttctgaatgaggatcactggttcagcagagaaaactcctattctggggttgagggagaaggcctgcataagctcgggtacatcctgcgggacatcagcaaaattcccggcggagcgatgtatgccgatgacacggctggctgggacaccagaatcacagaggatgaccttcacaatgaagagaagattacccagcagatggatcctgagcaccggcaactggccaacgctatctttaaactcacataccagaataaggtggtcaaggtgcagcgccccaccccgacagggaccgtcatggacattatctccagaaaagatcagcggggatctggccaagtggggacgtatggactgaacacattcaccaatatggaagcccagcttatccgccagatggagggcgaaggggttctgagcaaggcggacctcgagaaccctcatctgcccgagaaaaagattacccagtggctggagacaaaaggcgtggagagactcaagcggatggccatctccggagatgactgcgtcgtgaagcccattgatgaccgctttgctaacgccctgcttgctctgaatgatatgggcaaagtgagaaaggacatccctcaatggcagccgagcaaagggtggcacgattggcagcaggttcccttctgttctcatcacttccacgaactcattatgaaggacggacggaaactggtggtcccttgccgcccccaagacgagcttatcggcagagcccggatttcccagggggctggatggagcctgaaggaaaccgcctgtctcggcaaggcgtacgcccagatgtggtctctgatgtattttcatcgcagagatctgcggctcgcttccaacgccatctgcagcgccgtgcctgttcactgggtgcccacatctcgcacgacctggtccatccatgctcaccatcaatggatgacaaccgaggacatgctgacagtctggaatagagtgtggattgaagataacccttggatggaggacaaaacccccgtcacgacctgggagaatgtgccgtaccttgggaagcgggaagatcagtggtgtggcagcctgatcggactcacatccagagccacctgggcgcagaacattcctacagctatccagcaagttcgcagcctgattggcaatgaggagttccttgactacatgccctctatgaaacggtttagaaaggaggaggaaagcgagggggccatctggtga

SEQ ID NO: 20612 - RNA, 9873 nt, synthetic construct
  misc_feature 1..9873: note = derived and/or modified CDS sequence (opt5) from DENV-3__FJ898458__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaaacgctcctgtttaagacagcgtctggcatcaatatgtgtacacttattgctatggatctgggggaaatgtgcgacgataccgtcacatacaaatgtccgcatatcaccgaagttgagcccgaagacattgattgctggtgtaacctcacaagcacctgggtgacgtatggaacctgcaatcaggccggcgagcacagacgggacaagcgctccgtggccctggctcctcatgtcgggatgggactggatacaagaacccagacatggatgtctgccgagggcgcttggagacaggtggaaaaagttgagacctgggccctccgccaccccggcttcacgatcctggcgctttttctggcccattacatcgggacaagcctcacccagaaggtggtcattttcatcctgcttatgctggtgacaccttccatgaccatgagatgtgttggagtgggcaaccgggactttgtcgaagggctctctggagctacctgggtggatgtggtcctggagcacggcgggtgcgttacaacgatggccaagaataaacccaccctggacattgagctccagaagacagaagctacccagctggccacacttcgcaaactgtgtatcgagggaaagattaccaacatcacgacagatagcagatgccctacccagggcgaagcggtgctcccggaggaacaggaccagaattatgtgtgtaaacacacctacgtcgatcggggctgggggaacggatgcggcctgttcgggaagggatcccttgtgacatgcgccaagtttcaatgtctggagcccattgagggcaaagttgtgcagtatgaaaatctcaagtacaccgtcatcatcacagtgcatacgggggaccagcaccaggttggaaacgagacccaaggcgtgacagctgaaattacccctcaggccagcacaaccgaggctatcctgcccgaatatggcacgctggggctcgagtgctctcctcgcaccggactggacttcaatgagatgattcttctgacaatgaaaaacaaggcctggatggtccatagacagtggtttttcgatctccccctgccgtggacctccggcgccacaaccgaaacgcctacatggaatcggaaagagcttctggtgacctttaagaacgctcacgcgaaaaagcaagaagtcgtggttctcgggagccaggagggagccatgcacacagctctgaccggcgccaccgaaatccaaaattctgggggcacatccattttcgccggacatctgaagtgtcgcctcaaaatggacaagctggagcttaaaggcatgagctacgctatgtgcacgaacacctttgtgctgaagaaagaggtctctgaaacacagcacgggaccatcctcatcaaggtggagtacaagggagaagatgttccctgtaaaattcctttctccacagaggacggccatgggaaggcccacaacggaagactgatcaccgcgaatcccgtggtcacgaaaaaggaggaacccgtgaacattgaggctgaacctccgttcggcgagagcaatatcgtgattgggatcggcgataacgccctgaaaatcaattggtataagaagggatcctctattggcaaaatgtttgaagccacagctagaggggccagacgcatggctatccttggagacaccgcctgggatttcggcagcgttgggggagtcctcaactccctgggcaagatggtgcatcaaatttttgggagcgcgtacaccgccctgttctctggcgtgtcctgggtcatgaaaatcggaattggcgtgctcctgacatggatcgggcttaatagcaagaacacctctatgagcttttcctgcattgctatcggaatcattacactgtatctcggcgccgttgtgcaggctgacatggggtgtgtcatcaattggaaaggaaaggagctgaagtgcggctctgggattttcgtgacgaacgaggttcacacctggacagaacagtacaaatttcaggccgatagccccaagcggctggcgaccgccatcgctggcgcctgggagaatggagtgtgtggcattagatccacaacccgcatggaaaaccttctctggaaacaaatcgctaatgagctgaactatatcctgtgggaaaataacattaagctcacggtcgtggttggggacatcattggagtgctggagcagggcaaacggacccttacacctcagcccatggagctgaagtacagctggaaaacctgggggaaggccaagatcgtcacagccgaaacccagaactcttccttcattatcgatggacctaatacacccgagtgcccgagcgcttctagagcgtggaacgtgtgggaagtggaggactatggctttggcgtcttcaccacgaatatctggctcaaactgcgcgaagtttacacacaactgtgtgaccaccggcttatgtccgccgctgtgaaggatgagagagccgtgcatgccgacatggggtactggattgagagccagaaaaacggatcctggaagctcgaaaaggcttctctgatcgaggtcaagacctgcacctggcctaagagccacacactgtggtccaatggcgtgctcgaatctgatatgattatccccaaaagcctggccgggcctatttcccagcataaccaccgccccggatatcacacccagacggcgggcccttggcatcttgggaagctggagctcgactttaattactgcgagggaacaaccgttgtgatcacagaaaactgtggcacccggggccccagcctgagaacaaccacggtctctgggaaactgatccacgagtggtgctgtcgctcctgcacccttccgcctctccggtatatgggagaagatggctgttggtacgggatggagattagacccatcagcgaaaaggaggagaatatggtgaaatctctggtttccgctggaagcggcaaggtggacaacttcacaatgggggtcctgtgcctcgccattctgtttgaagaggtgatgcggggaaagttcggcaaaaagcatatgatcgccggcgttttctttaccttcgtgcttctgctctctgggcaaattacatggcgcgatatggctcacaccctgatcatgattggaagcaatgcctccgacagaatgggcatgggggtcacgtatctggcgcttatcgctacatttaaaatccagcccttcctggccctcggatttttcctgcggaagctcaccagcagagaaaacctgcttctgggcgtggggctcgccatggctacaaccctgcagctgcctgaggatattgaacaaatggccaatggaatcgctcttggcctgatggccctcaaactgattacccagtttgagacataccagctctggacggcgctgatctctcttacctgttccaacacaattttcaccctgacagtggcctggcgcaccgctacgctcatcctggccggcgtcagcctgcttccggtttgccagtcctctagcatgcggaagacagactggctgcccatgaccgtggctgccatgggggtgcctcccctccctctgtttatcttctccctcaaggataccctgaaaagacgctcttggccccttaatgagggagtcatggccgtgggcctggttagcattctggcttcctctctcctgagaaacgacgtgcctatggcggggccccttgtcgccggaggcctgctcatcgcttgttatgtgattacagggaccagcgccgatctgacagttgaaaaggccgctgacatcacgtgggaggaagaggccgaacaaaccggagtgtcccataacctcatgattacagtcgacgatgacggcaccatgcggatcaaagatgacgagacagagaatatcctgaccgtgcttctgaagacggcgctgctcattgtcagcggcatctttccgtactctattcctgctaccctgcttgtgtggcacacatggcagaaacagacccagcgctccggggttctgtgggatgtgcccagccctcccgaaacacaaaaggccgagctcgaagagggagtctacagaatcaaacagcagggcattttcgggaagacccaggtgggagttggcgtgcaaaaggagggggtctttcacacaatgtggcatgtgacgcggggagccgtgctgacctataacggcaaacgcctcgaaccgaattgggcttctgttaagaaagacctgatctcctacggcgggggatggagacttagcgcccagtggaagaaaggcgaggaagtccaggtgattgcggtggagcctgggaagaaccccaagaatttccaaacaatgcctggaaccttccagaccacaacgggcgaaatcggggctatcgccctggattttaaacccggaacctctggctcccccattatcaaccgggagggcaaggtcgtggggctgtatggaaatggcgttgtgaccaagaacgggggatacgtcagcggcattgcccagaccaatgctgagcctgacgggccgacacccgaactcgaggaagagatgttcaagaaacgcaacctgaccatcatggatcttcaccctggctccggaaagacgagaaagtatctgcccgccattgtgcgggaagctatcaaacgcagactccggacactgatcctcgcccctaccagagttgtggcggccgagatggaggaagctctgaagggccttcccattcgctaccagaccacagccaccaaaagcgagcatacagggcgggaaatcgtcgacctgatgtgccacgctacctttacgatgagactgctctctcctgtgcgcgttccgaattataacctgattatcatggatgaggcccatttcacagaccccgccagcattgctgcgcggggatacatctccaccagagtgggcatgggggaagccgctgccatctttatgacagccacccctcccggaacggctgatgccttccctcaatctaatgcgcccattcaggacgaggagcgcgacatcccggaacggagctggaactccggcaatgagtggattaccgattttgctgggaagacagtctggttcgtgccttctatcaaagccggcaacgacattgccaactgtcttagaaagaatggaaagaaagtgatccagctgagccgcaagacctttgatacagaataccagaaaaccaagctcaacgactgggatttcgtcgttacaaccgacatttccgagatgggcgctaattttaaagccgatcgggtgatcgaccccagacggtgcctgaagcccgtgatcctgacggatgggcctgagcgcgtcattctcgcgggacccatgcctgtgacagccgcttctgccgctcaaagacggggccgcgttgggagaaacccgcagaaggaaaatgaccagtatatcttcaccggacagccccttaacaatgatgaggaccacgcccactggaccgaagctaaaatgctgctggacaacattaatacacctgagggcatcattcccgccctcttcgaacctgagcgggagaaaagcgcggccatcgatggggaatacagactgaaaggcgaatcccgcaagacctttgtggaacttatgcggagaggagacctgcccgtctggctcgctcataaagtggccagcgagggcatcaagtatacagatcgcaaatggtgcttcgacgggcaacggaacaatcagattctggaagagaacatggatgttgagatctggacgaaggaaggagagaagaaaaagctgagaccgcgctggctcgacgctcggacctactctgatcctcttgccctgaaagaatttaaggacttcgccgctggcagaaaatccattgcgctggatctcgtgacagagatcgggcgcgtccccagccacctggcccatagaacccggaatgctcttgacaacctggtgatgctccacacatctgaacacggaggccgcgcctatagacatgccgtcgaggagctgcctgaaaccatggagacgctgctccttctgggcctgatgattctcctgaccgggggagctatgctttttctgatctccggcaaggggatcggaaagacaagcattggcctcatctgtgtgattgcctcctctgggatgctgtggatggcggaaatccccctgcagtggattgccagcgctatcgttctcgagttctttatgatggtgcttctgattcctgagcccgaaaaacagcggaccccgcaagataatcagctggcctacgtggtcatcggaatcctcacactggctgccattatcgcggccaacgagatgggccttctggaaaccacgaagcgcgacctcggcatgtccaaagagcctggggttgtgagccccacatcttatctggatgtggacctgcaccccgcttccgcctggaccctctacgctgtcgccacaaccgtgattacccctatgcttagacatacaatcgaaaatagcacggctaacgtttctctggccgcgattgccaaccaggctgtggtcctgatgggactcgacaagggctggccgatcagcaaaatggatctgggggtgccccttctggccctcggatgctactcccaagtcaatcctctgaccctgacagctgccgtgctccttctgatcacccactatgccattatcggccccgggctgcaggcgaaggctacacgggaggcccagaagagaaccgctgccggaattatgaaaaaccctacggttgacggcatcatgacaattgatctcgaccccgtgatctacgattctaagttcgagaaacagctgggccaagtcatgcttctggtgctctgtgccgttcagctgctgctcatgcgcaccagctgggctctttgcgaagccctgaccctggcgacagggcctatcaccacactctgggagggatccccgggcaagttttggaatacgaccattgccgtgtctatggctaacatcttccgggggagctatctggccggagctggccttgccttttccattatgaaaagcgtcgggacaggaaagagaggcaccggctctcagggggaaacactgggagagaagtggaaaaagaaactcaatcagctgtcccgcaaggagttcgacctgtacaaaaagagcggcatcaccgaggtggatcggacggaggcgaaagaagggctcaagagaggagagattacccatcacgccgtgtcccggggctctgctaaacttcaatggtttgttgaacgcaacatggtcatccccgaggggagagtgattgacctgggatgtggccggggcgggtggagctattactgcgccggactgaaaaaggtgacagaagtccgcggctataccaaagggggacctggccacgaggagcccgttcctatgtccacatacgggtggaatatcgtgaagctcatgtctggaaaagatgtgttctacctgcccccggaaaagtgtgacacccttctgtgcgatatcggcgagagctcccctagccccacagtcgaagagtctagaaccattcgggtgctcaagatggttgagccctggctgaaaaacaatcagttctgtatcaaggtgctgaacccttatatgcccacggtcattgaacatctcgagcgccttcagagaaaacacggcgggatgctggtgcggaatcctctgtcccgcaacagcacacatgaaatgtactggatctctaatggaaccggcaacattgttgcttccgtgaatatggtcagcagactcctgcttaaccggtttaccatgacacacagacgcccgacgatcgagaaggacgtggatctgggggccggaacccggcacgtgaacgctgaacccgagacacctaatatggacgtcatcggcgagagaattaaacgcatcaaggaagaacacaactctacctggcactatgacgatgaaaatccctacaagacatgggcctatcatgggagctacgaggttaaagcgaccggatccgcctctagcatgattaacggcgtggtgaagctcctgacaaaaccttgggacgtcgtgcccatggttacccagatggctatgacggataccacaccgttcggccaacagcgggtgtttaaggaaaaagtcgacaccagaacacctcgctccatgcccgggacccggagagtgatgggaatcacggccgagtggctgtggcgcacactcggccggaataagaagcctagactgtgcacccgcgaggagttcaccaagaaggttcggaccaacgctgccatgggggccgtgtttacggaggaaaatcagtgggatagcgcgaaagctgccgtcgaggacgaagatttctggaaacttgtggacagagagcgcgagctgcacaaactcggaaagtgtggctcctgcgtttataacatgatggggaaaagagaaaagaagctgggcgagtttggaaaagccaagggctctcgggctatttggtacatgtggcttggggcccgctacctggagttcgaggctctcggatttctgaatgaggatcattggttcagcagagaaaactcctattctggcgtggagggggaaggactgcacaaactcggctacatcctgcgggacatcagcaagattcccgggggcgccatgtatgcggatgacaccgccggatgggacacaagaatcaccgaggatgaccttcacaatgaagagaaaattacacaacagatggatcctgagcatcggcagctggctaacgccatctttaagctcacctaccagaataaggtcgtgaaagtccaacgccccacaccgaccggcacggtgatggacattatctccagaaaggatcagcgggggtctggacaggttggcacatatgggctgaacaccttcaccaatatggaagctcagcttatccgccaaatggagggagaaggcgtgctgagcaaagccgacctcgagaaccctcatctgcccgaaaagaaaattacacagtggctggagaccaagggggtcgagagactcaagcggatggcgatctccggcgatgactgcgtggtgaaacccattgatgaccgctttgccaacgctctgcttgccctgaatgatatgggaaaggttagaaaagacatccctcagtggcagccgagcaagggctggcatgattggcaacaggtgcccttctgttctcaccacttccatgaactcattatgaaagacgggcggaagctggtcgtgccttgccgcccccaggacgagcttatcggacgggctcggatttcccagggcgccgggtggagcctgcgcgaaacagcttgtctcggaaaggcctacgcgcaaatgtggtctctgatgtattttcacagacgggatctgcgcctcgcctccaacgctatctgcagcgccgttcctgtgcattgggtccccacgtctagaaccacatggtccatccacgcccatcaccagtggatgaccacagaggacatgctgaccgtgtggaatcgggtctggattgaagataacccttggatggaggacaaaacgcccgtgaccacatgggagaatgttccgtaccttggcaagagagaagatcagtggtgtgggagcctgatcggcctcacctcccgcgctacatgggcccaaaacattcctaccgcgatccaacaggtgcggagcctgattggaaatgaggagttccttgactacatgccctctatgaaaagatttcgcaaggaggaggaaagcgagggcgctatctggtga

SEQ ID NO: 20613 - RNA, 9873 nt, synthetic construct
  misc_feature 1..9873: note = derived and/or modified CDS sequence (opt5) from DENV-3__KJ189256__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccatgggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcatcaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcacacgtggaccgaacagtacaaatttcaggccgattcccccaagcggctggcgacagccatcgctggcgcctgggagaatggagtgtgtggcattagaagcaccacacgcatggaaaaccttctctggaaacaaatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcaactgtgtgaccaccggcttatgagcgccgctgtgaaggatgagagagccgtgcatgccgacatggggtactggattgagtcccagaaaaacggatcttggaagctcgaaaaagctagcctgatcgaggtcaagacatgcacctggcctaagtcccacaccctgtggtctaatggcgtgctcgaaagcgatatgattatccccaaatccctggccgggcctattagccagcataaccaccgccccggatatcacacacagaccgcgggcccttggcatcttgggaagctggagctcgactttaattactgcgagggaacgacagttgtgatcaccgaaaactgtggcacacggggcccctctctgagaaccacaaccgtctccgggaaactgatccacgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcaaattacctggcgcgatatggctcacacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcagctgcctgaggatattgaacaaatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccagtctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacaaacaggagtgagccataacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcacacgtggcagaaacagacccagcgcagcggggttctgtgggatgtgccctctcctcccgaaacacaaaaggccgagctcgaagagggagtctacagaatcaaacagcagggcattttcgggaagacccaggtgggagttggcgtgcaaaaggagggggtctttcacacaatgtggcatgtgacccggggagctgtgctgacatataacggcaaacgcctcgaaccgaattgggcctccgttaagaaagacctgatcagctacggcgggggatggagactttctgcgcagtggcagaagggcgaggaagtccaagtgattgctgtggagcctgggaaaaaccccaagaatttccagacgatgcctggaaccttccagacaaccaccggcgaaatcggggccatcgccctggattttaagcccggaacatccggcagccccattatcaaccgggagggcaaagtcgtggggctgtatggaaatggcgttgtgacgaagaacgggggatacgtctccggcattgctcagaccaatgccgagcctgacgggccgacacccgaactcgaggaagagatgttcaaaaagcgcaacctgaccatcatggatcttcaccctggcagcggaaaaacaagaaagtatctgcccgctattgtgcgggaagccatcaagcgcagactccggaccctgatcctcgcgcctacgagagttgtggccgctgagatggaggaagccctgaaaggccttcccattcgctaccaaacaaccgctaccaagtctgagcatacagggcgggaaatcgtcgacctgatgtgccacgccacctttacaatgagactgctcagccctgtgcgcgttccgaattataacctgattatcatggatgaggcccatttcaccgaccccgcttccattgcggcccggggatacatctctacgagagtgggcatgggggaagctgccgccatctttatgacagctacccctcccggaacagccgatgcgttccctcagagcaatgctcccattcaggacgaggagcgcgacatcccggaacggtcctggaactctggcaatgagtggattaccgattttgccgggaaaacggtctggttcgtgcctagcatcaaggccggcaacgacattgctaactgtcttcgcaaaaatggaaagaaggtgatccagctgtccagaaaaacctttgatacagaataccaaaagaccaaactcaacgactgggatttcgtcgttacaaccgacatttctgagatgggcgccaattttaaggcggatcgggtgatcgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccagtatatcttcacgggacaaccccttaacaatgatgaggaccacgctcactggacagaagccaagatgctgctggacaacattaatacccctgagggcatcattcccgccctcttcgaacctgagcgggagaaatccgccgctatcgatggggaatacagactgaagggcgagagccgcaaaacctttgtggaacttatgcggagaggagacctgcccgtctggctcgcccataaggtggcttctgagggcatcaaatatacagatcgcaagtggtgcttcgacgggcagcggaacaatcagattctggaagagaacatggatgttgagatctggaccaaagaaggagagaagaagaaactgagaccgcgctggctcgacgcccggacatactccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacacggaggccgcgcctatagacatgctgtcgaggagctgcctgaaaccatggagacactgctccttctgggcctgatgattctcctgaccgggggagccatgctttttctgatcagcggcaaagggatcggaaagacgtccattggcctcatctgtgtgattgcgtctagcgggatgctgtggatggccgaaatccccctgcagtggattgcttccgccatcgttctcgagttctttatgatggtgcttctgattcctgagcccgaaaagcaacggaccccgcaggataatcagctggcttacgtggtcatcggaatcctcacactggccgcgattatcgccgctaacgagatgggccttctggaaaccacaaaacgcgacctcggcatgagcaaggagcctggggttgtgtctcccacctcctatctggatgtggacctgcaccccgccagcgcttggacgctctacgccgtcgctacaaccgtgattacacctatgcttagacataccatcgaaaattctaccgccaacgttagcctggcggccattgctaaccaagccgtggtcctgatgggactcgacaaaggctggccgatctccaagatggatctgggggtgccccttctggctctcggatgctactctcaggtcaatcctctgacactgacggccgccgtgctccttctgatcacccactatgcgattatcggccccgggctgcaggctaaagccacacgggaggctcagaagagaaccgccgccggaattatgaagaaccctacagttgacggcatcatgaccattgatctcgaccccgtgatctacgatagcaaattcgagaagcaactgggccaggtcatgcttctggtgctctgtgctgttcagctgctgctcatgcgcacgtcctgggccctttgcgaagcgctgacactggccaccgggcctatcaccacactctgggagggatctccgggcaaattttggaataccacaattgctgtgagcatggccaacatcttccgggggtcctatctggctggagccggccttgcgtttagcattatgaagtctgtcgggacgggaaaaagaggcaccggctcccagggggaaacactgggagagaagtggaagaaaaagctcaatcaactgagccgcaaagagttcgacctgtacaagaaatccggcatcaccgaggtggatcggacagaggccaaggaagggctcaaaagaggagagattacccatcacgctgtgtctcggggcagcgccaaacttcagtggtttgttgaacgcaacatggtcatccccgaggggagagtgattgacctgggatgtggccggggcgggtggtcctattactgcgctggactgaagaaagtgacggaagtccgcggctataccaaagggggacctggccacgaggagcccgttcctatgtctacatacgggtggaatatcgtgaaactcatgagcggaaaggatgtgttctacctgcccccggaaaaatgtgacacccttctgtgcgatatcggcgagtccagcccttctcccacagtcgaagagtccagaaccattcgggtgctcaagatggttgagccctggctgaagaacaatcagttctgtatcaaagtgctgaacccttatatgcccacagtcattgaacatctcgagcgccttcagagaaagcacggcgggatgctggtgcggaatcctctgagccgcaactctacccatgaaatgtactggatctccaatggaacgggcaacattgttgccagcgtgaatatggtctctagactcctgcttaaccggtttacaatgacccacagacgcccgaccatcgagaaagacgtggatctgggggctggaacacggcacgtgaacgccgaacccgagacgcctaatatggacgtcatcggcgagagaattaagcgcatcaaagaagaacacaacagcacctggcactatgacgatgaaaatccctacaagacatgggcgtatcatgggtcctacgaggttaaggccaccggatctgctagctccatgattaacggcgtggtgaaactcctgacaaagccttgggacgtcgtgcccatggttacccaaatggccatgacagataccacgccgttcggccagcagcgggtgtttaaagaaaaggtcgacaccagaacacctcgcagcatgcccgggacccggagagtgatgggaatcacagctgagtggctgtggcgcaccctcggccggaataaaaagcctagactgtgcacgcgcgaggagttcacaaagaaagttcggaccaacgccgccatgggggcggtgtttacagaggaaaatcaatgggattccgctaaggccgccgtcgaggacgaagatttctggaaacttgtggacagagagcgcgagctgcacaagctcggaaaatgtggctcttgcgtttataacatgatggggaagagagagaagaagctgggcgagtttggaaaggctaaaggcagccgggccatttggtacatgtggcttggggctcgctacctggagttcgaggccctcggatttctgaatgaggatcattggttctccagagaaaactcttatagcggcgtggagggggaaggactgcacaagctcggctacatcctgcgggacatctccaaaattcccgggggcgcgatgtatgccgatgacaccgctggatgggacacgagaatcaccgaggatgaccttcacaatgaagagaagattacacagcagatggatcctgagcatcggcagctggccaacgctatctttaaactcacctaccaaaataaggtcgtgaaggtccagcgccccacaccgaccggcacagtgatggacattatctctagaaaagatcagcgggggagcggacaggttggcacctatgggctgaacacgttcacaaatatggaagcccaacttatccgccagatggagggagaaggcgtgctgtccaaggcggacctcgagaaccctcatctgcccgagaagaagattacccagtggctggagaccaaaggggtcgagagactcaagcggatggccatcagcggcgatgactgcgtggtgaagcccattgatgaccgctttgctaacgccctgcttgctctgaatgatatgggaaaagttagaaaggacatccctcagtggcaaccgtctaaaggctggcatgattggcaacaggtgcccttctgttcccaccacttccatgaactcattatgaaggacgggcggaaactggtcgtgccttgccgcccccaggacgagcttatcggacgggcccggattagccaaggcgctgggtggtctctgcgcgaaacagcctgtctcggaaaggcgtacgcccagatgtggtccctgatgtattttcacagacgggatctgcgcctcgctagcaacgccatctgctctgccgttcctgtgcattgggtccccacctccagaacaacgtggagcatccacgctcatcaccagtggatgaccacagaggacatgctgaccgtgtggaatcgggtctggattgaagataacccttggatggaggacaagacacccgtgaccacgtgggagaatgttccgtaccttggcaaaagagaagatcaatggtgtgggtccctgatcggcctcaccagccgcgccacatgggcgcagaacattcctaccgctatccaacaggtgcggtctctgattggaaatgaggagttccttgactacatgcccagcatgaagagatttcgcaaagaggaggaatccgagggcgccatctggtga

SEQ ID NO: 20614 - RNA, 9873 nt, synthetic construct
  misc_feature 1..9873: note = derived and/or modified CDS sequence (opt5) from DENV-3__KJ189257__SS-prME
  source 1..9873: mol_type = other RNA
accagcctctgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccatgggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcatcaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcacacgtggaccgaacagtacaaatttcaggccgattcccccaagcggctggcgacagccatcgctggcgcctgggagaatggagtgtgtggcattagaagcaccacacgcatggaaaaccttctctggaaacaaatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcaactgtgtgaccaccggcttatgagcgccgctgtgaaggatgagagagccgtgcatgccgacatggggtactggattgagtcccagaaaaacggatcttggaagctcgaaaaagctagcctgatcgaggtcaagacatgcacctggcctaagtcccacaccctgtggtctaatggcgtgctcgaaagcgatatgattatccccaaatccctggccgggcctattagccagcataaccaccgccccggatatcacacacagaccgcgggcccttggcatcttgggaagctggagctcgactttaattactgcgagggaacgacagttgtgatcaccgaaaactgtggcacacggggcccctctctgagaaccacaaccgtctccgggaaactgatccacgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcaaattacctggcgcgatatggctcacacactgatcatgattggatccaataccagcgacagaatgggcatgggggtcacgtatctggcccttatcgcgacatttaaaatccagcccttcctggctctcggatttttcctgcggaagctcacctctagagaaaacctgcttctgggcgtggggctcgccatggccacaaccctgcagctgcctgaggatattgaacaaatggctaatggaatcgcccttggcctgatggctctcaaactgattacccagtttgagacataccagctctggacggccctgatctcccttacctgtagcaacacaattttcaccctgacagtggcgtggcgcaccgccacgctcatcctggctggcgtctccctgcttccggtttgccagtctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctgacatcacatgggaggaagaggccgaacaaacgggagtgagccataacctcatgattaccgtcgacgatgacggcacaatgcggatcaaagatgacgagaccgagaatatcctgacagtgcttctgaagaccgcgctgctcattgtctctggcatctttccgtactccattcctgctacgctgcttgtgtggcacacctggcagaaacagacacagcgcagcggggttctgtgggatgtgccctctcctcccgaaacccaaaaggccgagctcgaagagggagtctacagaatcaaacagcagggcattttcgggaagacacaggtgggagttggcgtgcaaaaggagggggtctttcacaccatgtggcatgtgacacggggagccgtgctgacgtataacggcaaacgcctcgaaccgaattgggcttccgttaagaaagacctgatcagctacggcgggggatggagactttctgcccagtggcagaagggcgaggaagtccaagtgattgcggtggagcctgggaaaaaccccaagaatttccagaccatgcctggaacattccagaccaccacaggcgaaatcggggctatcgccctggattttaagcccggaacgtccggcagccccattatcaaccgggagggcaaagtcgtggggctgtatggaaatggcgttgtgaccaagaacgggggatacgtctccggcattgcccagacaaatgctgagcctgacgggccgacccccgaactcgaggaagagatgttcaaaaagcgcaacctgacaatcatggatcttcaccctggcagcggaaaaaccagaaagtatctgcccgccattgtgcgggaagctatcaagcgcagactccggacgctgatcctcgcccctacaagagttgtggcggccgagatggaggaagctctgaaaggccttcccattcgctaccaaaccaccgccacaaagtctgagcataccgggcgggaaatcgtcgacctgatgtgccacgctacatttaccatgagactgctcagccctgtgcgcgttccgaattataacctgattatcatggatgaggcccatttcacggaccccgcctccattgctgcgcggggatacatctctacaagagtgggcatgggggaagccgctgccatctttatgaccgccacacctcccggaaccgctgatgccttccctcagagcaatgcgcccattcaggacgaggagcgcgacatcccggaacggtcctggaactctggcaatgagtggattacggattttgctgggaaaaccgtctggttcgtgcctagcatcaaggccggcaacgacattgccaactgtcttcgcaaaaatggaaagaaggtgatccagctgtccagaaaaacatttgataccgaataccaaaagacaaaactcaacgactgggatttcgtcgttaccacagacatttctgagatgggcgctaattttaaggccgatcgggtgatcgaccccagacggtgcctgaaacccgtgatcctgaccgatgggcctgagcgcgtcattctcgcgggacccatgcctgtgacggccgctagcgccgctcagagacggggccgcgttgggagaaacccgcagaaggaaaatgaccagtatatcttcacaggacaaccccttaacaatgatgaggaccacgcccactggaccgaagctaagatgctgctggacaacattaatacccctgagggcatcattcccgccctcttcgaacctgagcgggagaaatccgcggccatcgatggggaatacagactgaagggcgagagccgcaaaacatttgtggaacttatgcggagaggagacctgcccgtctggctcgctcataaggtggcctctgagggcatcaaatataccgatcgcaagtggtgcttcgacgggcagcggaacaatcagattctggaagagaacatggatgttgagatctggacaaaagaaggagagaagaagaaactgagaccgcgctggctcgacgctcggacgtactccgatcctcttgccctgaaggaatttaaagacttcgccgctggcagaaagagcattgcgctggatctcgtgaccgagatcgggcgcgtcccctctcacctggcccatagaacacggaatgctcttgacaacctggtgatgctccacacctccgaacacggaggccgcgcctatagacatgccgtcgaggagctgcctgaaacaatggagaccctgctccttctgggcctgatgattctcctgacagggggagctatgctttttctgatcagcggcaaagggatcggaaagacctccattggcctcatctgtgtgattgcctctagcgggatgctgtggatggcggaaatccccctgcagtggattgcctccgctatcgttctcgagttctttatgatggtgcttctgattcctgagcccgaaaagcaacggacaccgcaggataatcagctggcctacgtggtcatcggaatcctcaccctggctgccattatcgcggccaacgagatgggccttctggaaacaaccaaacgcgacctcggcatgagcaaggagcctggggttgtgtctcccacgtcctatctggatgtggacctgcaccccgctagcgcctggacactctacgctgtcgccaccacagtgattacccctatgcttagacataccatcgaaaattctacagctaacgttagcctggccgcgattgccaaccaagctgtggtcctgatgggactcgacaaaggctggccgatctccaagatggatctgggggtgccccttctggccctcggatgctactctcaggtcaatcctctgacgctgaccgctgccgtgttcctccttatcacacactatgccattatcggccccgggctgcaggcgaaagctacccgggaggcccagaagagaacagctgccggaattatgaagaaccctaccgttgacggcatcatgacgattgatctggaccccgtgatctacgatagcaaatttgagaagcaactcggccaggtcatgctgcttgtgctgtgtgccgttcagctcctgctgatgcgcacatcctgggctctctgcgaagcccttaccctggcgaccgggcctatcacaaccctgtgggagggatctccgggcaaattctggaatacaacgattgccgtgagcatggctaacatctttcgggggtcctatctcgccggagctggcctggccttcagcattatgaagtctgtcgggaccggaaaaagaggcacaggctcccagggggaaacccttggagagaagtggaagaaaaagctgaatcaactcagccgcaaagaatttgacctgtacaagaaatccggcatcacagaggtggatcggaccgaggcgaaggaagggctgaaaagaggagagattacgcatcacgccgtgtctcggggcagcgctaagctccagtggttcgttgaacgcaacatggtcatccccgaggggagagtgattgaccttggatgtggccggggcgggtggtcctattactgcgccggactgaagaaagtgaccgaagtccgcggctatacaaaagggggacctggccacgaggagcccgttcctatgtctacctacgggtggaatatcgtgaaactgatgagcggaaaggatgtgttctacctgcccccggaaaaatgtgacacactgctttgcgatatcggcgagtccagcccttctcccaccgtcgaagagtccagaacaattcgggtgctgaagatggttgagccctggctcaagaacaatcagttttgtatcaaagtgctgaacccttatatgcccaccgtcattgaacatctggagcgcctccagagaaagcacggcgggatgcttgtgcggaatcctctgagccgcaactctacgcatgaaatgtactggatctccaatggaacaggcaacattgttgctagcgtgaatatggtctctagactgctcctgaaccggttcaccatgacccacagacgcccgacaatcgagaaagacgtggatcttggggccggaacgcggcacgtgaacgctgaacccgagacccctaatatggacgtcatcggcgagagaattaagcgcatcaaagaggaacataacagcacatggcactatgacgatgaaaatccctacaagacctgggcctatcatgggtcctacgaggttaaggcgacaggatctgccagctccatgattaacggcgtggtgaaactgctcaccaagccttgggacgtcgtgcccatggttacacaaatggctatgaccgatacgaccccgtttggccagcagcgggtgttcaaagaaaaggtcgacacaagaacccctcgcagcatgcccgggacacggagagtgatgggaatcaccgccgagtggctgtggcgcacgctgggccggaataaaaagcctagactctgcacacgcgaggaatttaccaagaaagttcggacaaacgctgccatgggggccgtgttcaccgaggaaaatcaatgggattccgcgaaggctgccgtcgaggacgaagatttttggaaactggtggacagagagcgcgagcttcacaagctgggaaaatgtggctcttgcgtttataacatgatggggaagagagagaagaagctcggcgagttcggaaaggccaaaggcagccgggctatttggtacatgtggctgggggcccgctaccttgaatttgaggctctgggattcctcaatgaggatcattggttttccagagaaaactcttatagcggcgtggagggggaaggactgcacaagctgggctacatcctccgggacatctccaaaattcccgggggcgccatgtatgcggatgacacggccggatgggacaccagaatcacagaggatgacctgcacaatgaagagaagattacccagcagatggatcctgagcatcggcagcttgctaacgccatcttcaaactgacataccaaaataaggtcgtgaaggtccagcgccccaccccgacaggcaccgtgatggacattatctctagaaaagatcagcgggggagcggacaggttggcacgtatgggctcaacacatttaccaatatggaagctcaactgatccgccagatggagggagaaggcgtgctttccaaggccgacctggagaaccctcacctccccgagaaaaagattacccagtggctggagacaaaaggggtcgagagactgaagcggatggcgatcagcggcgatgactgcgtggtgaagcccattgatgaccgcttcgccaacgctctcctggcccttaatgatatgggaaaagttagaaaggacatccctcagtggcaaccgtctaaaggctggcatgattggcaacaggtgcccttctgttcccaccactttcatgaactgattatgaaggacgggcggaaactcgtcgtgccttgccgcccccaggacgagctgatcggacgggctcggattagccaaggcgccgggtggtctcttcgcgaaaccgcttgtctgggaaaggcctacgcgcagatgtggtccctcatgtatttccacagacgggatctgcgcctggccagcaacgctatctgctctgccgttcctgtgcattgggtccccacatccagaacgacctggagcatccacgcccatcaccagtggatgacaaccgaggacatgctcacagtgtggaatcgggtctggattgaagataacccttggatggaggacaagacccccgtgacgacctgggagaatgttccgtacctgggcaaaagagaagatcaatggtgtgggtcccttatcggcctgacaagccgcgctacctgggcccagaacattcctacagcgatccaacaggtgcggtctctcattggaaatgaggaatttctggactacatgcccagcatgaagagattccgcaaagaggaggaatccgagggcgctatctggtga

SEQ ID NO: 20615 - RNA, 9873 nt, synthetic construct
  misc_feature 1..9873: note = derived and/or modified CDS sequence (opt5) from DENV-3__KJ189262__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccatgggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcatcaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcacacgtggaccgaacagtacaaatttcaggccgattcccccaagcggctggcgacagccatcgctggcgcctgggagaatggagtgtgtggcattagaagcaccacacgcatggaaaaccttctctggaaacaaatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcaactgtgtgaccaccggcttatgagcgccgctgtgaaggatgagagagccgtgcatgccgacatggggtactggattgagtcccagaaaaacggatcttggaagctcgaaaaagctagcctgatcgaggtcaagacatgcacctggcctaagtcccacaccctgtggtctaatggcgtgctcgaaagcgatatgattatccccaaatccctggccgggcctattagccagcataaccaccgccccggatatcacacacagaccgcgggcccttggcatcttgggaagctggagctcgactttaattactgcgagggaacgacagttgtgatcaccgaaaactgtggcacacggggcccctctctgagaaccacaaccgtctccgggaaactgatccacgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcaaattacctggcgcgatatggctcacacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcagctgcctgaggatattgaacaaatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccagtctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacaaacaggagtgagccataacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcacacgtggcagaaacagacccagcgcagcggggttctgtgggatgtgccctctcctcccgaaacacaaaaggccgagctcgaagagggagtctacagaatcaaacagcagggcattttcgggaagacccaggtgggagttggcgtgcaaaaggagggggtctttcacacaatgtggcatgtgacccggggagctgtgctgacatataacggcaaacgcctcgaaccgaattgggcctccgttaagaaagacctgatcagctacggcgggggatggagactttctgcgcagtggcagaagggcgaggaagtccaagtgattgctatcgagcctgggaaaaaccccaagaatttccagacgatgcctggaaccttccagacaaccaccggcgaaatcggggccattgccctggattttaagcccggaacatccggcagccccatcattaaccgggagggcaaagtggtcgggctgtatggaaatggcgtggttacgaagaacgggggatacgtgtccggcatcgctcagaccaatgccgagcctgacgggccgacacccgaactcgaggaagagatgttcaaaaagcgcaacctgaccattatggatcttcaccctggcagcggaaaaacaagaaagtatctgcccgctatcgtccgggaagccatcaagcgcagactccggaccctgattctcgcgcctacgagagtggttgccgctgagatggaggaagccctgaaaggccttcccatccgctaccaaacaaccgctaccaagtctgagcatacagggcgggaaattgtggacctgatgtgccacgccacctttacaatgagactgctcagccctgtccgcgtgccgaattataacctgatcattatggatgaggcccatttcaccgaccccgcttccatcgcggcccggggatacatctctacgagagttggcatgggggaagctgccgccatttttatgacagctacccctcccggaacagccgatgcgttccctcagagcaatgctcccatccaggacgaggagcgcgacattccggaacggtcctggaactctggcaatgagtggatcaccgattttgccgggaaaacggtgtggttcgtccctagcattaaggccggcaacgacatcgctaactgtcttcgcaaaaatggaaagaaggtgattcagctgtccagaaaaacctttgatacagaataccaaaagaccaaactcaacgactgggatttcgtggtcacaaccgacatctctgagatgggcgccaattttaaggcggatcgggttatcgaccccagacggtgcctgaaacccgtgattctgacagatgggcctgagcgcgtgatcctcgccggacccatgcctgtcaccgctgccagcgctgcccagagacggggccgcgtggggagaaacccgcagaaggaaaatgaccagtatattttcacgggacaaccccttaacaatgatgaggaccacgctcactggacagaagccaagatgctgctggacaacatcaatacccctgagggcattatccccgccctcttcgaacctgagcgggagaaatccgccgctatcgatggggaatacagactgaagggcgagagccgcaaaacctttgttgaacttatgcggagaggagacctgcccgtgtggctcgcccataaggtcgcttctgagggcattaaatatacagatcgcaagtggtgcttcgacgggcagcggaacaatcagatcctggaagagaacatggatgtggagatttggaccaaagaaggagagaagaagaaactgagaccgcgctggctcgacgcccggacatactccgatcctcttgccctgaaggaatttaaagacttcgctgcgggcagaaagagcatcgccctggatctcgttacggagattgggcgcgtgccctctcacctggctcatagaacccggaatgcccttgacaacctggtcatgctccacacatccgaacacggaggccgcgcctatagacatgctgtggaggagctgcctgaaaccatggagacactgctccttctgggcctgatgatcctcctgaccgggggagccatgctttttctgatcagcggcaaagggattggaaagacgtccatcggcctcatttgtgtcatcgcgtctagcgggatgctgtggatggccgaaattcccctgcagtggatcgcttccgccattgtgctcgagttctttatgatggttcttctgatccctgagcccgaaaagcaacggaccccgcaggataatcagctggcttacgtggtgatcggcattctcacactggccgcgatcattgccgctaacgagatgggccttctggaaaccacaaaacgcgacctcggcatgagcaaggagcctggggtcgtttctcccacctcctatctggatgtggacctgcaccccgccagcgcttggacgctctacgccgtggctacaaccgtcatcacacctatgcttagacataccattgaaaattctaccgccaacgtgagcctggcggccatcgctaaccaagccgttgtgctgatgggactcgacaaaggctggccgatctccaagatggatctgggggtcccccttctggctctcggatgctactctcaggtgaatcctctgacactgacggccgccgtcctccttctgattacccactatgcgatcattggccccgggctgcaggctaaagccacacgggaggctcagaagagaaccgccgccggaatcatgaagaaccctacagtggacggcattatgaccatcgatctcgaccccgttatctacgatagcaaattcgagaagcaactgggccaggtgatgcttctggtcctctgtgctgtgcagctgctgctcatgcgcacgtcctgggccctttgcgaagcgctgacactggccaccgggcctattaccacactctgggagggatctccgggcaaattttggaataccacaatcgctgttagcatggccaacattttccgggggtcctatctggctggagccggccttgcgtttagcatcatgaagtctgtggggacgggaaaaagaggcaccggctcccagggggaaacactgggagagaagtggaagaaaaagctcaatcaactgagccgcaaagagttcgacctgtacaagaaatccggcattaccgaggtcgatcggacagaggccaaggaagggctcaaaagaggagagatcacccatcacgctgtgtctcggggcagcgccaaacttcagtggtttgtggaacgcaacatggttattcccgaggggagagtcatcgacctgggatgtggccggggcgggtggtcctattactgcgctggactgaagaaagtgacggaagtgcgcggctataccaaagggggacctggccacgaggagcccgtccctatgtctacatacgggtggaatatcgttaaactcatgagcggaaaggatgtgttctacctgcccccggaaaaatgtgacacccttctgtgcgatattggcgagtccagcccttctcccacagtggaagagtccagaaccatccgggtcctcaagatggtggagccctggctgaagaacaatcagttctgtattaaagttctgaacccttatatgcccacagtgatcgaacatctcgagcgccttcagagaaagcacggcgggatgctggtccggaatcctctgagccgcaactctacccatgaaatgtactggatttccaatggaacgggcaacatcgtggccagcgttaatatggtgtctagactcctgcttaaccggtttacaatgacccacagacgcccgaccatcgagaaagacgtcgatctgggggctggaacacggcacgtgaacgccgaacccgagacgcctaatatggacgtgattggcgagagaatcaagcgcattaaagaagaacacaacagcacctggcactatgacgatgaaaatccctacaagacatgggcgtatcatgggtcctacgaggtcaaggccaccggatctgctagctccatgatcaacggcgttgtgaaactcctgacaaagccttgggacgtggtccccatggtgacccaaatggccatgacagataccacgccgttcggccagcagcgggtttttaaagaaaaggtggacaccagaacacctcgcagcatgcccgggacccggagagtcatgggaattacagctgagtggctgtggcgcaccctcggccggaataaaaagcctagactgtgcacgcgcgaggagttcacaaagaaagtgcggaccaacgccgccatgggggcggtttttacagaggaaaatcaatgggattccgctaaggccgccgtggaggacgaagatttctggaaacttgtcgacagagagcgcgagctgcacaagctcggaaaatgtggctcttgcgtgtataacatgatggggaagagagagaagaagctgggcgagtttggaaaggctaaaggcagccgggccatctggtacatgtggcttggggctcgctacctggagttcgaggccctcggatttctgaatgaggatcattggttctccagagaaaactcttatagcggcgttgagggggaaggactgcacaagctcggctacatcctgcgggacatttccaaaatccccgggggcgcgatgtatgccgatgacaccgctggatgggacacgagaattaccgaggatgaccttcacaatgaagagaagatcacacagcagatggatcctgagcatcggcagctggccaacgctatttttaaactcacctaccaaaataaggtggtcaaggtgcagcgccccacaccgaccggcacagtcatggacatcatctctagaaaagatcagcgggggagcggacaggtgggcacctatgggctgaacacgttcacaaatatggaagcccaacttattcgccagatggagggagaaggcgttctgtccaaggcggacctcgagaaccctcatctgcccgagaagaagatcacccagtggctggagaccaaaggggtggagagactcaagcggatggccattagcggcgatgactgcgtcgtgaagcccatcgatgaccgctttgctaacgccctgcttgctctgaatgatatgggaaaagtgagaaaggacattcctcagtggcaaccgtctaaaggctggcatgattggcagcaggttcccttctgttcccaccacttccatgaactcatcatgaaggacgggcggaaactggtggtcccttgccgcccccaggacgagcttattggacgggcccggatcagccaaggcgctgggtggtctctgcgcgaaacagcctgtctcggaaaggcgtacgcccagatgtggtccctgatgtattttcacagacgggatctgcgcctcgctagcaacgccatctgctctgccgtgcctgttcattgggtgcccacctccagaacaacgtggagcattcacgctcatcaccagtggatgaccacagaggacatgctgaccgtctggaatcgggtgtggatcgaagataacccttggatggaggacaagacacccgtcaccacgtgggagaatgtgccgtaccttggcaaaagagaagatcaatggtgtgggtccctgattggcctcaccagccgcgccacatgggcgcagaacatccctaccgctattcagcaggttcggtctctgatcggaaatgaggagttccttgactacatgcccagcatgaagagatttcgcaaagaggaggaatccgagggcgccatctggtga

SEQ ID NO: 20616 - RNA, 9873 nt, synthetic construct
  misc_feature 1..9873: note = derived and/or modified CDS sequence (opt5) from DENV-3__KJ189263__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccgtgctcattaaggttgagtacaagggagaagatgtgccctgtaaaatccctttcagcacagaggacggccatgggaaggcccacaacggaagactgatcaccgcgaatcccgtcgtgacgaaaaaggaggaacccgtgaacattgaggctgaacctccgttcggcgagtccaatatcgttattgggatcggcgataacgccctgaaaattaattggtataagaagggatctagcatcggcaaaatgtttgaagccacagctagaggggccagacgcatggctatccttggagacaccgcctgggatttcggctccgtcgggggagtgctcaacagcctgggcaagatggtgcatcaaatttttgggtctgcgtacaccgccctgttctccggcgtcagctgggtgatgaaaatcggaattggcgttctcctgacatggatcgggcttaattctaagaacaccagcatgtccttttcttgcattgctatcggaattatcacactgtatctcggcgccgtggtccaggctgacatggggtgtgtgatcaattggaaaggaaaggagctgaagtgcggcagcgggattttcgttacgaacgaggtgcacacctggacagaacagtacaaatttcaggccgattcccccaagcggctggcgaccgccatcgctggcgcctgggagaatggagtctgtggcattagaagcacaacccgcatggaaaaccttctctggaaacaaatcgctaatgagctgaactatattctgtgggaaaataacatcaagctcacggtggttgtgggggacatcattggagtcctggagcagggcaaacggacccttacacctcagcccatggagctgaagtactcttggaaaacctgggggaaggccaagatcgtgacagccgaaacccagaactccagcttcattatcgatggacctaatacacccgagtgcccgtctgcttccagagcgtggaacgtgtgggaagtcgaggactatggctttggcgttttcaccacgaatatttggctccgcctgcgggaagtgtacacacaactgtgtgaccacagacttatgagcgccgctgtgaaagatgagcgcgccgtccatgccgacatggggtactggatcgagtcccagaagaacggatcttggaaactcgaaaaggctagcctgatcgaggtgaaaacctgcacctggcctaagtcccacacactgtggtctaatggcgttctcgaaagcgatatgattatccccaagtccctggccgggcctattagccagcataaccaccggcccggatatcacacccagacggcgggcccttggcatcttgggaaactggagctcgactttaattactgcgagggaacaaccgtggtcatcacagaaaactgtggcaccagaggcccctctctgcgcacaaccacggtgtccgggaagctgattcacgagtggtgctgtcggagctgcacccttccgcctctcagatatatgggagaagatggctgttggtacgggatggagatccggcccatctctgaaaaagaggagaatatggttaagtccctggtgagcgctggatctggcaaagtcgacaacttcacaatgggggtgctgtgcctcgccattctgtttgaagaggttatgcgcggaaagttcggcaagaaacatatgatcgccggcgtgttctttaccttcgtccttctgctcagcgggcaaattacatggagagatatggctcacaccctgatcatgattggatccaatgccagcgaccggatgggcatgggggtgacgtatctggcgcttatcgctacatttaagattcagcccttcctggccctcggatttttcctgagaaaactcacctctcgcgaaaacctgcttctgggcgtggggctcgccatggctacaaccctgcagctgcctgaggatatcgaacaaatggccaatggaatcgctcttggcctgatggccctcaagctgattacccagtttgagatctaccagctctggacagcgctgatttcccttacgtgtagcaacaccatcttcacactgaccgtcgcctggcggacagctaccctcattctggccggcgtttccctgcttccggtgtgccagtctagctccatgagaaaaacggactggctgcccatggctgtggccgccatgggggtccctcccctccctctgtttatcttctctctcaaggatacactgaagcgcagaagctggccccttaatgagggagtgatggctgttggcctggtgtccatcctggcgtctagcctcctgcggaacgacgtccctatggccgggccccttgtggctggaggcctgctcattgcctgttatgttatcaccgggacctccgccgatctgacagtggaaaaagctgccgacattacctgggaggaagaggcggaacaaacaggagtcagccataacctcatgatcacggtggacgatgacggcaccatgcgcattaaggatgacgagacagagaatatcctgaccgtccttctgaaaacagctctgctcatcgtgtctggcatttttccgtactccatccctgccaccctgcttgtttggcacacgtggcagaagcagacccagagaagcggggtgctgtgggatgtcccctctcctcccgaaacacaaaaagccgagctcgaagagggagtgtaccggattaagcagcagggcatcttcgggaaaacccaggttggagtgggcgtccaaaaggagggggtgtttcacacaatgtggcatgtgacccgcggagctgttctgacatataacggcaagagactcgaaccgaattgggcctccgtcaaaaaggacctgattagctacggcgggggatggcggctttctacgcagtggcagaaaggcgaggaagtgcaagtgatcgcggtcgagcctgggaagaaccccaaaaatttccagaccatgcctggaacattccagaccaccacaggcgaaattggggctatcgccctggattttaagcccggaacgtccggcagccccatcattaaccgcgagggcaaggtggttgggctgtatggaaatggcgtggtcaccaaaaacgggggatacgtgtccggcatcgcccagacaaatgctgagcctgacgggccgacccccgaactcgaggaagagatgttcaagaaaagaaacctgacaattatggatcttcaccctggcagcggaaagacccggaaatatctgcccgccatcgttcgcgaagctattaagagacggctcagaacgctgatcctcgcccctacacgcgtggtcgcggccgagatggaggaagctctgaagggccttcccatccggtaccaaaccaccgccacaaaatctgagcataccgggagagaaattgtggacctgatgtgccacgctacatttaccatgcgcctgctcagccctgttcgggtgccgaattataacctgatcattatggatgaggcccatttcacggaccccgcctccatcgctgcgagaggatacatttctacacgcgtcggcatgggggaagccgctgccatctttatgaccgccacacctcccggaaccgctgatgccttccctcagagcaatgcgcccatccaggacgaggagcgggacattccggaaagatcctggaactctggcaatgagtggatcacggattttgctgggaagaccgtgtggttcgtgcctagcattaaagccggcaacgacatcgccaactgtcttcgcaagaatggcaaaaaggtcattcagctgtcccggaagacatttgataccgaataccagaagacgaagctcaacgactgggatttcgttgtgaccacagacatctctgagatgggagctaattttaaagccgatagagtgattgacccccggcgctgcctgaagcccgtcatcctgaccgatgggcctgagagagtgatcctcgcgggacccatgcctgttacggccgctagcgccgctcagcggcgcggcagagtggggcggaacccgcagaaagaaaatgaccagtatattttcacaggacaaccccttaacaatgatgaggaccacgcccactggaccgaagctaagatgctgctggacaacatcaatacccctgagggcattatccccgccctcttcgaacctgagagagagaagtccgcggccattgatggggaataccgcctgaaaggcgagagccggaagacatttgtcgaacttatgagacgcggagacctgcccgtgtggctcgctcataaagttgcctctgagggcatcaagtataccgatcggaaatggtgcttcgacgggcagagaaacaatcagatcctggaagagaacatggatgtggagatttggacaaaggaaggagagaaaaagaagctgcgcccgcggtggctcgacgctagaacgtactccgatcctcttgccctgaaagaatttaaggacttcgccgctggccgcaaaagcatcgcgctggatctcgtcaccgagattgggagagtgccctctcacctggcccatcggacacgcaatgctcttgacaacctggtcatgctccacacctccgaacacggaggcagagcctatcggcatgccgtggaggagctgcctgaaacaatggagaccctgctccttctgggcctgatgatcctcctgacagggggagctatgctttttctgattagcggcaaggggatcggaaaaacctccatcggcctcatttgtgttatcgcctctagcgggatgctgtggatggcggaaattcccctgcagtggatcgcctccgctattgtgctcgagttctttatgatggtgcttctgatccctgagcccgaaaagcaacgcacaccgcaggataatcagctggcctacgtcgttattggaatcctcaccctggctgccatcattgcggccaacgagatgggccttctggaaacaaccaagagagacctcggcatgagcaaagagcctggggtggtgtctcccacgtcctatctggatgtcgacctgcaccccgctagcgcctggacactctacgctgtggccaccacagttatcacccctatgcttcggcataccattgaaaattctacagctaacgtgagcctggccgcgatcgccaaccaagctgtcgtgctgatgggactcgacaagggctggccgatttccaaaatggatctgggggtcccccttctggccctcggatgctactctcaggtgaatcctctgacgctgaccgctgccgttctccttctgatcacacactatgccatcattggccccgggctgcaggcgaaggctaccagagaggcccagaaacgcacagctgccggaatcatgaagaaccctaccgtggacggcattatgacgatcgatctcgaccccgtcatttacgatagcaagttcgagaaacaactgggccaggtgatgcttctggttctctgtgccgtgcagctgctgctcatgcggacatcctgggctctttgcgaagccctgaccctggcgaccgggcctatcacaaccctctgggagggatctccgggcaagttttggaatacaacgatcgccgtcagcatggctaacattttcagagggtcctatctggccggagctggccttgcctttagcatcatgaaatctgtggggaccggaaagcgcggcacaggctcccagggggaaaccctgggagagaaatggaagaagaaactcaatcaactgagccggaaggagttcgacctgtacaaaaagtccggcattacagaggtggatagaaccgaggcgaaagaagggctcaagcggggagagatcacgcatcacgccgtttctcgcggcagcgctaaacttcagtggtttgtcgaaagaaacatggtgattcccgaggggcgggtgatcgacctgggatgtggccgcggcgggtggtcctattactgcgccggactgaagaaggtcaccgaagttagaggctatacaaaagggggacctggccacgaggagcccgtgcctatgtctacctacgggtggaatattgtgaagctcatgagcggaaaagatgtcttctacctgcccccggaaaagtgtgacacacttctgtgcgatatcggcgagtccagcccttctcccaccgtggaagagtcccggacaatccgcgttctcaaaatggtggagccctggctgaagaacaatcagttctgtattaaggtcctgaacccttatatgcccaccgtgatcgaacatctcgagagacttcagcggaaacacggcgggatgctggttcgcaatcctctgagcagaaactctacgcatgaaatgtactggatttccaatggaacaggcaacatcgtggctagcgtcaatatggtgtctcggctcctgcttaacagatttaccatgacccaccgccggccgacaattgagaaggacgtggatctgggggccggaacgagacacgtcaacgctgaacccgagacccctaatatggacgttatcggcgagcgcatcaaacggattaaggaagaacacaacagcacatggcactatgacgatgaaaatccctacaaaacctgggcctatcatgggtcctacgaggtgaaggcgacaggatctgccagctccatgatcaacggcgtggtcaagctcctgaccaaaccttgggacgtggttcccatggtgacacaaatggctatgaccgatacgaccccgttcggccagcagagagtctttaaggaaaaagtggacacacgcacccctcggagcatgcccgggacaagacgcgttatgggaattaccgccgagtggctgtggcggacgctcggcagaaataagaaacctcgcctgtgcacacgggaggagttcaccaagaaggtgagaacaaacgctgccatgggggccgtctttaccgaggaaaatcaatgggattccgcgaaagctgccgtggaggacgaagatttctggaaacttgttgaccgcgagagagagctgcacaaactcggaaagtgtggctcttgcgtgtataacatgatggggaaacgggaaaagaaactgggcgagtttggaaaggccaagggcagccgcgctatctggtacatgtggcttggggccagatacctggagttcgaggctctcggatttctgaatgaggatcattggttctcccgggaaaactcttatagcggcgtcgagggggaaggactgcacaaactcggctacattctgagagacatctccaagatccccgggggcgccatgtatgcggatgacacggccggatgggacacccggattacagaggatgaccttcacaatgaagagaaaatcacccagcagatggatcctgagcatcgccagctggctaacgccatttttaagctcacataccaaaataaagtggtcaaggtgcagagacccaccccgacaggcaccgttatggacatcatttctcggaaggatcagcgcgggagcggacaggtgggcacgtatgggctgaacacattcaccaatatggaagctcaacttatcagacagatggagggagaaggcgtcctgtccaaagccgacctcgagaaccctcatctgcccgaaaagaaaatcacccagtggctggagacaaagggggtggagcggctcaaacgcatggcgattagcggcgatgactgcgtggttaagcccatcgatgacagatttgccaacgctctgcttgccctgaatgatatgggaaaggtgcggaaagacattcctcagtggcaaccgtctaagggctggcatgattggcagcaggtccccttctgttcccaccacttccatgaactcatcatgaaagacgggcgcaagctggtggttccttgcagaccccaggacgagcttattggacgggctcgcatcagccaaggcgccgggtggtctctgagagaaaccgcttgtctcggaaaagcctacgcgcagatgtggtccctgatgtattttcaccggcgcgatctgagactcgccagcaacgctatttgctctgccgtgcctgtccattgggtgcccacatcccggacgacctggagcatccacgcccatcaccagtggatgacaaccgaggacatgctgacagtctggaatagagtgtggatcgaagataacccttggatggaggacaagacccccgttacgacctgggagaatgtgccgtaccttggcaagcgcgaagatcaatggtgtgggtccctgattggcctcacaagccgggctacctgggcccagaacatccctacagcgattcagcaggtcagatctctgatcggaaatgaggagttccttgactacatgcccagcatgaaacgctttcggaaggaggaggaatccgagggcgctatttggtga

SEQ ID NO: 20617 - RNA, 9873 nt, synthetic construct
  misc_feature 1..9873: note = derived and/or modified CDS sequence (opt5) from DENV-3__KJ189265__SS-prME
  source 1..9873: mol_type = other RNA
accagcctgtgcctcatgatgatcctgcccgccgctcttgccttccacctgacgtccagagacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccatgggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcatcaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcacacgtggaccgaacagtacaaatttcaggccgattcccccaagcggctggcgacagccatcgctggcgcctgggagaatggagtgtgtggcattagaagcaccacacgcatggaaaaccttctctggaaacaaatcgctaatgagctgaactatatcctgtgggaaaataacattaagctcaccgtcgtggttggggacatcattggagtgctggagcacggcaaacggacgcttacccctcagcccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccatcggcttatgagcgccgctgtgaaggatgagagagccgtgcacgccgacatggggtactggattgagtcccagaagaatggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaaccaccgccccggatatcatacacagaccgcgggcccttggcaccttgggaagctggagctcgactttaattactgcgagggaacgacagttgtgatcaccgaaaactgtggcacacggggcccctctctgagaaccacaaccgtctccgggaaactgatccatgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcacatgatcgccggcgttttctttacattcgtgcttctgctcagcgggcagattacctggcgcgatatggctcatacactgatcatgattggatccaataccagcgacagaatgggcatgggggtcacgtatctggcccttatcgcgacatttaaaatccaacccttcctggctctcggatttttcctgcggaagctcacctctagagaaaacctgcttctgggcgtggggctcgccatggccacaaccctgcagctgcctgaggatattgaacagatggctaatggaatcgcccttggcctgatggctctcaaactgattacccaatttgagacataccagctctggacggccctgatctcccttacctgtagcaacacaattttcaccctgacagtggcgtggcgcaccgccacgctcatcctggctggcgtctccctgcttccggtttgccagtctagctccatgcggaagacagactggctgcccatggccgtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttatgtgattaccgggacatccgccgatctgaccgttgaaaaggccgctaacatcacatgggaggaagaggccgaacagacgggagtgagccacaatctcatgattaccgtcgacgacgatggcacaatgcggatcaaagacgatgagaccgagaacatcctgacagtgcttctgaagaccgcgctgctcattgtctctggcatctttccgtactccattcctgctacgctgcttgtgtggcacacctggcaaaaacagacacagcgcagcggggttctgtgggacgtgccctctcctcccgaaacccagaaggccgagctcgaagagggagtctacagaatcaaacaacagggcattttcgggaagacacaggtgggagttggcgtgcagaaggagggggtctttcataccatgtggcacgtgacacggggagccgtgctgacgtataatggcaaacgcctcgaaccgaactgggcttccgttaagaaagatctgatcagctacggcgggggatggagactttctgcccaatggcagaagggcgaggaagtccaggtgattgcggtggagcctgggaaaaatcccaagaacttccaaaccatgcctggaacattccagaccaccacaggcgaaatcggggctatcgccctggactttaagcccggaacgtccggcagccccattatcaatcgggagggcaaagtcgtggggctgtatggaaacggcgttgtgaccaagaatgggggatacgtctccggcattgcccagacaaacgctgagcctgatgggccgacccccgaactcgaggaagagatgttcaaaaagcgcaatctgacaatcatggaccttcatcctggcagcggaaaaaccagaaagtatctgcccgccattgtgcgggaagctatcaagcgcagactccggacgctgatcctcgcccctacaagagttgtggcggccgagatggaggaagctctgaaaggccttcccattcgctaccagaccaccgccacaaagtctgagcacaccgggcgggaaatcgtcgatctgatgtgccatgctacatttaccatgagactgctcagccctgtgcgcgttccgaactataatctgattatcatggacgaggcccacttcacggatcccgcctccattgctgcgcggggatacatctctacaagagtgggcatgggggaagccgctgccatctttatgaccgccacacctcccggaaccgctgacgccttccctcaaagcaacgcgcccattcaggatgaggagcgcgacatcccggaacggtcctggaactctggcaacgagtggattacggactttgctgggaaaaccgtctggttcgtgcctagcatcaaggccggcaacgatattgccaattgtcttcggaaaaacggaaagaaggtgatccagctgtcccgcaaaacatttgacaccgaataccagaagacaaaactcaatgattgggacttcgtcgttaccacagatatttctgagatgggcgctaactttaaggccgaccgggtgatcgatcccagacggtgcctgaaacccgtgatcctgaccgacgggcctgagcgcgtcattctcgcgggacccatgcctgtgacggccgctagcgccgctcaaagacggggccgcgttgggagaaatccgcagaaggaaaacgatcagtatatcttcacaggacagccccttaataacgacgaggatcacgcccattggaccgaagctaagatgctgctggacaatattaacacccctgagggcatcattcccgccctcttcgaacctgagcgggagaaatccgcggccatcgacggggaatacagactgaagggcgagagccgcaaaacatttgtggaacttatgcggagaggagatctgcccgtctggctcgctcacaaggtggcctctgagggcatcaaatataccgaccgcaagtggtgcttcgatgggcaacggaataaccagattctggaagagaatatggacgttgagatctggacaaaagaaggagagaagaagaaactgagaccgcgctggctcgatgctcggacgtactccgaccctcttgccctgaaggaatttaaagatttcgccgctggcagaaagagcattgcgctggacctcgtgaccgagatcgggcgcgtcccctctcatctggcccacagaacacggaacgctcttgataatctggtgatgctccacacctccgaacatggaggccgcgcctatagacacgccgtcgaggagctgcctgaaacaatggagaccctgctccttctgggcctgatgattctcctgacagggggagctatgctttttctgatcagcggcaaagggatcggaaagacctccattggcctcatctgtgtgattgcctctagcgggatgctgtggatggcggaaatccccctgcagtggattgcctccgctatcgttctcgagttctttatgatggtgcttctgattcctgagcccgaaaagcagcggacaccgcaagacaaccagctggcctacgtggtcatcggaatcctcaccctggctgccattatcgcggccaatgagatgggccttctggaaacaaccaaacgcgatctcggcatgagcaaggagcctggggttgtgtctcccacgtcctatctggacgtggatctgcatcccgctagcgcctggacactctacgctgtcgccaccacagtgattacccctatgcttagacacaccatcgaaaactctacagctaacgttagcctggccgcgattgccaatcaggctgtggtcctgatgggactcgacaaaggctggccgatctccaagatggacctgggggtgccccttctggccctcggatgctactctcaagtcaaccctctgacgctgaccgctgccgtgctccttctgatcacacattatgccattatcggccccgggctgcaggcgaaagctacccgggaggcccagaagagaacagctgccggaattatgaagaatcctaccgttgatggcatcatgacgattgacctcgatcccgtgatctacgacagcaaattcgagaagcagctgggccaagtcatgcttctggtgctctgtgccgttcagctgctgctcatgcgcacatcctgggctctttgcgaagccctgaccctggcgaccgggcctatcacaaccctctgggagggatctccgggcaaattttggaacacaacgattgccgtgagcatggctaatatcttccgggggtcctatctggccggagctggccttgcctttagcattatgaagtctgtcgggaccggaaaaagaggcacaggctcccagggggaaaccctgggagagaagtggaagaaaaagctcaaccagctgagccgcaaagagttcgatctgtacaagaaatccggcatcacagaggtggaccggaccgaggcgaaggaagggctcaaaagaggagagattacgcaccacgccgtgtctcggggcagcgctaaacttcaatggtttgttgaacgcaatatggtcatccccgaggggagagtgattgatctgggatgtggccggggcgggtggtcctattactgcgccggactgaagaaagtgaccgaagtccgcggctatacaaaagggggacctggccatgaggagcccgttcctatgtctacctacgggtggaacatcgtgaaactcatgagcggaaaggacgtgttctacctgcccccggaaaaatgtgatacacttctgtgcgacatcggcgagtccagcccttctcccaccgtcgaagagtccagaacaattcgggtgctcaagatggttgagccctggctgaagaataaccagttctgtatcaaagtgctgaatccttatatgcccaccgtcattgaacacctcgagcgccttcagagaaagcatggcgggatgctggtgcggaaccctctgagccgcaattctacgcacgaaatgtactggatctccaacggaacaggcaatattgttgctagcgtgaacatggtctctagactcctgcttaaccggtttaccatgacccacagacgcccgacaatcgagaaagatgtggacctgggggccggaacgcggcatgtgaatgctgaacccgagacccctaacatggatgtcatcggcgagagaattaagcgcatcaaagaagaacacaatagcacatggcattatgacgacgaaaacccctacaagacctgggcctatcacgggtcctacgaggttaaggcgacaggatctgccagctccatgattaatggcgtggtgaaactcctgaccaagccttgggatgtcgtgcccatggttacacagatggctatgaccgacacgaccccgttcggccaacagcgggtgtttaaagaaaaggtcgatacaagaacccctcgcagcatgcccgggacacggagagtgatgggaatcaccgccgagtggctgtggcgcacgctcggccggaacaaaaagcctagactgtgcacacgcgaggagttcaccaagaaagttcggacaaatgctgccatgggggccgtgtttaccgaggaaaaccagtgggactccgcgaaggctgccgtcgaggatgaagacttctggaaacttgtggatagagagcgcgagctgcataagctcggaaaatgtggctcttgcgtttataatatgatggggaagagagagaagaagctgggcgagtttggaaaggccaaaggcagccgggctatttggtacatgtggcttggggcccgctacctggagttcgaggctctcggatttctgaacgaggaccactggttctccagagaaaattcttatagcggcgtggagggggaaggactgcacaagctcggctacatcctgcgggatatctccaaaattcccgggggcgccatgtatgcggacgatacggccggatgggacaccagaatcacagaggacgatcttcataacgaagagaagattacccaacagatggaccctgagcaccggcagctggctaatgccatctttaaactcacataccagaacaaggtcgtgaaggtccaacgccccaccccgacaggcaccgtgatggatattatctctagaaaagaccagcgggggagcggacaggttggcacgtatgggctgaatacattcaccaacatggaagctcagcttatccgccaaatggagggagaaggcgtgctgtccaaggccgatctcgagaaccctcatctgcccgagaaaaagattacccagtggctggagacaaaaggggtcgagagactcaagcggatggcgatcagcggcgacgattgcgtggtgaagcccattgacgatcgctttgccaatgctctgcttgccctgaacgacatgggaaaagttagaaaggatatccctcagtggcagccgtctaaaggctggcacgactggcaacaggtgcccttctgttcccaccatttccacgaactcattatgaaggatgggcggaaactggtcgtgccttgccgcccccaggacgagcttatcggacgggctcggattagccagggcgccgggtggtctctgcgcgaaaccgcttgtctcggaaaggcctacgcgcaaatgtggtccctgatgtattttcatagacgggacctgcgcctcgccagcaatgctatctgctctgccgttcctgtgcactgggtccccacatccagaacgacctggagcatccatgcccaccaccagtggatgacaaccgaggatatgctgacagtgtggaaccgggtctggattgaagacaatccttggatggaggataagacccccgtgacgacctgggagaacgttccgtaccttggcaaaagagaagaccagtggtgtgggtccctgatcggcctcacaagccgcgctacctgggcccaaaatattcctacagcgatccaacaggtgcggtctctgattggaaacgaggagttccttgattacatgcccagcatgaagagatttcgcaaagaggaggaatccgagggcgctatctggtga

SEQ ID NO: 20618 - RNA, 9873 nt, synthetic construct
  misc_feature 1..9873: note = derived and/or modified CDS sequence (opt5) from DENV-3__KJ189266__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccatgggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcatcaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcacacgtggaccgaacagtacaaatttcaggccgattcccccaagcggctggcgacagccatcgctggcgcctgggagaatggagtgtgtggcattagaagcaccacacgcatggaaaaccttctctggaaacaaatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcaactgtgtgaccaccggcttatgagcgccgctgtgaaggatgagagagccgtgcatgccgacatggggtactggattgagtcccagaaaaacggatcttggaagctcgaaaaagctagcctgatcgaggtcaagacatgcacctggcctaagtcccacaccctgtggtctaatggcgtgctcgaaagcgatatgattatccccaaatccctggccgggcctattagccagcataaccaccgccccggatatcacacacagaccgcgggcccttggcatcttgggaagctggagctcgactttaattactgcgagggaacgacagttgtgatcaccgaaaactgtggcacacggggcccctctctgagaaccacaaccgtctccgggaaactgatccacgagtggtgctgtcgcagctgcacgcttccgcctctccggtatatgggagaagatggctgttggtacgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcaaattacctggcgcgatatggctcacacactgatcatgattggatccaatgccagcgacagaatgggcatgggggtcacctatctggcgcttatcgctacgtttaaaatccagcccttcctggccctcggatttttcctgcggaagctcacatctagagaaaacctgcttctgggcgtggggctcgccatggctaccacactgcagctgcctgaggatattgaacaaatggccaatggaatcgctcttggcctgatggccctcaaactgattacccagtttgagacctaccagctctggacagcgctgatctcccttacgtgtagcaacaccattttcacactgaccgtggcctggcgcacagctaccctcatcctggccggcgtctccctgcttccggtttgccagtctagctccatgcggaagacggactggctgcccatggctgtggccgccatgggggtgcctcccctccctctgtttatcttctctctcaaggatacactgaaaagacgcagctggccccttaatgagggagtcatggctgtgggcctggtttccattctggcgtctagcctcctgagaaacgacgtgcctatggccgggccccttgtcgctggaggcctgctcatcgcctgttatgtgattaccgggacctccgccgatctgacagttgaaaaggctgccgacatcacctgggaggaagaggcggaacaaacaggagtgagccataacctcatgattacggtcgacgatgacggcaccatgcggatcaaagatgacgagacagagaatatcctgaccgtgcttctgaagacagctctgctcattgtctctggcatctttccgtactccattcctgccaccctgcttgtgtggcacacgtggcagaaacagacccagcgcagcggggttctgtgggatgtgccctctcctcccgaaacacaaaaggccgagctcgaagagggagtctacagaatcaaacagcagggcattttcgggaagacccaggtgggagttggcgtgcaaaaggagggggtctttcacacaatgtggcatgtgacccggggagctgtgctgacatataacggcaaacgcctcgaaccgaattgggcctccgttaagaaagacctgatcagctacggcgggggatggagactttctgcgcagtggcagaagggcgaggaagtccaagtgattgctatcgagcctgggaaaaaccccaagaatttccaggccatgcctggaacgttccagaccacaaccggcgaaatcggggccattgctctggattttaagcccggaacctccggcagccccatcattaaccgggagggcaaagtggtcgggctgtatggaaatggcgtggttacaaagaacgggggatacgtgtccggcatcgcccagacgaatgctgagcctgacgggccgacccccgaactcgaggaagagatgttcaaaaagcgcaacctgacaattatggatcttcaccctggcagcggaaaaaccagaaagtatctgcccgccatcgtccgggaagcgatcaagcgcagactccggacactgattctcgcccctaccagagtggttgctgccgagatggaggaagctctgaaaggccttcccatccgctaccaaacgacagccaccaagtctgagcataccgggcgggaaattgtggacctgatgtgccacgccacatttaccatgagactgctcagccctgtccgcgtgccgaattataacctgatcattatggatgaggctcatttcacagaccccgcgtccatcgccgctcggggatacatctctaccagagttggcatgggggaagccgccgctatttttatgacggccacacctcccggaaccgcggatgctttccctcagagcaatgcccccatccaggacgaggagcgcgacattccggaacggtcctggaactctggcaatgagtggatcacagattttgccgggaaaaccgtgtggttcgtccctagcattaaggctggcaacgacatcgccaactgtcttcgcaaaaatggaaagaaggtgattcagctgtccagaaaaacgtttgataccgaataccaaaagacaaaactcaacgactgggatttcgtggtcaccacagacatctctgagatgggcgcgaattttaaggccgatcgggttatcgaccccagacggtgcctgaaacccgtgattctgaccgatgggcctgagcgcgtgatcctcgctggacccatgcctgtcacagccgctagcgccgctcagagacggggccgcgtggggagaaacccgcagaaggaaaatgaccagtatattttcaccggacaaccccttaacaatgatgaggaccacgcccactggacggaagcgaagatgctgctggacaacatcaatacacctgagggcattatccccgccctcttcgaacctgagcgggagaaatccgctgccatcgatggggaatacagactgaagggcgagagccgcaaaacctttgttgaacttatgcggagaggagacctgcccgtgtggctcgctcataaggtcgcctctgagggcattaaatataccgatcgcaagtggtgcttcgacgggcagcggaacaatcagatcctggaagagaacatggatgtggagatttggacaaaagaaggagagaagaagaaactgagaccgcgctggctcgacgcccggacctactccgatcctcttgctctgaaggaatttaaagacttcgcggccggcagaaagagcatcgctctggatctcgttacagagattgggcgcgtgccctctcacctggcccatagaacgcggaatgcccttgacaacctggtcatgctccacacctccgaacacggaggccgcgcttatagacatgccgtggaggagctgcctgaaacaatggagaccctgctccttctgggcctgatgatcctcctgacagggggagcgatgctttttctgatcagcggcaaagggattggaaagacctccatcggcctcatttgtgtcatcgcctctagcgggatgctgtggatggctgaaattcccctgcagtggatcgcctccgctattgtgctcgagttctttatgatggttcttctgatccctgagcccgaaaagcaacggacgccgcaggataatcagctggcctacgtggtgatcggcattctcaccctggcggccatcattgctgccaacgagatgggccttctggaaacaaccaaacgcgacctcggcatgagcaaggagcctggggtcgtttctcccacatcctatctggatgtggacctgcaccccgctagcgcctggaccctctacgctgtggccacgacagtcatcacccctatgcttagacatacaattgaaaattctaccgcgaacgtgagcctggccgctatcgccaaccaagctgttgtgctgatgggactcgacaaaggctggccgatctccaagatggatctgggggtcccccttctggccctcggatgctactctcaggtgaatcctctgaccctgacagccgcggtcctccttctgattacgcactatgctatcattggccccgggctgcaggccaaagctacccgggaggcccagaagagaacagccgctggaatcatgaagaaccctaccgtggacggcattatgacaatcgatctcgaccccgttatctacgatagcaaattcgagaagcaactgggccaggtgatgcttctggtcctctgtgccgtgcagctgctgctcatgcgcacctcctgggcgctttgcgaagccctgacgctggctacagggcctattaccaccctctgggagggatctccgggcaaattttggaatacaaccatcgccgttagcatggctaacattttccgggggtcctatctggccggagcgggccttgcctttagcatcatgaagtctgtggggacaggaaaaagaggcacgggctcccagggggaaaccctgggagagaagtggaagaaaaagctcaatcaactgagccgcaaagagttcgacctgtacaagaaatccggcattacagaggtcgatcggaccgaggctaaggaagggctcaaaagaggagagatcacacatcacgccgtgtctcggggcagcgctaaacttcagtggtttgtggaacgcaacatggttattcccgaggggagagtcatcgacctgggatgtggccggggcgggtggtcctattactgcgccggactgaagaaagtgaccgaagtgcgcggctatacgaaagggggacctggccacgaggagcccgtccctatgtctacctacgggtggaatatcgttaaactcatgagcggaaaggatgtgttctacctgcccccggaaaaatgtgacacacttctgtgcgatattggcgagtccagcccttctcccaccgtggaagagtccagaacaatccgggtcctcaagatggtggagccctggctgaagaacaatcagttctgtattaaagttctgaacccttatatgcccaccgtgatcgaacatctcgagcgccttcagagaaagcacggcgggatgctggtccggaatcctctgagccgcaactctacacatgaaatgtactggatttccaatggaaccggcaacatcgtggctagcgttaatatggtgtctagactcctgcttaaccggtttacgatgacacacagacgcccgaccatcgagaaagacgtcgatctgggggccggaacccggcacgtgaacgcggaacccgagacacctaatatggacgtgattggcgagagaatcaagcgcattaaagaagaacacaacagcacgtggcactatgacgatgaaaatccctacaagacctgggcctatcatgggtcctacgaggtcaaggctacaggatctgccagctccatgatcaacggcgttgtgaaactcctgaccaagccttgggacgtggtccccatggtgacacaaatggctatgaccgatacaaccccgttcggccagcagcgggtttttaaagaaaaggtggacacgagaacccctcgcagcatgcccgggacacggagagtcatgggaattaccgccgagtggctgtggcgcacactcggccggaataaaaagcctagactgtgcacccgcgaggagttcacgaagaaagtgcggacaaacgccgcgatgggggctgtttttaccgaggaaaatcaatgggattccgccaaggccgctgtggaggacgaagatttctggaaacttgtcgacagagagcgcgagctgcacaagctcggaaaatgtggctcttgcgtgtataacatgatggggaagagagagaagaagctgggcgagtttggaaaggccaaaggcagccgggctatctggtacatgtggcttggggcccgctacctggagttcgaggcgctcggatttctgaatgaggatcattggttctccagagaaaactcttatagcggcgttgagggggaaggactgcacaagctcggctacatcctgcgggacatttccaaaatccccgggggcgccatgtatgctgatgacacagccggatgggacaccagaattacggaggatgaccttcacaatgaagagaagatcacccagcagatggatcctgagcatcggcagctggctaacgccatttttaaactcacataccaaaataaggtggtcaaggtgcagcgccccaccccgacaggcaccgtcatggacatcatctctagaaaagatcagcgggggagcggacaggtgggcacatatgggctgaacaccttcacgaatatggaagcgcaacttattcgccagatggagggagaaggcgttctgtccaaggccgacctcgagaaccctcatctgcccgagaagaagatcacacagtggctggagaccaaaggggtggagagactcaagcggatggctattagcggcgatgactgcgtcgtgaagcccatcgatgaccgctttgccaacgctctgcttgccctgaatgatatgggaaaagtgagaaaggacattcctcagtggcaaccgtctaaaggctggcatgattggcagcaggttcccttctgttcccaccacttccatgaactcatcatgaaggacgggcggaaactggtggtcccttgccgcccccaggacgagcttattggacgggctcggatcagccaaggcgccgggtggtctctgcgcgaaaccgcgtgtctcggaaaggcctacgctcagatgtggtccctgatgtattttcacagacgggatctgcgcctcgccagcaacgccatctgctctgctgtgcctgttcattgggtgcccacatccagaaccacatggagcattcacgcccatcaccagtggatgacgaccgaggacatgctgacagtctggaatcgggtgtggatcgaagataacccttggatggaggacaagacccccgtcacaacctgggagaatgtgccgtaccttggcaaaagagaagatcaatggtgtgggtccctgattggcctcacgagccgcgcgacctgggctcagaacatccctacagccattcagcaggttcggtctctgatcggaaatgaggagttccttgactacatgcccagcatgaagagatttcgcaaagaggaggaatccgagggcgccatctggtga

SEQ ID NO: 20619 - RNA, 9873 nt, synthetic construct
  misc_feature 1..9873: note = derived and/or modified CDS sequence (opt5) from DENV-3__KJ189268__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacaaacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaacacaatcttcaccctgacagtggcttggcggaccgccacgctcattctggctggcgtgtccctgcttccggtctgccagtctagctccatgagaaaaacagactggctgcccatggccgttgccgctatgggggtgcctcccctccctctgtttatcttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacatccgctgatctgaccgtggaaaaagccgcggacattacatgggaggaagaggctgaacaaacgggagttagccataacctcatgatcaccgtggacgatgacggcacaatgcgcattaaggatgacgagaccgagaatatcctgacagtccttctgaaaaccgccctgctcatcgtgtctggcatttttccgtactccatccctgccacgctgcttgtctggcacacctggcagaagcagacacagagaagcggggtgctgtgggatgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataacggcaagagactcgaaccgaattgggcgtccgtgaaaaaggacctgattagctacggcgggggatggcggctttctacccagtggcagaaaggcgaggaagttcaagtcatcgctgtggagcctgggaagaaccccaaaaatttccagacaatgcctggaaccttccagaccacaacgggcgaaattggggccatcgccctggattttaagcccggaacctccggcagccccatcattaaccgcgagggcaaggtggtcgggctgtatggaaatggcgtggttaccaagaacgggggatacgtgtccggcatcgctcagaccaatgccgagcctgacgggccgacacccgaactcgaggaagagatgttcaagaaaagaaacctgaccattatggatcttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggacctgatgtgccacgccacctttacgatgcgcctgctcagccctgtccgggtgccgaattataacctgatcattatggatgaggcccatttcacagaccccgcttccatcgcggccagaggatacatttctacccgcgttggcatgggggaagctgccgccatctttatgacagctacccctcccggaacggccgatgcgttccctcagagcaatgctcccatccaggacgaggagcgggacattccggaaagatcctggaactctggcaatgagtggatcaccgattttgccgggaagacagtgtggttcgtccctagcattaaagccggcaacgacatcgctaactgtcttcgcaagaatggcaaaaaggtgattcagctgtcccggaagacctttgatacagaataccagaagacaaagctcaacgactgggatttcgtggtcacaaccgacatctctgagatgggagccaattttaaagcggatagagttattgacccccggcgctgcctgaagcccgtgatcctgacggatgggcctgagagagtgatcctcgccggacccatgcctgtcacagctgccagcgctgcccagcggcgcggcagagtggggcggaacccgcagaaagaaaatgaccagtatattttcaccggacaaccccttaacaatgatgaggaccacgctcactggaccgaagccaagatgctgctggacaacatcaatacacctgagggcattatccccgccctcttcgaacctgagagagagaagtccgccgctattgatggggaataccgcctgaaaggcgagagccggaagacctttgttgaacttatgagacgcggagacctgcccgtgtggctcgcccataaagtcgcttctgagggcatcaagtatacagatcggaaatggtgcttcgacgggcagagaaacaatcagatcctggaagagaacatggatgtggagatttggacgaaggaaggagagaaaaagaagctgcgcccgcggtggctcgacgccagaacctactccgatcctcttgccctgaaagaatttaaggacttcgctgcgggccgcaaaagcatcgccctggatctcgttacagagattgggagagtgccctctcacctggctcatcggaccaagaatgcccttgacaacctggtcatgctccacacatccgaacacggaggccgcgcctatagacatgctgtggaggagctgcctgaaaccatggagacgctgctccttctgggcctgatgatcctcctgaccgggggagccatgctttttctgattagcggcaaagggatcggaaagacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacggaccccgcaggataatcagctggcttacgtggtgattggaatcctcacactggccgcgaccatcgccgctaacgagatgggccttctggaaacgacaaaacgcgacctcggcatgagcaaggagcctggggtcgtttctcccacctcctatctggatgtggacctgcaccccgccagcgcttggacactctacgccgtggctaccaccgtcattacacctatgcttagacatacgatcgaaaattctaccgccaacgtgagcctggcggccattgctaaccaagccgttgtgctgatgggactcgacaaaggctggccgatctccaagatggatctgggggtcccccttctggctctcggatgctactctcaggtgaatcctctgacactgaccgccgccgtcctccttctgattacacactatgcgatcatcggccccgggctgcaggctaaagccacccgggaggctcagaagagaacggccgccggaattatgaagaaccctacagtggacggcatcatgaccattgatctcgaccccgttatctacgatagcaaattcgagaagcaactgggccaggtgatgcttctggtcctctgtgctgtgcagctgctgctcatgcgcacctcctgggccctttgcgaagcgctgacactggccaccgggcctattacaacgctctgggagggatctccgggcaaattttggaataccacaatcgctgttagcatggccaacatcttccgggggtcctatctggctggagccggccttgcgtttagcattatgaagtctgtggggaccggaaaaagaggcacaggctcccagggggaaaccctgggagagaagtggaagaaaaagctcaatcaactgagccgcaaagagttcgacctgtacaagaaatccggcatcacggaggtcgatcggaccgaggccaaggaagggctcaaaagaggagagattacacatcacgctgtgtctcggggcagcgccaaacttcagtggtttgtggaacgcaacatggttatccccgaggggagagtcattgacctgggatgtggccggggcgggtggtcctattactgcgctggactgaagaaagtgaccgaagtgcgcggctatacaaaagggggacctggccacgaggagcccgtccctatgtctacctacgggtggaatatcgttaaactcatgagcggaaaggatgtgttctacctgcccccggaaaaatgtgacacacttctgtgcgatattggcgagtccagcccttctcccaccgtggaagagtccagaacgatccgggtcctcaagatggtggagccctggctgaagaacaatcagttctgtatcaaagttctgaacccttatatgcccacagtgattgaacatctcgagcgccttcagagaaagcacggcgggatgctggtccggaatcctctgagccgcaactctacccatgaaatgtactggatctccaatggaaccggcaacattgtggccagcgttaatatggtgtctagactcctgcttaaccggtttacaatgacgcacagacgcccgaccatcgagaaagacgtcgatctgggggctggaacacggcacgtgaacgccgaacccgagacccctaatatggacgtgattggcgagagaatcaagcgcatcaaagaagaacacaacagcacatggcactatgacgatgaaaatccctacaagacctgggcgtatcatgggtcctacgaggtcaaggccacaggatctgctagctccatgattaacggcgttgtgaaactcctgaccaagccttgggacgtggtccccatggtgacgcaaatggccatgaccgatacaaccccgttcggccagcagcgggtttttaaagaaaaggtggacacaagaacccctcgcagcatgcccgggacgcggagagtcatgggaatcacagctgagtggctgtggcgcaccctcggccggaataaaaagcctagactgtgcacacgcgaggagttcaccaagaaagtgcggacgaacgccgccatgggggcggtttttaccgaggaaaatcaatgggattccgctaaggccgccgtggaggacgaagatttctggaaacttgtcgacagagagcgcgagctgcacaagctcggaaaatgtggctcttgcgtgtataacatgatggggaagagagagaaaaagctgggcgagtttggaaaggctaaaggcagccgggccatttggtacatgtggcttggggctcgctacctggagttcgaggccctcggatttctgaatgaggatcattggttctccagagaaaactcttatagcggcgttgagggggaaggactgcacaagctcggctacatcctgcgggacatttccaaaatccccgggggcgcgatgtatgccgatgacacagctggatgggacaccagaatcacagaggatgaccttcacaatgaagagaagattacccagcagatggatcctgagcatcggcagctggccaacgctatctttaaactcacataccaaaataaggtggtcaaggtgcagcgccccaccccgacgggcacagtcatggacattatctctagaaaagatcagcgggggagcggacaggtgggcacctatgggctgaacaccttcacaaatatggaagcccaacttattcgccagatggagggagaaggcgttctgtccaaggcggacctcgagaaccctcatctgcccgagaaaaagatcacccagtggctggagacaaaaggggtggagagactcaagcggatggccatcagcggcgatgactgcgtcgtgaagcccattgatgaccgctttgctaacgccctgcttgctctgaatgatatgggaaaagtgagaaaggacatccctcagtggcaaccgtctaaaggctggcatgattggcagcaggttcccttctgttcccaccacttccatgaactcattatgaaggacgggcggaaactggtggtcccttgccgcccccaggacgagcttatcggacgggcgcggattagccaaggcgctgggtggtctctgcgcgaaacggcctgtctcggaaaggcgtacgcccagatgtggtccctgatgtattttcacagacgggatctgcgcctcgctagcaacgccatctgctctgccgtgcctgttcattgggtgcccacctccagaacaacctggagcattcacgctcatcaccagtggatgacaaccgaggacatgctgacggtctggaatcgggtgtggatcgaagataacccttggatggaggacaagacccccgtcacaacctgggaggatgtgccgtaccttggcaaaagagaagaccaatggtgtgggtccctgatcggcctcacaagccgcgccacctgggcgcagaatattcctacggctatccagcaggttcggtctctgattggaaacgaggagttccttgattacatgcccagcatgaagagatttcgcaaagaggaggaatccgagggcgccatctggtga

SEQ ID NO: 20620 - RNA, 9873 nt, synthetic construct
  misc_feature 1..9873: note = derived and/or modified CDS sequence (opt5) from DENV-3__KJ189271__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaaacttggcaagaaacatatgattgctggcgtgttcttcacctttgttctgctcctgagcgggcaaatcacatggagagatatggcccacaccctgattatgatcggatccaatgcgagcgaccggatgggcatgggggtgacgtatcttgctctgattgccacattcaagatccagccctttctcgccctgggattctttctcagaaaactgacctctcgcgaaaaccttctgctcggcgtcgggctggctatggccacaaccctgcagcttcctgaggatatcgaacaaatggctaatggaattgccctgggcctcatggcgctgaagctcatcacccagttcgagacataccagctgtggacggcccttatttccctgacctgtagcaacacaatctttaccctcacagtggcttggcggaccgccacgctgattctggctggcgtgtcccttctgccggtctgccagtctagctccatgagaaaaacagactggctccccatggccgttgccgctatgggggtgcctcccctgcctctcttcatcttttctctgaaggatacccttaagcgcagaagctggcccctgaatgagggagtgatggcggtcggcctggtgtccatcctcgcctctagcctgcttcggaacgacgttcctatggctgggcccctggtggccggaggcctcctgattgcctgttatgtcatcaccgggacatccgctgatctcaccgtggaaaaagccgcggacattacatgggaggaagaggctgaacaaacgggagttagccataacctgatgatcaccgtggacgatgacggcacaatgcgcattaaggatgacgagaccgagaatatccttacagtcctgctgaaaaccgccctcctgatcgtgtctggcattttcccgtactccatccctgccacgcttctggtctggcacacctggcagaagcagacacagagaagcggggtgctctgggatgttccctctcctcccgaaacccaaaaagctgagctggaagagggagtgtaccggattaagcagcagggcatctttgggaaaacacaggtcggagtgggcgttcaaaaggagggggtgttccacaccatgtggcatgtcacacgcggagccgtgctcacgtataacggcaagagactggaaccgaattgggcgtccgtgaaaaaggaccttattagctacggcgggggatggcggctgtctacccagtggcagaaaggcgaggaagttcaagtcatcgctgtggagcctgggaagaaccccaaaaattttcagacaatgcctggaaccttccagaccacaacgggcgaaattggggccatcgccctggatttcaagcccggaacctccggcagccccatcattaaccgcgagggcaaggtggtcgggctctatggaaatggcgtggttaccaagaacgggggatacgtgtccggcatcgctcagaccaatgccgagcctgacgggccgacacccgaactggaggaagagatgtttaagaaaagaaaccttaccattatggatctgcaccctggcagcggaaagacgcggaaatatctccccgctatcgtccgcgaagccattaagagacggctgagaacactcatcctggcgcctacccgcgtggttgccgctgagatggaggaagcccttaagggcctgcccatccggtaccaaaccacagctaccaaatctgagcatacagggagagaaattgtggacctgatgtgccacgccaccttcacgatgcgcctcctgagccctgtccgggtgccgaattataaccttatcattatggatgaggcccattttacagaccccgcttccatcgcggccagaggatacatttctacccgcgttggcatgggggaagctgccgccatcttcatgacagctacccctcccggaacggccgatgcgtttcctcagagcaatgctcccatccaggacgaggagcgggacattccggaaagatcctggaactctggcaatgagtggatcaccgatttcgccgggaagacagtgtggtttgtccctagcattaaagccggcaacgacatcgctaactgtctgcgcaagaatggcaaaaaggtgattcagctctcccggaagaccttcgatacagaataccagaagacaaagctgaacgactgggattttgtggtcacaaccgacatctctgagatgggagccaatttcaaagcggatagagttattgacccccggcgctgcctgaagcccgtgatcctcacggatgggcctgagagagtgatccttgccggacccatgcctgtcacagctgccagcgctgcccagcggcgcggcagagtggggcggaacccgcagaaagaaaatgaccagtatatttttaccggacaacccctgaacaatgatgaggaccacgctcactggaccgaagccaagatgctgctcgacaacatcaatacacctgagggcattatccccgcgctgttcgaacctgagagagagaagtccgccgctattgatggggaataccgccttaaaggcgagagccggaagaccttcgttgaactgatgagacgcggagacctccccgtgtggctggcccataaagtcgcttctgagggcatcaagtatacagatcggaaatggtgctttgacgggcagagaaacaatcagatcctggaagagaacatggatgtggagatttggacgaaggaaggagagaaaaagaagctccgcccgcggtggcttgacgccagaacctactccgatcctctggccctgaaagagttcaaggactttgctgcgggccgcaaaagcatcgccctcgatctggttacagagattgggagagtgccctctcaccttgctcatcggacccgcaatgccctggacaacctcgtcatgctgcacacatccgaacacggaggcagagcctatcggcatgctgtggaggagctgcctgaaaccatggagacgctccttctgctgggcctcatgatcctgcttaccgggggagccatgctgttcctcattagcggcaaggggatcggaaaaacatccatcggcctgatttgtgtcatcgcgtctagcgggatgctgtggatggccgaaattcccctccagtggatcgcttccgccattgtgcttgagtttttcatgatggttctgctgatccctgagcccgaaaagcaacgcaccccgcaggataatcagctcgcttacgtggtgattggaatcctgacacttgccgcgatcattgccgctaacgagatgggcctgctcgaaaccacgaagagagacctgggcatgagcaaagagcctggggtcgtttctcccacatcctatctggatgtggacctccaccccgccagcgcttggaccctttacgccgtggctacaaccgtcatcacccctatgctgcggcatacaattgaaaattctacggccaacgtgagcctggcggccatcgctaaccaagccgttgtgctcatgggactggacaagggctggccgatttccaaaatggatcttggggtccccctgctcgctctgggatgctactctcaggtgaatcctctgaccctcacagccgccgtccttctgctgatcacccactatgcgatcattggccccgggctccaggctaaggccacaagagaggctcagaaacgcaccgccgccggaatcatgaagaaccctacggtggacggcattatgacaatcgatctggaccccgttatttacgatagcaagtttgagaaacaacttggccaggtgatgctgctcgtcctgtgtgctgtgcagctgctccttatgcggacctcctgggccctgtgcgaagcgctgaccctcgccacagggcctatcaccacactgtgggagggatctccgggcaagttctggaatacgaccatcgctgttagcatggccaacatttttagagggtcctatcttgctggagccggcctggcgttcagcatcatgaaatctgtggggacaggaaagcgcggcaccggctcccagggggaaacactcggagagaaatggaagaagaaactgaatcaactgagccggaaggaatttgacctctacaaaaagtccggcattaccgaggtcgatagaacggaggccaaagaagggcttaagcggggagagatcacccatcacgctgtgtctcgcggcagcgccaaactgcagtggttcgtggaaagaaacatggttattcccgaggggcgggtcatcgacctgggatgtggccgcggcgggtggtcctattactgcgctggactcaagaaggtgacagaagtgagaggctataccaaagggggacctggccacgaggagcccgtccctatgtctacatacgggtggaatattgttaagctgatgagcggaaaagatgtgttttaccttcccccggaaaagtgtgacaccctgctctgcgatatcggcgagtccagcccttctcccacagtggaagagtcccggaccatccgcgtcctgaaaatggtggagccctggctgaagaacaatcagttctgtattaaggttctcaacccttatatgcccacggtgatcgaacatcttgagagactgcagcggaaacacggcgggatgctggtccgcaatcctctcagcagaaactctacacatgaaatgtactggatttccaatggaaccggcaacatcgtggccagcgttaatatggtgtctcggctgcttctgaacagattcaccatgacacaccgccggccgacgattgagaaggacgtcgatctcggggctggaaccagacacgtgaacgccgaacccgagacacctaatatggacgtgatcggcgagcgcatcaaacggattaaggaagaacacaacagcacctggcactatgacgatgaaaatccctacaaaacatgggcgtatcatgggtcctacgaggtcaaggccaccggatctgctagctccatgatcaacggcgttgtgaagctgctgacaaaaccttgggacgtggtccccatggtgacccaaatggccatgacggataccacaccgtttggccagcagagagttttcaaggaaaaagtggacacccgcacacctcggagcatgcccgggaccagacgcgtcatgggaattacggctgagtggctctggcggacactgggcagaaataagaaacctcgcctttgcacccgggaggaatttacaaagaaggtgagaaccaacgccgccatgggggcggttttcacggaggaaaatcaatgggattccgctaaagccgccgtggaggacgaagatttttggaagctggtcgaccgcgagagagagctccacaaactgggaaagtgtggctcttgcgtgtataacatgatggggaaacgggaaaagaaacttggcgagttcggaaaggctaagggcagccgcgccatctggtacatgtggctgggggctagatacctcgaatttgaggccctgggattcctgaatgaggatcattggttttcccgggaaaactcttatagcggcgttgagggggaaggactccacaaactgggctacattcttagagacatctccaagatccccgggggcgcgatgtatgccgatgacaccgctggatgggacacacggattaccgaggatgacctgcacaatgaagagaaaatcacacagcagatggatcctgagcatcgccagctcgccaacgctattttcaagctgacctaccaaaataaagtggtcaaggtgcagagacccacaccgaccggcacggtcatggacatcatttctcggaaggatcagcgcgggagcggacaggtgggcacatatgggcttaacacctttaccaatatggaagcccaactgatcagacagatggagggagaaggcgttctctccaaagcggacctggagaaccctcatctgcccgaaaagaaaatcacacagtggctcgagaccaagggggtggagcggctgaaacgcatggccattagcggcgatgactgcgtcgtgaagcccatcgatgacagattcgctaacgcccttctggctctcaatgatatgggaaaggtgcggaaagacattcctcagtggcaaccgtctaagggctggcatgattggcagcaggttcccttttgttcccaccacttccatgaactgatcatgaaagacgggcgcaaacttgtggtcccttgcagaccccaggacgagctgattggacgggcccgcatcagccaaggcgctgggtggtctctcagagaaacagcctgtctgggaaaagcgtacgcccagatgtggtccctgatgtatttccaccggcgcgatctcagactggctagcaacgccatttgctctgccgtgcctgttcattgggtgcccacgtcccggaccacatggagcatccacgctcatcaccagtggatgaccacagaggacatgcttaccgtctggaatagagtgtggatcgaagataacccttggatggaggacaagacgcccgtcaccacatgggaggatgtgccgtacctgggcaagcgcgaagaccaatggtgtgggtccctcattggcctgaccagccgggccacatgggcgcagaatatccctaccgctattcagcaggttagatctcttatcggaaacgaggaatttctggattacatgcccagcatgaaacgcttccggaaggaggaggaatccgagggcgccatttggtga

SEQ ID NO: 20621 - RNA, 9873 nt, synthetic construct
  misc_feature 1..9873: note = derived and/or modified CDS sequence (opt5) from DENV-3__KJ189272__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgtatatcacagaagttgagcccgaagacattgattgctggtgtaacctcacctccacatgggtgacctacggaacgtgcaatcaggccggcgagcatcggcgggacaagcgctctgtggccctggctcctcacgtcgggatgggactggataccagaacacaaacctggatgagcgccgagggcgcttggagacaggtggaaaaagttgagacatgggccctccgccatcccggcttcaccatcctggcgctttttctggcccactatatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcatggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattacgtgtgtaaacacacctatgtcgatcggggctgggggaacggatgcggcctgttcgggaagggaagccttgtgacctgcgccaagtttcaatgtctggagcccattgagggcaaagttgtgcagtacgaaaatctcaagtatacagtcatcatcaccgtgcacacaggggaccagcatcaggttggaaacgagacgcaaggcgtgaccgctgaaattacacctcaggcctctaccacagaggctaccctgcccgaatacggcacgctggggctcgagtgctcccctcgcaccggactggacttcaatgagatgatccttctgacaatgaaaaacaaggcctggatggtccacagacagtggtttttcgatctccccctgccgtggaccagcggcgccacaaccgaaacgcctacatggaatcggaaagagcttctggtgacctttaagaacgctcatgcgaaaaagcaagaagtcgtggttctcgggtctcaggagggagccatgcacacagctctgaccggcgccaccgaaattcaaaattccgggggcacaagcatcttcgccggacacctgaagtgtcgcctcaaaatggacaagctggagcttaaaggcatgtcttacgctatgtgcacgaacacctttgtgctgaagaaagaggtctccgaaacacagcatgggaccattctcatcaaggtggagtataagggagaagatgccccctgtaaaatccctttcagcacagaggacggccacgggaaggcgcataacggaagactgattaccgctaatcccgttgtgacgaaaaaggaggaacccgtctccatcgaggccgaacctccgttcggcgagtctaacattgtgatcgggattggcgataatgccctgaaaatcaactggtacaagaagggaagctccatcggcaaaatgtttgaagctacagccagaggggctagacgcatggccattcttggagacaccgcgtgggatttcggcagcgtcgggggagttctcaattctctgggcaagatggtccaccaaatctttgggtccgcctataccgctctgttcagcggcgtgtcttgggtgatgaaaattggaatcggcgtcctcctgacatggattgggcttaacagcaagaatacctccatgtcttttagctgcatcgccattggaatcatcacactgtacctcggcgctgtggttcaggccgacatggggtgtgtgattaactggaaaggaaaggagctgaagtgcggctccgggatcttcgtcacgaatgaggtgcatacctggacagaacagtataaatttcaggcggatagccccaagcggctggccaccgctattgccggcgcttgggagaacggagtttgtggcatcagatctacaacccgcatggaaaatcttctctggaaacaaattgccaacgagctgaattacatcctgtgggaaaacaatatcaagctcacggtggtcgtgggggacattatcggagttctggagcagggcaaacggacccttacacctcagcccatggagctgaagtattcctggaaaacctgggggaaggccaagattgtgacagctgaaacccagaacagctctttcatcattgatggacctaacacacccgagtgcccgtccgcgagcagagcctggaatgtctgggaagtggaggactacggctttggcgtgttcaccacgaacatctggctccgcctgcgggaagtctacacacaactgtgtgaccacagacttatgtccgctgccgttaaagatgagcgcgccgtgcacgctgacatggggtattggatcgagtctcagaagaatggaagctggaaactcgaaaaggcctccctgattgaggtgaaaacctgcacctggcctaagtctcatacactgtggagcaacggcgtcctcgaatccgatatgatcattcccaagagcctggcggggcctatctctcagcacaatcatcggcccggataccacacccagacggctggcccttggcaccttgggaaactggagctcgactttaactattgcgagggaacaaccgtggttattacagaaaattgtggcaccagaggcccctccctgcgcacaaccacggtgagcgggaagctgatccatgagtggtgctgtcggtcttgcacccttccgcctctcagatacatgggagaagatggctgttggtatgggatggagatccggcccatttccgaaaaagaggagaacatggtcaagagcctggtgtctgccggaagcggcaaagttgacaatttcacaatgggggtgctgtgcctcgccatcctgtttgaagaggtcatgcgcggaaagttcggcaagaaacacatgattgctggcgtgttctttaccttcgttcttctgctctccgggcaaatcacatggagagatatggcccataccctgattatgatcggaagcaacgcgtctgaccggatgggcatgggggtgacgtacctggctcttattgccacatttaagatccagcccttcctggccctcggatttttcctgagaaaactcacctcccgcgaaaatctgcttctgggcgtcgggctcgctatggccacaaccctgcagctgcctgaggatatcgaacaaatggctaacggaattgcccttggcctgatggcgctcaagctgatcacccagtttgagacatatcagctctggacggccctgattagccttacctgttccaatacaatcttcaccctgacagtggcttggcggaccgccacgctcattctggctggcgtgtctctgcttccggtctgccagagctcctctatgagaaaaacagactggctgcccatggccgttgccgctatgggggtgcctcccctccctctgtttatcttcagcctcaaggataccctgaagcgcagatcctggccccttaacgagggagtgatggcggtcggcctggtgtctatcctggccagctccctcctgcggaatgacgttcctatggctgggccccttgtggccggaggcctgctcattgcctgttacgtcatcaccgggacaagcgctgatctgaccgtggaaaaagccgcggacattacatgggaggaagaggctgaacaaacgggagtttctcacaacctcatgatcaccgtggacgatgacggcacaatgcgcattaaggatgacgagaccgagaacatcctgacagtccttctgaaaaccgccctgctcatcgtgtccggcatttttccgtacagcatccctgccacgctgcttgtctggcatacctggcagaagcagacacagagatctggggtgctgtgggatgttccctcccctcccgaaacccaaaaagctgagctcgaagagggagtgtatcggattaagcagcagggcatcttcgggaaaacacaggtcggagtgggcgttcaaaaggagggggtgtttcacaccatgtggcacgtcacacgcggagccgtgctgacgtacaatggcaagagactcgaaccgaactgggcgagcgtgaaaaaggacctgatttcttatggcgggggatggcggctttccacccagtggcagaaaggcgaggaagttcaagtcatcgctgtggagcctgggaagaatcccaaaaacttccagacaatgcctggaaccttccagaccacaacgggcgaaattggggccatcgccctggattttaagcccggaaccagcggctcccccatcattaatcgcgagggcaaggtggtcgggctgtacggaaacggcgtggttaccaagaatgggggatatgtgagcggcatcgctcagaccaacgccgagcctgacgggccgacacccgaactcgaggaagagatgttcaagaaaagaaatctgaccattatggatcttcatcctggctctggaaagacgcggaaatacctgcccgctatcgtccgcgaagccattaagagacggctcagaacactgatcctcgcgcctacccgcgtggttgccgctgagatggaggaagccctgaagggccttcccatccggtatcaaaccacagctaccaaaagcgagcacacagggagagaaattgtggacctgatgtgccatgccacctttacgatgcgcctgctctcccctgtccgggtgccgaactacaatctgatcattatggatgaggcccacttcacagaccccgcttctatcgcggccagaggatacattagcacccgcgttggcatgggggaagctgccgccatctttatgacagctacccctcccggaacggccgatgcgttccctcagtccaacgctcccatccaggacgaggagcgggacattccggaaagatcttggaatagcggcaacgagtggatcaccgattttgccgggaagacagtgtggttcgtcccttccattaaagccggcaatgacatcgctaactgtcttcgcaagaacggcaaaaaggtgattcagctgtctcggaagacctttgatacagaatatcagaaaacaaagctcaatgactgggatttcgtggtcacaaccgacatcagcgagatgggagccaactttaaagcggatagagttattgacccccggcgctgcctgaagcccgtgatcctgacggatgggcctgagagagtgatcctcgccggacccatgcctgtcacagctgcctccgctgcccagcggcgcggcagagtggggcggaatccgcagaaagaaaacgaccagtacattttcaccggacaaccccttaataacgatgaggaccatgctcactggaccgaagccaagatgctgctggacaatatcaacacacctgagggcattatccccgccctcttcgaacctgagagagaaaagagcgccgctattgatggggaatatcgcctgaaaggcgagtctcggaagacctttgttgaacttatgagacgcggagacctgcccgtgtggctcgcccacaaagtcgcttccgagggcatcaagtacacagatcggaaatggtgcttcgacgggcagagaaataaccagatcctggaagagaatatggatgtggagatttggacgaaggaaggagagaaaaagaagctgcgcccgcggtggctcgacgccagaacctatagcgatcctcttgccctgaaagaatttaaggacttcgctgcgggccgcaaatctatcgccctggatctcgttacagagattgggagagtgccctcccatctggctcaccggacccgcaacgcccttgacaatctggtcatgctccatacaagcgaacacggaggcagagcctaccggcacgctgtggaggagctgcctgaaaccatggagacgctgctccttctgggcctgatgatcctcctgaccgggggagccatgctttttctgatttccggcaaggggatcggaaaaacatctatcggcctcatttgtgtcatcgcgagctccgggatgctgtggatggccgaaattcccctgcagtggatcgctagcgccattgtgctcgagttctttatgatggttcttctgatccctgagcccgaaaagcaacgcaccccgcaggataaccagctggcttatgtggtgattggaatcctcacactggccgcgatcattgccgctaatgagatgggccttctggaaaccacgaagagagacctcggcatgtctaaagagcctggggtcgtttcccccacaagctacctggatgtggacctgcatcccgcctctgcttggaccctctacgccgtggctacaaccgtcatcacccctatgcttcggcacacaattgaaaacagcacggccaatgtgtccctggcggccatcgctaaccaagccgttgtgctgatgggactcgacaagggctggccgatttctaaaatggatctgggggtcccccttctggctctcggatgctatagccaggtgaaccctctgaccctgacagccgccgtcctccttctgatcacccattacgcgatcattggccccgggctgcaggctaaggccacaagagaggctcagaaacgcaccgccgccggaatcatgaagaatcctacggtggacggcattatgacaatcgatctcgaccccgttatttatgattccaagttcgagaaacaactgggccaggtgatgcttctggtcctctgtgctgtgcagctgctgctcatgcggacctcttgggccctttgcgaagcgctgaccctggccacagggcctatcaccacactctgggagggaagcccgggcaagttttggaacacgaccatcgctgtttccatggccaatattttcagagggagctacctggctggagccggccttgcgttttctatcatgaaatccgtggggacaggaaagcgcggcaccggcagccagggggaaacactgggagagaaatggaagaagaaactcaaccaactgtcccggaaggagttcgacctgtataaaaagtctggcattaccgaggtcgatagaacggaggccaaagaagggctcaagcggggagagatcacccaccatgctgtgagccgcggctccgccaaacttcagtggtttgtggaaagaaatatggttattcccgaggggcgggtcatcgacctgggatgtggccgcggcgggtggtcttactattgcgctggactgaagaaggtgacagaagtgagaggctacaccaaagggggacctggccacgaggagcccgtccctatgagcacatacgggtggaacattgttaagctcatgtccggaaaagatgtgttctatctgcccccggaaaagtgtgacacccttctgtgcgatatcggcgagagctctccttcccccacagtggaagagagccggaccatccgcgtcctcaaaatggtggagccctggctgaagaataaccagttctgtattaaggttctgaatccttacatgcccacggtgatcgaacacctcgagagacttcagcggaaacatggcgggatgctggtccgcaaccctctgtctagaaattccacacacgaaatgtattggattagcaacggaaccggcaatatcgtggcctctgttaacatggtgagccggctcctgcttaatagatttaccatgacacatcgccggccgacgattgagaaggacgtcgatctgggggctggaaccagacacgtgaacgccgaacccgagacacctaacatggacgtgatcggcgagcgcatcaaacggattaaggaagaacacaattccacctggcattacgacgatgaaaacccctataaaacatgggcgtaccacgggtcttatgaggtcaaggccaccggaagcgcttccagcatgatcaatggcgttgtgaagctcctgacaaaaccttgggacgtggtccccatggtgacccaaatggccatgacggataccacaccgttcggccagcagagagtttttaaggaaaaagtggacacccgcacacctcggtccatgcccgggaccagacgcgtcatgggaattacggctgagtggctgtggcggacactcggcagaaacaagaaacctcgcctgtgcacccgggaggagttcacaaagaaggtgagaaccaatgccgccatgggggcggtttttacggaggaaaaccaatgggattctgctaaagccgccgtggaggacgaagatttctggaaacttgtcgaccgcgagagagagctgcataaactcggaaagtgtggcagctgcgtgtacaatatgatggggaaacgggaaaagaaactgggcgagtttggaaaggctaagggctcccgcgccatctggtacatgtggcttggggctagatatctggagttcgaggccctcggatttctgaacgaggatcactggttctctcgggaaaatagctactccggcgttgagggggaaggactgcataaactcggctatattctgagagacatctctaagatccccgggggcgcgatgtacgccgatgacaccgctggatgggacacacggattaccgaggatgaccttcacaacgaagagaaaatcacacagcagatggatcctgagcaccgccagctggccaatgctatttttaagctcacctatcaaaacaaagtggtcaaggtgcagagacccacaccgaccggcacggtcatggacatcattagccggaaggatcagcgcgggtccggacaggtgggcacatacgggctgaataccttcaccaacatggaagcccaacttatcagacagatggagggagaaggcgttctgagcaaagcggacctcgagaatcctcatctgcccgaaaagaaaatcacacagtggctggagaccaagggggtggagcggctcaaacgcatggccatttctggcgatgactgcgtcgtgaagcccatcgatgacagatttgctaacgccctgcttgctctgaacgatatgggaaaggtgcggaaagacattcctcagtggcaaccgtccaagggctggcacgattggcagcaggttcccttctgtagccatcacttccacgaactcatcatgaaagacgggcgcaagctggtggtcccttgcagaccccaggacgagcttattggacgggcccgcatctctcaaggcgctgggtggtccctgagagaaacagcctgtctcggaaaagcgtatgcccagatgtggagcctgatgtactttcatcggcgcgatctgagactcgcttctaatgccatttgctccgccgtgcctgttcactgggtgcccacgagccggaccacatggtccatccatgctcaccatcagtggatgaccacagaggacatgctgaccgtctggaacagagtgtggatcgaagataatccttggatggaggacaagacgcccgtcaccacatgggaggatgtgccgtaccttggcaagcgcgaagaccaatggtgtgggagcctgattggcctcacctctcgggccacatgggcgcagaacatccctaccgctattcagcaggttagaagcctgatcggaaatgaggagttccttgattatatgccctccatgaaacgctttcggaaggaggaggaatctgagggcgccatttggtga

SEQ ID NO: 20622 - RNA, 9873 nt, synthetic construct
  misc_feature 1..9873: note = derived and/or modified CDS sequence (opt5) from DENV-3__KJ189273__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggtcaccctgcccgaatatggcacgctggggctcgagtgctcccctcgcaccggactggacttcaatgagatgatccttctgacaatgaaaaacaaggcttggatggtgcatagacagtggtttttcgatctccccctgccgtggaccagcggcgccacaaccgaaacgcctacatggaatcggaaagagcttctggtcacctttaagaacgcccacgctaaaaagcaagaagtggttgtgctcgggtctcaggagggagcgatgcacacagccctgaccggcgctaccgaaattcaaaattccgggggcacaagcatcttcgccggacatctgaagtgtcgcctcaaaatggacaagctggagcttaaaggcatgtcttacgccatgtgcacgaacacctttgtcctgaagaaagaggtgtccgaaacacagcacgggaccattctcatcaaggttgagtacaagggagaagatgctccctgtaaaatccctttcagcacagaggacggccatgggaaggcccacaacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcatcaaatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcacacctggacagaacagtacaaatttcaggccgattcccccaagcggctggcgaccgccattgctggcgcctgggagaatggagtgtgtggcatcagaagcacaacccgcatggaaaaccttctctggaaacaaattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccagaactccagcttcatcattgatggacctaatacacccgagtgcccgtctgcttccagagcgtggaacgtgtgggaagtggaggactatggctttggcgtcttcaccacgaatatctggctccgcctgcgggaagtttacacacaactgtgtgaccacagacttatgagcgccgctgtgaaagatgagcgcgccgtgcatgccgacatggggtactggatcgagtcccagaagaacggatcttggaaactcgaaaaggctagcctgattgaggtcaaaacctgcacctggcctaagtcccacacactgtggtctaatggcgtgctcgaaagcgatatgatcattcccaagtccctggccgggcctatcagccagcataaccaccggcccggatatcacacccagacggcgggcccttggcatcttgggaaactggagctcgactttaattactgcgagggaacaaccgttgtgattacagaaaactgtggcaccagaggcccctctctgcgcacaaccacggtctccgggaagctgatccacgagtggtgctgtcggagctgcacccttccgcctctcagatatatgggagaagatggctgttggtacgggatggagatccggcccatttctgaaaaagaggagaatatggtgaagtccctggttagcgctggatctggcaaagtggacaacttcacaatgggggtcctgtgcctcgccatcctgtttgaagaggtgatgcgcggaaagttcggcaagaaacatatgattgccggcgttttctttaccttcgtgcttctgctcagcgggcaaatcacatggagagatatggctcacaccctgattatgatcggatccaatgccagcgaccggatgggcatgggggtcacgtatctggcgcttattgctacatttaagatccagcccttcctggccctcggatttttcctgagaaaactcacctctcgcgaaaacctgcttctgggcgtggggctcgccatggctacaaccctgcagctgcctgaggatatcgaacaaatggccaatggaattgctcttggcctgatggccctcaagctgatcacccagtttgagatttaccagctctggacagcgctgatctcccttacgtgtagcaacaccattttcacactgaccgtggcctggcggacagctaccctcatcctggccggcgtctccctgcttccggtttgccagtctagctccatgagaaaaacggactggctgcccatggctgtggccgccatgggggtgcctcccctccctctgtttatcttctctctcaaggatacactgaagcgcagaagctggccccttaatgagggagtcatggctgtgggcctggtttccattctggcgtctagcctcctgcggaacgacgtgcctatggccgggccccttgtcgctggaggcctgctcatcgcctgttatgtgattaccgggacctccgccgatctgacagttgaaaaagctgccgacatcacctgggaggaagaggcggaacaaacaggagtgagccataacctcatgattacggtcgacgatgacggcaccatgcgcatcaaggatgacgagacagagaatatcctgaccgtgcttctgaaaacagctctgctcattgtctctggcatctttccgtactccattcctgccaccctgcttgtgtggcacacgtggcagaagcagacccagagaagcggggttctgtgggatgtgccctctcctcccgaaacacaaaaagccgagctcgaagagggagtctaccggatcaagcagcagggcattttcgggaaaacccaggtgggagttggcgtgcaaaaggagggggtctttcacacaatgtggcatgtgacccgcggagctgtgctgacatataacggcaagagactcgaaccgaattgggcctccgttaaaaaggacctgatcagctacggcgggggatggcggctttctacgcagtggcagaaaggcgaggaagtccaagtgattgcggtggagcctgggaagaaccccaaaaatttccagaccatgcctggaacattccagaccaccacaggcgaaatcggggctatcgccctggattttaagcccggaacgtccggcagccccattatcaaccgcgagggcaaggtcgtggggctgtatggaaatggcgttgtgaccaaaaacgggggatacgtctccggcattgcccagacaaatgctgagcctgacgggccgacccccgaactcgaggaagagatgttcaagaaaagaaacctgacaatcatggatcttcaccctggcagcggaaagacccggaaatatctgcccgccattgtgcgcgaagctatcaagagacggctcagaacgctgatcctcgcccctacacgcgttgtggcggccgagatggaggaagctctgaagggccttcccattcggtaccaaaccaccgccacaaaatctgagcataccgggagagaaatcgtcgacctgatgtgccacgctacatttaccatgcgcctgctcagccctgtgcgggttccgaattataacctgattatcatggatgaggcccatttcacggaccccgcctccattgctgcgagaggatacatctctacacgcgtgggcatgggggaagccgctgccatctttatgaccgccacacctcccggaaccgctgatgccttccctcagagcaatgcgcccattcaggacgaggagcgggacatcccggaaagatcctggaactctggcaatgagtggattacggattttgctgggaagaccgtctggttcgtgcctagcatcaaagccggcaacgacattgccaactgtcttcgcaagaatggcaaaaaggtgatccagctgtcccggaagacatttgataccgaataccagaagacgaagctcaacgactgggatttcgtcgttaccacagacatttctgagatgggagctaattttaaagccgatagagtgatcgacccccggcgctgcctgaagcccgtgatcctgaccgatgggcctgagagagtcattctcgcgggacccatgcctgtgacggccgctagcgccgctcagcggcgcggcagagttgggcggaacccgcagaaagaaaatgaccagtatatcttcacaggacaaccccttaacaatgatgaggaccacgcccactggaccgaagctaagatgctgctggacaacattaatacccctgagggcatcattcccgccctcttcgaacctgagagagagaagtccgcggccatcgatggggaataccgcctgaaaggcgagagccggaagacatttgtggaacttatgagacgcggagacctgcccgtctggctcgctcataaagtggcctctgagggcatcaagtataccgatcggaaatggtgcttcgacgggcagagaaacaatcagattctggaagagaacatggatgttgagatctggacaaaggaaggagagaaaaagaagctgcgcccgcggtggctcgacgctagaacgtactccgatcctcttgccctgaaagaatttaaggacttcgccgctggccgcaaaagcattgcgctggatctcgtgaccgagatcgggagagtcccctctcacctggcccatcggacacgcaatgctcttgacaacctggtgatgctccacacctccgaacacggaggcagagcctatcggcatgccgtcgaggagctgcctgaaacaatggagaccctgctccttctgggcctgatgattctcctgacagggggagctatgctttttctgatcagcggcaaggggatcggaaaaacctccattggcctcatctgtgtgattgcctctagcgggatgctgtggatggcggaaatccccctgcagtggattgcctccgctatcgttctcgagttctttatgatggtgcttctgattcctgagcccgaaaagcaacgcacaccgcaggataatcagctggcctacgtggtcatcggaatcctcaccctggctgccattatcgcggccaacgagatgggccttctggaaacaaccaagagagacctcggcatgagcaaagagcctggggttgtgtctcccacgtcctatctggatgtggacctgcaccccgctagcgcctggacactctacgctgtcgccaccacagtgattacccctatgcttcggcataccatcgaaaattctacagctaacgttagcctggccgcgattgccaaccaagctgtggtcctgatgggactcgacaagggctggccgatctccaaaatggatctgggggtgccccttctggccctcggatgctactctcaggtcaatcctctgacgctgaccgctgccgtgctccttctgatcacacactatgccattatcggccccgggctgcaggcgaaggctaccagagaggcccagaaacgcacagctgccggaattatgaagaaccctaccgttgacggcatcatgacgattgatctcgaccccgtgatctacgatagcaagttcgagaaacaactgggccaggtcatgcttctggtgctctgtgccgttcagctgctgctcatgcggacatcctgggctctttgcgaagccctgaccctggcgaccgggcctatcacaaccctctgggagggatctccgggcaagttttggaatacaacgattgccgtgagcatggctaacatcttcagagggtcctatctggccggagctggccttgcctttagcattatgaaatctgtcgggaccggaaagcgcggcacaggctcccagggggaaaccctgggagagaaatggaagaagaaactcaatcaactgagccggaaggagttcgacctgtacaaaaagtccggcatcacagaggtggatagaaccgaggcgaaagaagggctcaagcggggagagattacgcatcacgccgtgtctcgcggcagcgctaaacttcagtggtttgttgaaagaaacatggtcatccccgaggggcgggtgattgacctgggatgtggccgcggcgggtggtcctattactgcgccggactgaagaaggtgaccgaagtcagaggctatacaaaagggggacctggccacgaggagcccgttcctatgtctacctacgggtggaatatcgtgaagctcatgagcggaaaagatgtgttctacctgcccccggaaaagtgtgacacacttctgtgcgatatcggcgagtccagcccttctcccaccgtcgaagagtcccggacaattcgcgtgctcaaaatggttgagccctggctgaagaacaatcagttctgtatcaaggtgctgaacccttatatgcccaccgtcattgaacatctcgagagacttcagcggaaacacggcgggatgctggtgcgcaatcctctgagcagaaactctacgcatgaaatgtactggatctccaatggaacaggcaacattgttgctagcgtgaatatggtctctcggctcctgcttaacagatttaccatgacccaccgccggccgacaatcgagaaggacgtggatctgggggccggaacgagacacgtgaacgctgaacccgagacccctaatatggacgtcatcggcgagcgcattaaacggatcaaggaagaacacaacagcacatggcactatgacgatgaaaatccctacaaaacctgggcctatcatgggtcctacgaggttaaggcgacaggatctgccagctccatgattaacggcgtggtgaagctcctgaccaaaccttgggacgtcgtgcccatggttacacaaatggctatgaccgatacgaccccgttcggccagcagagagtgtttaaggaaaaagtcgacacacgcacccctcggagcatgcccgggacaagacgcgtgatgggaatcaccgccgagtggctgtggcggacgctcggcagaaataagaaacctcgcctgtgcacacgggaggagttcaccaagaaggttagaacaaacgctgccatgggggccgtgtttaccgaggaaaatcaatgggattccgcgaaagctgccgtcgaggacgaagatttctggaaacttgtggaccgcgagagagagctgcacaaactcggaaagtgtggctcttgcgtttataacatgatggggaaacgggaaaagaaactgggcgagtttggaaaggccaagggcagccgcgctatttggtacatgtggcttggggccagatacctggagttcgaggctctcggatttctgaatgaggatcattggttctcccgggaaaactcttatagcggcgtggagggggaaggactgcacaaactcggctacatcctgagagacatctccaagattcccgggggcgccatgtatgcggatgacacggccggatgggacacccggatcacagaggatgaccttcacaatgaagagaaaattacccagcagatggatcctgagcatcgccagctggctaacgccatctttaagctcacataccaaaataaagtcgtgaaggtccagagacccaccccgacaggcaccgtgatggacattatctctcggaaggatcagcgcgggagcggacaggttggcacgtatgggctgaacacattcaccaatatggaagctcaacttatcagacagatggagggagaaggcgtgctgtccaaagccgacctcgagaaccctcatctgcccgaaaagaaaattacccagtggctggagacaaagggggtcgagcggctcaaacgcatggcgatcagcggcgatgactgcgtggtgaagcccattgatgacagatttgccaacgctctgcttgccctgaatgatatgggaaaggttcggaaagacatccctcagtggcaaccgtctaagggctggcatgattggcaacaggtgcccttctgttcccaccacttccatgaactcattatgaaagacgggcgcaagctggtcgtgccttgcagaccccaggacgagcttatcggacgggctcgcattagccaaggcgccgggtggtctctgagagaaaccgcttgtctcggaaaagcctacgcgcagatgtggtccctgatgtattttcaccggcgcgatctgagactcgccagcaacgctatctgctctgccgttcctgtgcattgggtccccacatcccggacgacctggagcatccacgcccatcaccagtggatgacaaccgaggacatgctgacagtgtggaatagagtctggattgaagataacccttggatggaggacaagacccccgtgacgacctgggaggatgttccgtaccttggcaagcgcgaagaccaatggtgtgggtccctgatcggcctcacaagccgggctacctgggcccagaatattcctacagcgatccaacaggtgagatctctgattggaaacgaggagttccttgattacatgcccagcatgaaacgctttcggaaggaggaggaatccgagggcgctatctggtga

SEQ ID NO: 20623 - RNA, 9873 nt, synthetic construct
  misc_feature 1..9873: note = derived and/or modified CDS sequence (opt5) from DENV-3__KJ189274__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagcccggggggctagacgcatggccattcttggagacaccgcgtgggatttcggctccgtggggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggccggagaacccttacacctcagcccatggagctgaaatactcttggaagacctgggggaaagccaagattgtgacagctgaaacccagaactccagcttcatcattgatggacctaatacacccgagtgcccgtctgcgtcccgcgcctggaacgtctgggaagtggaggactatggctttggcgtgttcaccacgaatatctggctccggctgagagaagtctacacacaactgtgtgaccaccgccttatgagcgctgccgttaaggatgagcgggccgtgcatgctgacatggggtactggatcgagtcccagaaaaacggatcttggaagctcgaaaaagccagcctgattgaggtgaagacctgcacctggcctaaatcccacacactgtggtctaatggcgtcctcgaaagcgatatgatcattcccaagtccctggcggggcctatcagccagcataaccacagacccggatatcacacccagacggctggcccttggcatcttgggaagctggagctcgactttaattactgcgagggaacaaccgtggttattacagaaaactgtggcacccgcggcccctctctgcggacaaccacggtgtccgggaaactgatccacgagtggtgctgtagaagctgcacccttccgcctctccggtatatgggagaagatggctgttggtacgggatggagatccgccccatttctgaaaaggaggagaatatggtcaaatccctggtgagcgccggatctggcaaggttgacaacttcacaatgggggtgctgtgcctcgccatcctgtttgaagaggtcatgagaggaaaattcggcaagaagcatatgattgctggcgtgttctttaccttcgttcttctgctcagcgggcaaatcacatggcgggatatggcccacaccctgattatgatcggatccaatgcgagcgacagaatgggcatgggggtgacgtatctggctcttattgccacatttaaaatccagcccttcctggccctcggatttttcctgcgcaagctcacctctcgggaaaacctgcttctgggcgtcgggctcgctatggccacaaccctgcagctgcctgaggatatcgaacaaatggctaatggaattgcccttggcctgatggcgctcaaactgatcacccagtttgagatttaccagctctggacagccctgatctcccttacgtgtagcaacaccattttcacactgaccgtggcttggagaacagccaccctcatcctggctggcgtgtccctgcttccggtctgccagtctagctccatgcgcaagacggactggctgcccatggccgttgccgctatgggggtgcctcccctccctctgtttatcttctctctcaaagatacactgaagagacggagctggccccttaatgagggagtgatggcggtcggcctggtgtccattctggcctctagcctcctgcgcaacgacgttcctatggctgggccccttgtggccggaggcctgctcatcgcctgttatgtcattaccgggacctccgctgatctgacagtggaaaaggccgcggacatcacctgggaggaagaggctgaacaaacaggagttagccataacctcatgattacggtggacgatgacggcaccatgagaatcaaagatgacgagacagagaatatcctgaccgtccttctgaagacagccctgctcattgtgtctggcatctttccgtactccattcctgccaccctgcttgtctggcacacgtggcagaaacagacccagcggagcggggtgctgtgggatgttccctctcctcccgaaacacaaaaggctgagctcgaagagggagtgtaccgcatcaaacagcagggcattttcgggaagacccaggtcggagtgggcgttcaaaaagagggggtgtttcacacaatgtggcatgtcaccagaggagccgtgctgacatataacggcaagcggctcgaaccgaattgggcgtccgtgaagaaagacctgatcagctacggcgggggatggcgcctttctacgcagtggcagaagggcgaggaagttcaagtcattgctgtggagcctgggaaaaaccccaagaatttccagaccatgcctggaacattccagaccaccacaggcgaaatcggggccatcgccctggattttaaacccggaacgtccggcagccccattatcaacagagagggcaaggtggtcgggctgtatggaaatggcgtggttaccaagaacgggggatacgtgtccggcattgctcagacaaatgccgagcctgacgggccgacccccgaactcgaggaagagatgttcaaaaagcggaacctgacaatcatggatcttcaccctggcagcggaaaaacccgcaagtatctgcccgctattgtcagagaagccatcaaacggagactccgcacgctgatcctcgcgcctacacgggtggttgccgctgagatggaggaagccctgaagggccttcccattagataccaaaccaccgctacaaagtctgagcataccgggcgcgaaatcgtggacctgatgtgccacgccacatttaccatgcggctgctcagccctgtcagagtgccgaattataacctgattatcatggatgaggcccatttcacggaccccgcttccattgcggcccgcggatacatctctacacgggttggcatgggggaagctgccgccatctttatgaccgctacacctcccggaaccgccgatgcgttccctcagagcaatgctcccattcaggacgaggagagagacatcccggaacgctcctggaactctggcaatgagtggattacggattttgccgggaaaaccgtgtggttcgtccctagcatcaaggccggcaacgacattgctaactgtcttcggaaaaatggaaagaaagtgatccagctgtccagaaagacatttgataccgaataccaaaagacaaaactcaacgactgggatttcgtggtcaccacagacatttctgagatgggcgccaattttaaggcggatcgggttatcgacccccgcagatgcctgaaacccgtgatcctgaccgatgggcctgagcgggtgattctcgccggacccatgcctgtcacggctgccagcgctgcccagcgcagaggccgggtggggagaaacccgcagaaggaaaatgaccagtatatcttcacaggacaaccccttaacaatgatgaggaccacgctcactggaccgaagccaaaatgctgctggacaacattaatacccctgagggcatcattcccgcgctcttcgaacctgagcgcgagaagtccgccgctatcgatggggaataccggctgaagggcgagagcagaaaaacatttgttgaacttatgcgccggggagacctgcccgtgtggctcgcccataaggtcgcttctgagggcatcaaatataccgatagaaagtggtgcttcgacgggcagcgcaacaatcagattctggaagagaacatggatgtggagatctggacaaaagaaggagagaagaaaaagctgcggccgagatggctcgacgcccgcacgtactccgatcctcttgccctgaaggaatttaaagacttcgctgcgggcagaaagagcattgccctggatctcgttaccgagatcgggcgggtgccctctcacctggctcatcgcacaagaaatgcccttgacaacctggtcatgctccacacctccgaacacggaggccgggcctatcgccatgctgtggaggagctgcctgaaacaatggagaccctgctccttctgggcctgatgattctcctgacggggggagccatgctttttctgatcagcggcaaagggatcggaaagacctccattggcctcatctgtgtcattgcgtctagcgggatgctgtggatggccgaaatccccctgcagtggattgcttccgccatcgtgctcgagttctttatgatggttcttctgattcctgagcccgaaaaacaaagaacaccgcaggataatcagctggcttacgtggtgatcggaatcctcaccctggccgcgattatcgccgctaacgagatgggccttctggaaacaaccaagcgggacctcggcatgagcaaggagcctggggtcgtttctcccacgtcctatctggatgtggacctgcaccccgccagcgcttggacactctacgccgtggctaccacagtcattacccctatgcttagacataccatcgaaaattctacagccaacgtgagcctggcggccattgctaaccaagccgttgtgctgatgggactcgacaaaggctggccgatctccaagatggatctgggggtcccccttctggctctcggatgctactctcaggtgaatcctctgacgctgaccgccgccgtcctccttctgatcacacactatgcgattatcggccccgggctgcaggctaaagccacccgcgaggctcagaagcggacagccgccggaattatgaaaaaccctaccgtggacggcatcatgacgattgatctcgaccccgttatctacgatagcaagttcgagaagcaactgggccaggtgatgcttctggtcctctgtgctgtgcagctgctgctcatgagaacatcctgggccctttgcgaagcgctgaccctggccaccgggcctatcacaaccctctgggagggatctccgggcaaattttggaatacaacgattgctgttagcatggccaacatcttccgcgggtcctatctggctggagccggccttgcgtttagcattatgaagtctgtggggaccggaaaacggggcacaggctcccagggggaaaccctgggagagaagtggaaaaagaagctcaatcaactgagcagaaaagaattcgacctgtacaagaaatccggcatcacagaggtcgatcggaccgaggccaaggaagggctcaaacgcggagagattacgcatcacgctgtgtctagaggcagcgccaagcttcagtggtttgtggaacggaacatggttatccccgaggggcgcgtcattgacctgggatgtggcagaggcgggtggtcctattactgcgctggactgaaaaaggtgaccgaagtgcggggctatacaaaggggggacctggccacgaggagcccgtccctatgtctacctacgggtggaatatcgttaaactcatgagcggaaaggatgtgttctacctgcccccggaaaaatgtgacacacttctgtgcgatatcggcgagtccagcccttctcccaccgtggaagagtcccgcacaattagagtcctcaagatggtggagccctggctgaaaaacaatcagttctgtatcaaggttctgaacccttatatgcccaccgtgattgaacatctcgagcggcttcagcgcaagcacggcgggatgctggtcagaaatcctctgagccggaactctacgcatgaaatgtactggatctccaatggaacaggcaacattgtggccagcgttaatatggtgtctagactcctgcttaaccgctttaccatgacccaccggagaccgacaatcgagaaagacgtcgatctgggggctggaacgcgccacgtgaacgccgaacccgagacccctaatatggacgtgatcggcgagcggattaagagaatccgcgaagagcataacagcacatggcactatgacgatgaaaatccctacaaaacctgggcgtatcatgggtcctacgaggtcaaggccacaggatctgctagctccatgattaacggcgttgtgaaactcctgaccaagccttgggacgtggtccccatggtgacacaaatggccatgaccgatacgaccccgttcggccagcagcgggtttttaaggaaaaagtggacacaagaacccctcgcagcatgcccgggacacggagagtcatgggaatcaccgctgagtggctgtggcgcacgctcggccggaataagaaacctagactgtgcacacgcgaggaattcaccaagaaagtgagaacaaacgccgccatgggggcggtttttaccgaggaaaatcaatgggattccgctaaggccgccgtggaggacgaagatttctggaagcttgtcgaccgggagcgcgagctgcacaaactcggaaagtgtggctcttgcgtgtataacatgatggggaaaagagaaaagaaactgggcgagtttggaaaggctaaaggcagccgggccatttggtacatgtggcttggggctagatacctggaattcgaggccctcggatttctgaatgaggatcattggttctcccgggaaaactcttatagcggcgttgagggggaaggactgcacaagctcggctacatcctgcgcgacatctccaagattcccgggggcgcgatgtatgccgatgacacggctggatgggacaccagaatcacagaggatgaccttcacaatgaagagaaaattacccagcagatggatcctgagcatcggcagctggccaacgctatctttaagctcacataccaaaataaagtggtcaaggtgcagcgccccaccccgacaggcaccgtcatggacattatctctagaaaagatcagcgggggagcggacaggtgggcacgtatgggctgaacacattcaccaatatggaagcccaacttatccgccagatggagggagaaggcgttctgtccaaggcggacctcgagaaccctcacctgcccgaaaagaaaattacccagtggctggagacaaagggggtggagagactcaaacggatggccatcagcggcgatgactgcgtcgtgaagcccattgatgaccgctttgctaacgccctgcttgctctgaatgatatgggaaaagtgagaaaggacatccctcagtggcaaccgtctaagggctggcatgattggcagcaggttcccttctgttcccaccacttccatgaactcattatgaaagacgggcggaagctggtggtcccttgccgcccccaggacgagcttatcggaagagcccggattagccaaggcgctgggtggtctctgcgcgaaaccgcctgtctcggaaaagcgtacgcccagatgtggtccctgatgtattttcacagacgggatctgagactcgctagcaacgccatctgctctgccgtgcctgttcattgggtgcccacatcccgcacgacctggagcatccacgctcatcaccagtggatgacaaccgaggacatgctgacagtctggaatcgggtgtggattgaagataacccttggatggaggacaagacccccgtcacgacctgggaggatgtgccgtaccttggcaaaagagaagaccaatggtgtgggtccctgatcggcctcacaagccgcgccacctgggcgcagaatattcctacagctatccagcaggttcggtctctgattggaaacgaggaattccttgattacatgcccagcatgaagagatttcgcaaggaggaggaatccgagggcgccatctggtga

SEQ ID NO: 20624 - RNA, 9873 nt, synthetic construct
  misc_feature 1..9873: note = derived and/or modified CDS sequence (opt5) from DENV-3__KJ189275__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagcccggggggctagacgcatggccattcttggagacaccgcgtgggatttcggctccgtggggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggccggagaacccttacacctcagcccatggagctgaaatactcttggaagacctgggggaaagccaagattgtgacagctgaaacccagaactccagcttcatcattgatggacctaatacacccgagtgcccgtctgcgtcccgcgcctggaacgtctgggaagtggaggactatggctttggcgtgttcaccacgaatatctggctccggctgagagaagtctacacacaactgtgtgaccaccgccttatgagcgctgccgttaaggatgagcgggccgtgcatgctgacatggggtactggatcgagtcccagaaaaacggatcttggaagctcgaaaaagccagcctgattgaggtgaagacctgcacctggcctaaatcccacacactgtggtctaatggcgtcctcgaaagcgatatgatcattcccaagtccctggcggggcctatcagccagcataaccacagacccggatatcacacccagacggctggcccttggcatcttgggaagctggagctcgactttaattactgcgagggaacaaccgtggttattacagaaaactgtggcacccgcggcccctctctgcggacaaccacggtgtccgggaaactgatccacgagtggtgctgtagaagctgcacccttccgcctctccggtatatgggagaagatggctgttggtacgggatggagatccgccccatttctgaaaaggaggagaatatggtcaaatccctggtgagcgccggatctggcaaggttgacaacttcacaatgggggtgctgtgcctcgccatcctgtttgaagaggtcatgagaggaaaattcggcaagaagcatatgattgctggcgtgttctttaccttcgttcttctgctcagcgggcaaatcacatggcgggatatggcccacaccctgattatgatcggatccaatgcgagcgacagaatgggcatgggggtgacgtatctggctcttattgccacatttaaaatccagcccttcctggccctcggatttttcctgcgcaagctcacctctcgggaaaacctgcttctgggcgtcgggctcgctatggccacaaccctgcagctgcctgaggatatcgaacaaatggctaatggaattgcccttggcctgatggcgctcaaactgatcacccagtttgagacataccagctctggacggccctgatttcccttacctgtagcaacacaatcttcaccctgacagtggcttggagaaccgccacgctcattctggctggcgtgtccctgcttccggtctgccagtctagctccatgcgcaagacagactggctgcccatggccgttgccgctatgggggtgcctcccctccctctgtttatcttctctctcaaagataccctgaagagacggagctggccccttaatgagggagtgatggcggtcggcctggtgtccatcctggcctctagcctcctgcgcaacgacgttcctatggctgggccccttgtggccggaggcctgctcattgcctgttatgtcatcaccgggacatccgctgatctgaccgtggaaaaggccgcggacattacatgggaggaagaggctgaacaaacgggagttagccataacctcatgatcaccgtggacgatgacggcacaatgagaattaaagatgacgagaccgagaatatcctgacagtccttctgaagaccgccctgctcatcgtgtctggcatttttccgtactccatccctgccacgctgcttgtctggcacacctggcagaaacagacacagcggagcggggtgctgtgggatgttccctctcctcccgaaacccaaaaggctgagctcgaagagggagtgtaccgcattaaacagcagggcatcttcgggaagacacaggtcggagtgggcgttcaaaaagagggggtgtttcacaccatgtggcatgtcacaagaggagccgtgctgacgtataacggcaagcggctcgaaccgaattgggcgtccgtgaagaaagacctgattagctacggcgggggatggcgcctttctacccagtggcagaagggcgaggaagttcaagtcatcgctgtggagcctgggaaaaaccccaagaatttccagacaatgcctggaaccttccagaccacaacgggcgaaattggggccatcgccctggattttaaacccggaacctccggcagccccatcattaacagagagggcaaggtggtcgggctgtatggaaatggcgtggttacaaagaacgggggatacgtgtccggcatcgctcagaccaatgccgagcctgacgggccgacacccgaactcgaggaagagatgttcaaaaagcggaacctgaccattatggatcttcaccctggcagcggaaaaacgcgcaagtatctgcccgctatcgtcagagaagccattaaacggagactccgcacactgatcctcgcgcctacccgggtggttgccgctgagatggaggaagccctgaagggccttcccatcagataccaaaccacagctaccaagtctgagcatacagggcgcgaaattgtggacctgatgtgccacgccacctttacgatgcggctgctcagccctgtcagagtgccgaattataacctgatcattatggatgaggcccatttcacagaccccgcttccatcgcggcccgcggatacatttctacccgggttggcatgggggaagctgccgccatctttatgacagctacccctcccggaacggccgatgcgttccctcagagcaatgctcccatccaggacgaggagagagacattccggaacgctcctggaactctggcaatgagtggatcaccgattttgccgggaaaacagtgtggttcgtccctagcattaaggccggcaacgacatcgctaactgtcttcggaaaaatggaaagaaagtgattcagctgtccagaaagacctttgatacagaataccaaaagaccaaactcaacgactgggatttcgtggtcacaaccgacatctctgagatgggcgccaattttaaggcggatcgggttattgacccccgcagatgcctgaaacccgtgatcctgacggatgggcctgagcgggtgatcctcgccggacccatgcctgtcacagctgccagcgctgcccagcgcagaggccgggtggggagaaacccgcagaaggaaaatgaccagtatattttcaccggacaaccccttaacaatgatgaggaccacgctcactggaccgaagccaaaatgctgctggacaacatcaatacacctgagggcattatccccgcgctcttcgaacctgagcgcgagaagtccgccgctattgatggggaataccggctgaagggcgagagcagaaaaacctttgttgaacttatgcgccggggagacctgcccgtgtggctcgcccataaggtcgcttctgagggcatcaaatatacagatagaaagtggtgcttcgacgggcagcgcaacaatcagatcctggaagagaacatggatgtggagatttggacgaaagaaggagagaagaaaaagctgcggccgagatggctcgacgcccgcacctactccgatcctcttgccctgaaggaatttaaagacttcgctgcgggcagaaagagcatcgccctggatctcgttacagagattgggcgggtgccctctcacctggctcatcgcaccagaaatgcccttgacaacctggtcatgctccacacatccgaacacggaggccgggcctatcgccatgctgtggaggagctgcctgaaaccatggagacgctgctccttctgggcctgatgatcctcctgaccgggggagccatgctttttctgattagcggcaaagggatcggaaagacatccatcggcctcatttgtgtcatcgcgtctagcgggatgctgtggatggccgaaattcccctgcagtggatcgcttccgccattgtgctcgagttctttatgatggttcttctgatccctgagcccgaaaaacaaagaaccccgcaggataatcagctggcttacgtggtgattggaatcctcacactggccgcgatcattgccgctaacgagatgggccttctggaaaccacgaagcgggacctcggcatgagcaaggagcctggggtcgtttctcccacatcctatctggatgtggacctgcaccccgccagcgcttggaccctctacgccgtggctacaaccgtcatcacccctatgcttagacatacaattgaaaattctacggccaacgtgagcctggcggccatcgctaaccaagccgttgtgctgatgggactcgacaaaggctggccgatttccaagatggatctgggggtcccccttctggctctcggatgctactctcaggtgaatcctctgaccctgacagccgccgtcctccttctgatcacccactatgcgatcattggccccgggctgcaggctaaagccacacgcgaggctcagaagcggaccgccgccggaatcatgaaaaaccctacggtggacggcattatgacaatcgatctcgaccccgttatttacgatagcaagttcgagaagcaactgggccaggtgatgcttctggtcctctgtgctgtgcagctgctgctcatgagaacctcctgggccctttgcgaagcgctgaccctggccacagggcctatcaccacactctgggagggatctccgggcaaattttggaatacgaccatcgctgttagcatggccaacattttccgcgggtcctatctggctggagccggccttgcgtttagcatcatgaagtctgtggggacaggaaaacggggcaccggctcccagggggaaacactgggagagaagtggaaaaagaagctcaatcaactgagcagaaaagaattcgacctgtacaagaaatccggcattaccgaggtcgatcggacggaggccaaggaagggctcaaacgcggagagatcacccatcacgctgtgtctagaggcagcgccaagcttcagtggtttgtggaacggaacatggttattcccgaggggcgcgtcatcgacctgggatgtggcagaggcgggtggtcctattactgcgctggactgaaaaaggtgacagaagtgcggggctataccaaggggggacctggccacgaggagcccgtccctatgtctacatacgggtggaatattgttaaactcatgagcggaaaggatgtgttctacctgcccccggaaaaatgtgacacccttctgtgcgatatcggcgagtccagcccttctcccacagtggaagagtcccgcaccatcagagtcctcaagatggtggagccctggctgaaaaacaatcagttctgtattaaggttctgaacccttatatgcccacggtgatcgaacatctcgagcggcttcagcgcaagcacggcgggatgctggtcagaaatcctctgagccggaactctacacatgaaatgtactggatttccaatggaaccggcaacatcgtggccagcgttaatatggtgtctagactcctgcttaaccgctttaccatgacacaccggagaccgacgattgagaaagacgtcgatctgggggctggaacccgccacgtgaacgccgaacccgagacacctaatatggacgtgatcggcgagcggatcaagagaattcgcgaagagcataacagcacctggcactatgacgatgaaaatccctacaaaacatgggcgtatcatgggtcctacgaggtcaaggccaccggatctgctagctccatgatcaacggcgttgtgaaactcctgacaaagccttgggacgtggtccccatggtgacccaaatggccatgacggataccacaccgttcggccagcagcgggtttttaaggaaaaagtggacaccagaacacctcgcagcatgcccgggacccggagagtcatgggaattacggctgagtggctgtggcgcacactcggccggaataagaaacctagactgtgcacccgcgaggaattcacaaagaaagtgagaaccaacgccgccatgggggcggtttttacggaggaaaatcaatgggattccgctaaggccgccgtggaggacgaagatttctggaagcttgtcgaccgggagcgcgagctgcacaaactcggaaagtgtggctcttgcgtgtataacatgatggggaaaagagaaaagaaactgggcgagtttggaaaggctaaaggcagccgggccatctggtacatgtggcttggggctagatacctggaattcgaggccctcggatttctgaatgaggatcattggttctcccgggaaaactcttatagcggcgttgagggggaaggactgcacaagctcggctacattctgcgcgacatctccaagatccccgggggcgcgatgtatgccgatgacaccgctggatgggacacaagaattaccgaggatgaccttcacaatgaagagaaaatcacacagcagatggatcctgagcatcggcagctggccaacgctatttttaagctcacctaccaaaataaagtggtcaaggtgcagcgccccacaccgaccggcacggtcatggacatcatttctagaaaagatcagcgggggagcggacaggtgggcacatatgggctgaacaccttcaccaatatggaagcccaacttatccgccagatggagggagaaggcgttctgtccaaggcggacctcgagaaccctcacctgcccgaaaagaaaatcacacagtggctggagaccaagggggtggagagactcaaacggatggccattagcggcgatgactgcgtcgtgaagcccatcgatgaccgctttgctaacgccctgcttgctctgaatgatatgggaaaagtgagaaaggacattcctcagtggcaaccgtctaagggctggcatgattggcagcaggttcccttctgttcccaccacttccatgaactcatcatgaaagacgggcggaagctggtggtcccttgccgcccccaggacgagcttattggaagagcccggatcagccaaggcgctgggtggtctctgcgcgaaacagcctgtctcggaaaagcgtacgcccagatgtggtccctgatgtattttcacagacgggatctgagactcgctagcaacgccatttgctctgccgtgcctgttcattgggtgcccacgtcccgcaccacatggagcatccacgctcatcaccagtggatgaccacagaggacatgctgaccgtctggaatcgggtgtggatcgaagataacccttggatggaggacaagacgcccgtcaccacatgggaggatgtgccgtaccttggcaaaagagaagaccaatggtgtgggtccctgattggcctcaccagccgcgccacatgggcgcagaatatccctaccgctattcagcaggttcggtctctgatcggaaacgaggaattccttgattacatgcccagcatgaagagatttcgcaaggaggaggaatccgagggcgccatttggtga

SEQ ID NO: 20625 - RNA, 9873 nt, synthetic construct
  misc_feature 1..9873: note = derived and/or modified CDS sequence (opt5) from DENV-3__KJ189276__SS-prME
  source 1..9873: mol_type = other RNA
accagcctgtgcctcatgatgatcctgcccgcggctcttgccttccacctgacgtcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctccagtgctcccctcgcaccggactggacttcaatgagatgatccttctgacaatgaaaaacaaggcctggatggtccatagacaatggtttttcgatctccccctgccgtggaccagcggcgccacatctgagacccctacgtggaatcggaaagaacttctggtgacatttaagaacgctcacgcgaaaaagcaggaggtcgtggttctcgggtcccaggaaggagccatgcacaccgctctgacaggcgccaccgagattcagaatagcgggggcacctctatcttcgccggacatctgaagtgtcgcctcaaaatggacaagctggaacttaaaggcatgtcctacgctatgtgcacaaacacgtttgtgctgaagaaagaggtcagcgagacccaacacgggacaattctcatcaaggtggaatacaagggagaggatgccccctgtaaaatccctttctccaccgaagacggccatgggaaggcgcacaacggaagactgattacagctaatcccgttgtgaccaaaaaggaggagcccgtcaacatcgaagccgagcctccgttcggcgaatctaatattgtgatcgggattggcgataacgccctgaaaatcaattggtataagaagggaagctccatcggcaaaatgtttgaggctacggccagaggggctagacgcatggccattcttggagacacagcgtgggatttcggcagcgtcgggggagttctcaactctctgggcaagatggtccatcagatctttgggtccgcctacaccgctctgttcagcggcgtgtcttgggtgatgaaaattggaatcggcgtcctcctgacctggattgggcttaatagcaagaacacatccatgtcttttagctgcatcgccattggaatcatcaccctgtatctcggcgctgtggttcaggccgacatggggtgtgtgattaattggaaaggaaaggaactgaagtgcggctccgggatcttcgtcacaaacgaggtgcacacgtggaccgagcagtacaaatttcaagcggatagccccaagcggctggccacagctattgccggcgcttgggaaaatggagtttgtggcatcagatctaccacacgcatggagaaccttctctggaaacagattgccaatgaactgaactatatcctgtgggagaataacatcaagctcaccgtggtcgtgggggacattatcggagttctggaacagggcaaacggacgcttacccctcagcccatggagctgaagtactcctggaaaacatgggggaaggccaagattgtgaccgctgagacacaaaacagctctttcatcattgatggacctaatacccccgaatgcccgtccgcgagcagagcctggaacgtctgggaggtggaagactatggctttggcgtgttcacaaccaatatctggctccgcctgcgggaggtctacacgcagctgtgtgaccacagacttatgtccgctgccgttaaagatgaacgcgccgtgcatgctgacatggggtactggatcgagtctcagaagaacggaagctggaaactcgagaaggcctccctgattgaagtgaaaacatgcacctggcctaagtctcacaccctgtggagcaatggcgtcctcgagtccgatatgatcattcccaagagcctggcggggcctatctctcagcataaccaccggcccggatatcacacacaaaccgctggcccttggcatcttgggaaactggaactcgactttaattactgcgagggaacgacagtggttattaccgagaactgtggcacaagaggcccctccctgcgcaccacaaccgtgagcgggaagctgatccacgaatggtgctgtcggtcttgcacgcttccgcctctcagatatatgggagaggatggctgttggtacgggatggaaatccggcccatttccgagaaagaagagaatatggtcaagagcctggtgtctgccggaagcggcaaagttgacaacttcaccatgggggtgctgtgcctcgccatcctgtttgaggaagtcatgcgcggaaagttcggcaagaaacatatgattgctggcgtgttctttacattcgttcttctgctctccgggcagatcacctggagagatatggcccacacactgattatgatcggaagcaatgcgtctgaccggatgggcatgggggtgacctatctggctcttattgccacgtttaagatccagcccttcctggccctcggatttttcctgagaaaactcacatcccgcgagaacctgcttctgggcgtcgggctcgctatggccaccacactgcaactgcctgaagatatcgagcagatggctaatggaattgcccttggcctgatggcgctcaagctgatcacccagtttgaaacctaccagctctggacagccctgattagccttacgtgttccaacaccatcttcacactgaccgtggcttggcggacagccaccctcattctggctggcgtgtctctgcttccggtctgccaaagctcctctatgagaaaaacggactggctgcccatggccgttgccgctatgggggtgcctcccctccctctgtttatcttcagcctcaaggatacactgaagcgcagatcctggccccttaatgagggagtgatggcggtcggcctggtgtctatcctggccagctccctcctgcggaacgacgttcctatggctgggccccttgtggccggaggcctgctcattgcctgttatgtcatcaccgggaccagcgctgatctgacagtggagaaagccgcggacattacctgggaagaggaagctgagcagacaggagtttctcataacctcatgatcacggtggacgatgacggcaccatgcgcattaaggatgacgaaacagagaatatcctgaccgtccttctgaaaacagccctgctcatcgtgtccggcatttttccgtacagcatccctgccaccctgcttgtctggcacacgtggcagaagcagacccaaagatctggggtgctgtgggatgttccctcccctcccgagacacagaaagctgaactcgaggaaggagtgtaccggattaagcagcagggcatcttcgggaaaacccaagtcggagtgggcgttcagaaggagggggtgtttcacacaatgtggcatgtcacccgcggagccgtgctgacatataacggcaagagactcgagccgaattgggcgagcgtgaaaaaggacctgatttcttacggcgggggatggcggctttccacgcagtggcaaaaaggcgaagaggttcaggtcatcgctgtggaacctgggaagaaccccaaaaatttccagaccatgcctggaacattccagaccaccacaggcgagattggggccatcgccctggattttaagcccggaacgagcggctcccccatcattaaccgcgaaggcaaggtggtcgggctgtatggaaatggcgtggttaccaaaaacgggggatacgtgagcggcatcgctcaaacaaatgccgagcctgacgggccgacccccgagctcgaagaggaaatgttcaagaaaagaaacctgacaattatggatcttcaccctggctctggaaagacccggaaatatctgcccgctatcgtccgcgaggccattaagagacggctcagaacgctgatcctcgcgcctacacgcgtggttgccgctgaaatggaggaggccctgaagggccttcccatccggtaccagaccaccgctacaaaaagcgaacataccgggagagagattgtggacctgatgtgccacgccacatttaccatgcgcctgctctcccctgtccgggtgccgaattataacctgatcattatggatgaagcccatttcacggaccccgcttctatcgcggccagaggatacattagcacacgcgttggcatgggggaggctgccgccatctttatgaccgctacacctcccggaaccgccgatgcgttccctcagtccaatgctcccatccaggacgaagaacgggacattccggagagatcttggaacagcggcaatgaatggatcacggattttgccgggaagaccgtgtggttcgtcccttccattaaagccggcaacgacatcgctaactgtcttcgcaagaatggcaaaaaggtgattcaactgtctcggaagacatttgataccgagtaccagaaaacaaagctcaacgactgggatttcgtggtcaccacagacatcagcgaaatgggagccaattttaaagcggatagagttattgacccccggcgctgcctgaagcccgtgatcctgaccgatgggcctgagagagtgatcctcgccggacccatgcctgtcacggctgcctccgctgcccagcggcgcggcagagtggggcggaacccgcagaaagagaatgaccaatatattttcacaggacagccccttaacaatgatgaagaccacgctcactggaccgaggccaagatgctgctggacaacatcaatacccctgaaggcattatccccgccctcttcgagcctgaaagagaaaagagcgccgctattgatggggagtaccgcctgaaaggcgaatctcggaagacatttgttgagcttatgagacgcggagacctgcccgtgtggctcgcccataaagtcgcttccgaaggcatcaagtataccgatcggaaatggtgcttcgacgggcagagaaacaatcagatcctggaggaaaacatggatgtggagatttggacaaaggagggagagaagaagaagctgcgcccgcggtggctcgacgccagaacgtacagcgatcctcttgccctgaaagagtttaaggacttcgctgcgggccgcaaatctatcgccctggatctcgttaccgaaattgggagagtgccctcccacctggctcatcggacacgcaatgcccttgacaacctggtcatgctccacaccagcgagcacggaggcagagcctatcggcatgctgtggaagaactgcctgagacaatggaaaccctgctccttctgggcctgatgatcctcctgacagggggagccatgctttttctgatttccggcaaggggatcggaaaaacctctatcggcctcatttgtgtcatcgcgagctccgggatgctgtggatggccgagattcccctgcaatggatcgctagcgccattgtgctcgagttctttatgatggttcttctgatccctgagcccgagaagcagcgcacaccgcaggataatcaactggcttacgtggtgattggaatcctcaccctggccgcgatcattgccgctaacgaaatgggccttctggagacaaccaagagagacctcggcatgtctaaagaacctggggtcgtttcccccacgagctatctggatgtggacctgcaccccgcctctgcttggacactctacgccgtggctaccacagtcatcacccctatgcttcggcataccattgagaatagcacagccaacgtgtccctggcggccatcgctaaccaggccgttgtgctgatgggactcgacaagggctggccgatttctaaaatggatctgggggtcccccttctggctctcggatgctacagccaggtgaatcctctgacgctgaccgccgccgtcctccttctgatcacacactatgcgatcattggccccgggctgcaggctaaggccaccagagaagctcaaaaacgcacagccgccggaatcatgaagaaccctaccgtggacggcattatgacgatcgatctcgaccccgttatttacgattccaagttcgagaaacagctgggccaggtgatgcttctggtcctctgtgctgtgcagctgctgctcatgcggacatcttgggccctttgcgaggcgctgaccctggccaccgggcctatcacaaccctctgggaaggaagcccgggcaagttttggaatacaacgatcgctgtttccatggccaacattttcagagggagctatctggctggagccggccttgcgttttctatcatgaaatccgtggggaccggaaagcgcggcacaggcagccaaggggagaccctgggagaaaaatggaagaagaaactcaatcagctgtcccggaaggagttcgacctgtacaaaaagtctggcattacagaagtcgatagaaccgaggccaaagaggggctcaagcggggagaaatcacgcatcacgctgtgagccgcggctccgccaaacttcagtggtttgtggagagaaacatggttattcccgaagggcgggtcatcgacctgggatgtggccgcggcgggtggtcttattactgcgctggactgaagaaggtgaccgaggtgagaggctatacaaaagggggacctggccacgaggaacccgtccctatgagcacctacgggtggaatattgttaagctcatgtccggaaaagatgtgttctacctgcccccggagaagtgtgacacacttctgtgcgatatcggcgaaagctctccttcccccaccgtggaggaaagccggacaatccgcgtcctcaaaatggtggagccctggctgaagaacaatcagttctgtattaaggttctgaacccttatatgcccaccgtgatcgagcatctcgaaagacttcaacggaaacacggcgggatgctggtccgcaatcctctgtctagaaactccacgcatgagatgtactggattagcaatggaacaggcaacatcgtggcctctgttaatatggtgagccggctcctgcttaacagatttaccatgacccaccgccggccgacaattgaaaaggacgtcgatctgggggctggaacgagacacgtgaacgccgagcccgaaacccctaatatggacgtgatcggcgagcgcatcaaacggattaaggaggaacataactccacatggcactatgacgatgagaatccctacaaaacctgggcgtatcatgggtcttacgaagtcaaggccacaggaagcgcttccagcatgatcaacggcgttgtgaagctcctgaccaaaccttgggacgtggtccccatggtgacacagatggccatgaccgatacgaccccgttcggccagcaaagagtttttaaggagaaagtggacacacgcacccctcggtccatgcccgggacaagacgcgtcatgggaattaccgctgaatggctgtggcggacgctcggcagaaataagaaacctcgcctgtgcacacgggaggagttcaccaagaaggtgagaacaaacgccgccatgggggcggtttttaccgaagagaatcagtggaactctgctaaagccgccgtggaagatgaggacttctggaaacttgtcgatcgcgaaagagagctgcacaaactcggaaagtgtggcagctgcgtgtataatatgatggggaaacgggagaagaaactgggcgaatttggaaaggctaagggctcccgcgccatctggtacatgtggcttggggctagatacctggagttcgaagccctcggatttctgaacgaggaccattggttctctcgggagaatagctattccggcgttgaaggggagggactgcacaaactcggctacattctgagagatatctctaagatccccgggggcgcgatgtatgccgacgatacggctggatgggacacccggattacagaagacgatcttcacaacgaggagaaaatcacccagcagatggaccctgagcatcgcagactggccaatgctatttttaagctcacataccaaaacaaagtggtcaaggtgcagcggcccaccccgacaggcaccgtcatggatatcattagccgcaaggaccagagagggtccggacaggtgggcacgtatgggctgaatacattcaccaacatggaggcccaacttatccggcagatggaaggagagggcgttctgagcaaagcggatctcgaaaaccctcatctgcccgagaagaaaatcacccagtggctggaaacaaagggggtggagcgcctcaaaagaatggccatttctggcgacgattgcgtcgtgaagcccatcgacgatcggtttgctaatgccctgcttgctctgaacgacatgggaaaggtgcgcaaagatattcctcagtggcaaccgtccaagggctggcatgactggcagcaggttcccttctgtagccaccacttccatgagctcatcatgaaagatgggagaaagctggtggtcccttgccggccccaggacgaacttattggacgcgccagaatctctcaaggcgctgggtggtccctgcgggagaccgcctgtctcggaaaagcgtacgcccagatgtggagcctgatgtattttcaccgcagagacctgcggctcgcttctaatgccatttgctccgccgtgcctgttcattgggtgcccacaagcagaacgacctggtccatccacgctcatcaccagtggatgacaaccgaagatatgctgacagtctggaaccgcgtgtggatcgaggacaatccttggatggaagataagacccccgtcacgacctgggaggacgtgccgtaccttggcaagcgggaggatcaatggtgtgggagcctgattggcctcacatctagagccacctgggcgcagaacatccctacagctattcagcaggttcgcagcctgatcggaaatgaagagttccttgactacatgccctccatgaaacggtttagaaaggaagaggagtctgaaggcgccatttggtga

SEQ ID NO: 20626 - RNA, 9873 nt, synthetic construct
  misc_feature 1..9873: note = derived and/or modified CDS sequence (opt5) from DENV-3__KJ189277__SS-prME
  source 1..9873: mol_type = other RNA
accagcctgtgcctcatgatgatcctgcccgccgctcttgccttccacctgacgtcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctccagtgctcccctcgcaccggactggacttcaatgagatgatccttctgacaatgaaaaacaaggcctggatggtccatagacaatggtttttcgatctccccctgccgtggaccagcggcgccacatctgagacccctacgtggaatcggaaagaacttctggtgacatttaagaacgctcacgcgaaaaagcaggaggtcgtggttctcgggtcccaggaaggagccatgcacaccgctctgacaggcgccaccgagattcagaatagcgggggcacctctatcttcgccggacatctgaagtgtcgcctcaaaatggacaagctggaacttaaaggcatgtcctacgctatgtgcacaaacacgtttgtgctgaagaaagaggtcagcgagacccaacacgggacaattctcatcaaggtggaatacaagggagaggatgccccctgtaaaatccctttctccaccgaagacggccatgggaaggcgcacaacggaagactgattacagctaatcccgttgtgaccaaaaaggaggagcccgtcaacatcgaagccgagcctccgttcggcgaatctaatattgtgatcgggattggcgataacgccctgaaaatcaattggtataagaagggaagctccatcggcaaaatgtttgaggctacggccagaggggctagacgcatggccattcttggagacacagcgtgggatttcggcagcgtcgggggagttctcaactctctgggcaagatggtccatcagatctttgggtccgcctacaccgctctgttcagcggcgtgtcttgggtgatgaaaattggaatcggcgtcctcctgacctggattgggcttaatagcaagaacacatccatgtcttttagctgcatcgccattggaatcatcaccctgtatctcggcgctgtggttcaggccgacatggggtgtgtgattaattggaaaggaaaggaactgaagtgcggctccgggatcttcgtcacaaacgaggtgcacacgtggaccgagcagtacaaatttcaagcggatagccccaagcggctggccacagctattgccggcgcttgggaaaatggagtttgtggcatcagatctaccacacgcatggagaaccttctctggaaacagattgccaatgaactgaactatatcctgtgggagaataacatcaagctcaccgtggtcgtgggggacattatcggagttctggaacagggcaaacggacgcttacccctcagcccatggagctgaagtactcctggaaaacatgggggaaggccaagattgtgaccgctgagacacaaaacagctctttcatcattgatggacctaatacccccgaatgcccgtccgcgagcagagcctggaacgtctgggaggtggaagactatggctttggcgtgttcacaaccaatatctggctccgcctgcgggaggcttacacgcagctgtgtgaccacagacttatgtccgccgccgtcaaagatgaacgcgctgttcatgccgacatggggtactggatcgagtctcagaagaacggaagctggaaactcgagaaggcgtccctgattgaagtgaaaacatgcacctggcctaagtctcacaccctgtggagcaatggcgtgctcgagtccgatatgatcattcccaagagcctggctgggcctatctctcagcataaccaccggcccggatatcacacacaaaccgccggcccttggcatcttgggaaactggaactcgactttaattactgcgagggaacgacagtcgtgattaccgagaactgtggcacaagaggcccctccctgcgcaccacaaccgttagcgggaagctgatccacgaatggtgctgtcggtcttgcacgcttccgcctctcagatatatgggagaggatggctgttggtacgggatggaaatccggcccatttccgagaaagaagagaatatggtcaagagcctggtctctgccggaagcggcaaagtggacaacttcaccatgggggttctgtgcctcgctatcctgtttgaggaagtgatgcgcggaaagttcggcaagaaacatatgattgccggcgtcttctttacattcgtgcttctgctctccgggcagatcacctggagagatatggcgcacacactgattatgatcggaagcaatgcttctgaccggatgggcatgggggttacctatctggcccttattgccacgtttaagatccagcccttcctggctctcggatttttcctgagaaaactcacatcccgcgagaacctgcttctgggcgtggggctcgccatggctaccacactgcaactgcctgaagatatcgagcagatggccaatggaattgcgcttggcctgatggccctcaagctgatcacccagtttgaaacctaccagctctggacagctctgattagccttacgtgttccaacaccatcttcacactgaccgtcgcctggcggacagctaccctcattctggccggcgtgtctctgcttccggtgtgccaaagctcctctatgagaaaaacggactggctgcccatggccgtcgctgcgatgggggttcctcccctccctctgtttatcttcagcctcaaggatacactgaagcgcagatcctggccccttaatgagggagtgatggccgtgggcctggtctctatcctggctagctccctcctgcggaacgacgtgcctatggccgggccccttgttgccggaggcctgctcattgcttgttatgtgatcaccgggaccagcgccgatctgacagtcgagaaagcggctgacattacctgggaagaggaagccgagcagacaggagtgtctcataacctcatgatcacggttgacgatgacggcaccatgcgcattaaggatgacgaaacagagaatatcctgaccgtgcttctgaaaacagccctgctcatcgtctccggcatttttccgtacagcatccctgctaccctgcttgtgtggcacacgtggcagaagcagacccaaagatctggggtcctgtgggatgtgccctcccctcccgagacacagaaagccgaactcgaggaaggagtttaccggattaagcagcagggcatcttcgggaaaacccaagtgggagtcggcgtgcagaaggagggggtttttcacacaatgtggcatgtgacccgcggagcggtcctgacatataacggcaagagactcgagccgaattgggctagcgtgaaaaaggacctgatttcttacggcgggggatggcggctttccacgcagtggcaaaaaggcgaagaggtgcaggttatcgccgtcgaacctgggaagaaccccaaaaatttccagaccatgcctggaacattccagaccaccacaggcgagattggggccatcgctctggattttaagcccggaacgagcggctcccccatcattaaccgcgaaggcaaggtggtggggctgtatggaaatggcgtcgtgaccaaaaacgggggatacgttagcggcatcgcccaaacaaatgctgagcctgacgggccgacccccgagctcgaagaggaaatgttcaagaaaagaaacctgacaattatggatcttcaccctggctctggaaagacccggaaatatctgcccgccatcgtgcgcgaggcgattaagagacggctcagaacgctgatcctcgcccctacacgcgtcgtggctgccgaaatggaggaggctctgaagggccttcccatccggtaccagaccaccgccacaaaaagcgaacataccgggagagagattgttgacctgatgtgccacgccacatttaccatgcgcctgctctcccctgtgcgggtcccgaattataacctgatcattatggatgaagctcatttcacggaccccgcgtctatcgccgctagaggatacattagcacacgcgtgggcatgggggaggccgccgctatctttatgaccgccacacctcccggaaccgcggatgctttccctcagtccaatgcccccatccaggacgaagaacgggacattccggagagatcttggaacagcggcaatgaatggatcacggattttgccgggaagaccgtttggttcgtgccttccattaaagctggcaacgacatcgccaactgtcttcgcaagaatggcaaaaaggtcattcaactgtctcggaagacatttgataccgagtaccagaaaacaaagctcaacgactgggatttcgtggtgaccacagacatcagcgaaatgggagcgaattttaaagccgatagagtcattgacccccggcgctgcctgaagcccgttatcctgaccgatgggcctgagagagtgatcctcgctggacccatgcctgtgacggccgcttccgccgctcagcggcgcggcagagtcgggcggaacccgcagaaagagaatgaccaatatattttcacaggacagccccttaacaatgatgaagaccacgcccactggaccgaggcgaagatgctgctggacaacatcaatacccctgaaggcattatccccgccctcttcgagcctgaaagagaaaagagcgctgccattgatggggagtaccgcctgaaaggcgaatctcggaagacatttgtggagcttatgagacgcggagacctgcccgtttggctcgctcataaagtggcctccgaaggcatcaagtataccgatcggaaatggtgcttcgacgggcagagaaacaatcagatcctggaggaaaacatggatgtcgagatttggacaaaggagggagagaagaagaagctgcgcccgcggtggctcgacgccagaacgtacagcgatcctcttgctctgaaagagtttaaggacttcgcggccggccgcaaatctatcgctctggatctcgtgaccgaaattgggagagttccctcccacctggcccatcggacacgcaatgcccttgacaacctggtgatgctccacaccagcgagcacggaggcagagcttatcggcatgccgtcgaagaactgcctgagacaatggaaaccctgctccttctgggcctgatgatcctcctgacagggggagcgatgctttttctgatttccggcaaggggatcggaaaaacctctatcggcctcatttgtgtgatcgccagctccgggatgctgtggatggctgagattcccctgcaatggatcgccagcgctattgtcctcgagttctttatgatggtgcttctgatccctgagcccgagaagcagcgcacaccgcaggataatcaactggcctacgttgtgattggaatcctcaccctggcggccatcattgctgccaacgaaatgggccttctggagacaaccaagagagacctcggcatgtctaaagaacctggggtggtctcccccacgagctatctggatgttgacctgcaccccgcttctgcctggacactctacgctgtggccaccacagtgatcacccctatgcttcggcataccattgagaatagcacagcgaacgtctccctggccgctatcgccaaccaggctgtggttctgatgggactcgacaagggctggccgatttctaaaatggatctgggggtgccccttctggccctcggatgctacagccaggtcaatcctctgacgctgaccgccgcggtgctccttctgatcacacactatgctatcattggccccgggctgcaggccaaggctaccagagaagcccaaaaacgcacagccgctggaatcatgaagaaccctaccgtcgacggcattatgacgatcgatctcgaccccgtgatttacgattccaagttcgagaaacagctgggccaggttatgcttctggtgctctgtgccgtccagctgctgctcatgcggacatcttgggcgctttgcgaggccctgaccctggctaccgggcctatcacaaccctctgggaaggaagcccgggcaagttttggaatacaacgatcgccgtgtccatggctaacattttcagagggagctatctggccggagcgggccttgccttttctatcatgaaatccgttgggaccggaaagcgcggcacaggcagccaaggggagaccctgggagaaaaatggaagaagaaactcaatcagctgtcccggaaggagttcgacctgtacaaaaagtctggcattacagaagtggatagaaccgaggctaaagaggggctcaagcggggagaaatcacgcatcacgccgtcagccgcggctccgctaaacttcagtggtttgtggagagaaacatggtgattcccgaagggcgggttatcgacctgggatgtggccgcggcgggtggtcttattactgcgccggactgaagaaggtcaccgaggtgagaggctatacaaaagggggacctggccacgaggaacccgtgcctatgagcacctacgggtggaatattgtcaagctcatgtccggaaaagatgttttctacctgcccccggagaagtgtgacacacttctgtgcgatatcggcgaaagctctccttcccccaccgtggaggaaagccggacaatccgcgtgctcaaaatggtcgagccctggctgaagaacaatcagttctgtattaaggtgctgaacccttatatgcccaccgttatcgagcatctcgaaagacttcaacggaaacacggcgggatgctggtgcgcaatcctctgtctagaaactccacgcatgagatgtactggattagcaatggaacaggcaacatcgtcgcttctgtgaatatggttagccggctcctgcttaacagatttaccatgacccaccgccggccgacaattgaaaaggacgtggatctgggggccggaacgagacacgtcaacgcggagcccgaaacccctaatatggacgtgatcggcgagcgcatcaaacggattaaggaggaacataactccacatggcactatgacgatgagaatccctacaaaacctgggcctatcatgggtcttacgaagtgaaggctacaggaagcgcctccagcatgatcaacggcgtcgttaagctcctgaccaaaccttgggacgtggtgcccatggtcacacagatggctatgaccgatacgaccccgttcggccagcaaagagtgtttaaggagaaagttgacacacgcacccctcggtccatgcccgggacaagacgcgtgatgggaattaccgccgaatggctgtggcggacgctcggcagaaataagaaacctcgcctgtgcacacgggaggagttcaccaagaaggtcagaacaaacgccgcgatgggggctgtgtttaccgaagagaatcagtggaactctgccaaagccgctgttgaagatgaggacttctggaaacttgtggatcgcgaaagagagctgcacaaactcggaaagtgtggcagctgcgtctataatatgatggggaaacgggagaagaaactgggcgaatttggaaaggccaagggctcccgcgctatctggtacatgtggcttggggccagatacctggagttcgaagcgctcggatttctgaacgaggaccattggttctctcgggagaatagctattccggcgtggaaggggagggactgcacaaactcggctacattctgagagatatctctaagatccccgggggcgccatgtatgctgacgatacggccggatgggacacccggattacagaagacgatcttcacaacgaggagaaaatcacccagcagatggaccctgagcatcgcagactggctaatgccatttttaagctcacataccaaaacaaagttgtgaaggtccagcggcccaccccgacaggcaccgtgatggatatcattagccgcaaggaccagagagggtccggacaggtcggcacgtatgggctgaatacattcaccaacatggaggcgcaacttatccggcagatggaaggagagggcgtgctgagcaaagccgatctcgaaaaccctcatctgcccgagaagaaaatcacccagtggctggaaacaaagggggttgagcgcctcaaaagaatggctatttctggcgacgattgcgtggtcaagcccatcgacgatcggtttgccaatgctctgcttgccctgaacgacatgggaaaggtgcgcaaagatattcctcagtggcaaccgtccaagggctggcatgactggcaacaggtgcccttctgtagccaccacttccatgagctcatcatgaaagatgggagaaagctggttgtgccttgccggccccaggacgaacttattggacgcgctagaatctctcaaggcgccgggtggtccctgcgggagaccgcgtgtctcggaaaagcctacgctcagatgtggagcctgatgtattttcaccgcagagacctgcggctcgcctctaatgccatttgctccgctgtccctgtgcattgggttcccacaagcagaacgacctggtccatccacgcccatcaccagtggatgacaaccgaagatatgctgacagtgtggaaccgcgtctggatcgaggacaatccttggatggaagataagacccccgtgacgacctgggaggacgtcccgtaccttggcaagcgggaggatcaatggtgtgggagcctgattggcctcacatctagagcgacctgggctcagaacatccctacagccattcaacaggtgcgcagcctgatcggaaatgaagagttccttgactacatgccctccatgaaacggtttagaaaggaagaggagtctgaaggcgccatttggtga

SEQ ID NO: 20627 - RNA, 9873 nt, synthetic construct
  misc_feature 1..9873: note = derived and/or modified CDS sequence (opt5) from DENV-3__KJ189278__SS-prME
  source 1..9873: mol_type = other RNA
acaagcctgtgcctcatgatgatcctgcccgcggctcttgccttccacctgacatcccgggacggcgaacctcggatgattgtggggaagaacgaacgcggaaaatctctcctgtttaagacggcgagcggcaccaatatgtgtacacttatcgctatggatctgggggaaatgtgcgacgataccgtgacatacaaatgtccgcatattaccgaagttgaacccgaagacatcgattgctggtgtaacctcacatccacctgggtgacgtatggaacctgcaatcaggccggcgagcacagacgggacaagcgctctgtggccctggctcctcatgtcgggatgggactggatacaagaacccagacatggatgagcgccgagggcgcttggcggcaagtggaaaaagttgagacctgggccctccgccaccccggcttcacgattctggcgctttttctggcccattacatcgggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccagctggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcagtgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctacgctgcccgaatatggcaccctggggctcgagtgctcccctcgcacaggactggacttcaatgagatgattcttctgaccatgaaaaacaaggcctggatggtccatagacagtggtttttcgatctccccctgccgtggacaagcggcgccaccacggaaacacctacctggaatcggaaagagcttctggtgacatttaagaacgctcacgcgaaaaagcaagaagtcgtggttctcgggtctcaggagggagccatgcacaccgctctgaccggcgccacagaaatccaaaattccgggggcacgagcattttcgccggacatctgaagtgtcgcctcaaaatggacaagctggagcttaaaggcatgtcttacgctatgtgcaccaacacatttgtgctgaagaaagaggtctccgaaacccagcacgggacaatcctcattaaggtggagtacaagggagaagatgccccctgtaaaatccctttcagcaccgaggacggccatgggaaggcgcacaacggaagactgatcacggctaatcccgttgtgaccaagaaggaggaacccgtcaacattgaggccgaacctccgttcggcgagtccaatatcgtgattgggatcggcgataacgccctgaaaattaattggtataagaagggatctagcatcggcaaaatgtttgaagctaccgccagaggggctagacgcatggccatccttggagacaccgcgtgggatttcggctccgtcgggggagttctcaacagcctgggcaagatggtccatcaaatttttgggtctgcctacacagctctgttctccggcgtgagctgggtgatgaaaatcggaattggcgtcctcctgacctggatcgggcttaattctaagaacacaagcatgtccttttcttgcattgccatcggaattatcacgctgtatctcggcgctgtggttcaggccgacatggggtgtgtgatcaattggaaaggaaaggagctgaagtgcggcagcgggattttcgtcaccaacgaggtgcacacatggaccgaacagtacaaatttcaggcggattcccccaagcggctggccacagctatcgccggcgcttgggagaatggagtttgtggcattagaagcaccacgcgcatggaaaaccttctctggaaacaaatcgccaatgagctgaactatattctgtgggaaaataacgtgaagctcaccgtcgtggttggggacatcatcggagtgctggagcagggcaaacggacacttacccctcagcccatggagctgaagtactcttggaaaacatgggggaaggccaagattgtcaccgctgaaacacagaactccagcttcatcattgatggacctaatacccccgagtgcccgtctgcgtccagagcctggaacgtgtgggaagtggaggactatggctttggcgtcttcacgacaaatatctggctccgcctgcgggaagtttacacccaactgtgtgaccacagacttatgagcgctgccgtgaaagatgagcgcgccgtgcatgctgacatggggtactggattgagtcccagaagaacggatcttggaaactcgaaaaggccagcctgatcgaggtcaaaacctgcacatggcctaagtcccacaccctgtggtctaatggcgtgctcgaaagcgatatgatcattcccaagtccctggcggggcctatcagccagcataaccaccggcccggatatcacacgcagacagctggcccttggcatcttgggaaactggagctcgactttaattactgcgagggaaccacagttgtgattaccgaaaactgtggcacaagaggcccctctctgcgcaccacgaccgtctccgggaagctgatccacgagtggtgctgtcggagctgcacacttccgcctctcagatatatgggagaagatggctgttggtacgggatggagattcggcccatctctgaaaaagaggagaatatggtgaagtccctggttagcgccggatctggcaaagtggacaacttcaccatgggggtcctgtgcctcgccatcctgtttgaagaggtgatgcgcggaaagttcggcaagaaacatatgattgctggcgttttctttacattcgtgcttctgctcagcgggcaaatcacctggagagatatggcccacacgctgattatgatcggatccaatgcgagcgaccggatgggcatgggggtcacatatctggctcttattgccacctttaagatccagcccttcctggccctcggatttttcctgagaaaactcacatctcgcgaaaacctgcttctgggcgtggggctcgctatggccaccaccctgcagctgcctgaggatattgaacaaatggctaatggaatcgcccttggcctgatggcgctcaagctgatcacacagtttgagacgtaccagctctggaccgccctgatttcccttacatgtagcaacaccatcttcacactgaccgtggcttggcggacggccacactcattctggctggcgtctccctgcttccggtttgccagtctagctccatgagaaaaaccgactggctgcccatggccgtggccgctatgggggtgcctcccctccctctgtttatcttctctctcaaggataccctgaagcgcagaagctggccccttaatgagggagtcatggcggtgggcctggtttccattctggcctctagcctcctgcggaacgacgtgcctatggctgggccccttgtcgccggaggcctgctcatcgcctgttatgtgatcacagggacctccgctgatctgacagttgaaaaagccgcggacattacgtgggaggaagaggctgaacaaaccggagtgagccataacctcatgatcacagtcgacgatgacggcaccatgcgcattaaggatgacgagacagagaatatcctgaccgtgcttctgaaaacggccctgctcattgtctctggcatctttccgtactccatccctgccaccctgcttgtgtggcacacatggcagaagcagacccagagaagcggggttctgtgggatgtgccctctcctcccgaaacacaaaaagctgagctcgaagagggagtctaccggattaagcagcagggcatcttcgggaaaacccaggtgggagttggcgtgcaaaaggagggggtctttcacacaatgtggcatgtgacgcgcggagccgtgctgacctataacggcaagagactcgaaccgaattgggcgtccgttaaaaaggacctgattagctacggcgggggatggcggctttctacacagtggcagaaaggcgaggaagtccaagtgatcgctgtggagcctgggaagaaccccaaaaatttccagaccatgcctggaaccttccagacaacgaccggcgaaattggggccatcgccctggattttaagcccggaacatccggcagccccattatcaaccgcgagggcaaggtcgtggggctgtatggaaatggcgttgtgaccaaaaacgggggatacgtctccggcatcgctcagacaaatgccgagcctgacgggccgacccccgaactcgaggaagagatgttcaagaaaagaaacctgacgattatggatcttcaccctggcagcggaaagacacggaaatatctgcccgctatcgtgcgcgaagccattaagagacggctcagaaccctgatcctcgcgcctacccgcgttgtggccgctgagatggaggaagccctgaagggccttcccattcggtaccaaacaaccgctacaaaatctgagcataccgggagagaaatcgtcgacctgatgtgccacgccacgtttacaatgcgcctgctcagccctgtgcgggttccgaattataacctgatcattatggatgaggcccatttcaccgaccccgcttccatcgcggccagaggatacatttctacacgcgtgggcatgggggaagctgccgccatctttatgaccgctacgcctcccggaaccgccgatgcgttccctcagagcaatgctcccattcaggacgaggagcgggacatcccggaaagatcctggaactctggcaatgagtggatcacagattttgccgggaagaccgtctggttcgtgcctagcattaaagccggcaacgacatcgctaactgtcttcgcaagaatggcaaaaaggtgattcagctgtcccggaagacatttgataccgaataccagaaaacaaagctcaacgactgggatttcgtcgttaccacggacatctctgagatgggagccaattttaaagcggatagagtgattgacccccggcgctgcctgaagcccgtgatcctgacagatgggcctgagagagtcattctcgccggacccatgcctgtgaccgctgccagcgctgcccagcggcgcggcagagttgggcggaacccgcagaaagaaaatgaccagtatatcttcaccggacaaccccttaacaatgatgaggaccacgctcactggacagaagccaagatgctgctggacaacatcaatacccctgagggcattatccccgccctcttcgaacctgagagagagaagtccgccgctattgatggggaataccgcctgaaaggcgagagccggaagacatttgtggaacttatgagacgcggagacctgcccgtctggctcgcccataaagtggcttctgagggcatcaagtatacggatcggaaatggtgcttcgacgggcagagaaacaatcagattctggaagagaacatggatgttgagatctggaccaaggaaggagagaaaaagaagctgcgcccgcggtggctcgacgccagaacatactccgatcctcttgccctgaaagaatttaaggacttcgctgcgggccgcaaaagcatcgccctggatctcgtgaccgagattgggagagtcccctctcacctggctcatcggacacgcaatgcccttgacaacctggtgatgctccacacctccgaacacggaggcagagcctatcggcatgctgtcgaggagctgcctgaaacgatggagaccctgctccttctgggcctgatgatcctcctgacagggggagccatgctttttctgattagcggcaaggggatcggaaaaacctccattggcctcatctgtgtgatcgcgtctagcgggatgctgtggatggccgaaattcccctgcagtggatcgcttccgccattgttctcgagttctttatgatggtgcttctgatccctgagcccgaaaagcaacgcacaccgcaggataatcagctggcttacgtggtcattggaatcctcaccctggccgcgattatcgccgctaacgagatgggccttctggaaacgacaaagagagacctcggcatgagcaaagagcctggggttgtgtctcccacctcctatctggatgtggacctgcaccccgccagcgcttggacactctacgccgtcgctaccaccgtgatcacacctatgcttcggcatacgattgaaaattctaccgccaacgttagcctggcggccatcgctaaccaagccgtggtcctgatgggactcgacaagggctggccgatttccaaaatggatctgggggtgccccttctggctctcggatgctactctcaggtcaatcctctgacactgaccgccgccgtgctccttctgatcacacactatgcgattatcggccccgggctgcaggctaaggccaccagagaggctcagaaacgcacggccgccggaatcatgaagaaccctacagttgacggcattatgaccatcgatctcgaccccgtgatttacgatagcaagttcgagaaacaactgggccaggtcatgcttctggtgctctgtgctgttcagctgctgctcatgcggacctcctgggccctttgcgaagcgctgacactggccaccgggcctatcacaacgctctgggagggatctccgggcaagttttggaataccacaattgctgtgagcatggccaacatcttcagagggtcctatctggctggagccggccttgcgtttagcatcatgaaatctgtcgggaccggaaagcgcggcacaggctcccagggggaaaccctgggagagaaatggaagaagaaactcaatcaactgagccggaaggagttcgacctgtacaaaaagtccggcattacggaggtggatagaaccgaggccaaagaagggctcaagcggggagagatcacacatcacgctgtgtctcgcggcagcgccaaacttcagtggtttgttgaaagaaacatggtcattcccgaggggcgggtgatcgacctgggatgtggccgcggcgggtggtcctattactgcgctggactgaagaaggtgaccgaagtcagaggctatacaaaagggggacctggccacgaggagcccgttcctatgtctacctacgggtggaatattgtgaagctcatgagcggaaaagatgtgttctacctgcccccggaaaagtgtgacacacttctgtgcgatatcggcgagtccagcccttctcccaccgtcgaagagtcccggacgattcgcgtgctcaaaatggttgagccctggctgaagaacaatcagttctgtatcaaggtgctgaacccttatatgcccacagtcatcgaacatctcgagagacttcagcggaaacacggcgggatgctggtgcgcaatcctctgagcagaaactctacccatgaaatgtactggatttccaatggaaccggcaacatcgttgccagcgtgaatatggtctctcggctcctgcttaacagatttacaatgacgcaccgccggccgaccattgagaaggacgtggatctgggggctggaacaagacacgtgaacgccgaacccgagacccctaatatggacgtcatcggcgagcgcattaaacggatcaaggaagaacacaacagcacatggcactatgacgatgaaaatccctacaaaacctgggcgtatcatgggtcctacgaggttaaggccacaggatctgctagctccatgatcaacggcgtggtgaagctcctgaccaaaccttgggacgtcgtgcccatggttacgcaaatggccatgaccgatacaaccccgttcggccagcagagagtgtttaaggaaaaagtcgacacacgcacccctcggagcatgcccgggacgagacgcgtgatgggaattacagctgagtggctgtggcggaccctcggcagaaataagaaacctcgcctgtgcacacgggaggagttcaccaagaaggttagaacgaacgccgccatgggggcggtgtttaccgaggaaaatcaatgggattccgctaaagccgccgtcgaggacgaagatttctggaaacttgtggaccgcgagagagagctgcacaaactcggaaagtgtggctcttgcgtttataacatgatggggaaacgggaaaagaaactgggcgagtttggaaaggctaagggcagccgcgccatctggtacatgtggcttggggctagatacctggagttcgaggccctcggatttctgaatgaggatcattggttctcccgggaaaactcttatagcggcgtggagggggaaggactgcacaaactcggctacattctgagagacatctccaagattcccgggggcgcgatgtatgccgatgacacagctggatgggacacccggatcacagaggatgaccttcacaatgaagagaaaatcacccagcagatggatcctgagcatcgccagctggccaacgctatttttaagctcacataccaaaataaagtcgtgaaggtccagagacccaccccgacgggcacagtgatggacatcatttctcggaaggatcagcgcgggagcggacaggttggcacctatgggctgaacaccttcacaaatatggaagcccaacttatcagacagatggagggagaaggcgtgctgtccaaagcggacctcgagaaccctcatctgcccgaaaagaaaattacccagtggctggagacaaagggggtcgagcggctcaaacgcatggccatcagcggcgatgactgcgtggtgaagcccatcgatgacagatttgctaacgccctgcttgctctgaatgatatgggaaaggttcggaaagacattcctcagtggcaaccgtctaagggctggcatgattggcaacaggtgcccttctgttcccaccacttccatgaactcatcatgaaagacgggcgcaagctggtcgtgccttgcagaccccaggacgagcttattggacgggcccgcatcagccaaggcgctgggtggtctctgagagaaacggcctgtctcggaaaagcgtacgcccagatgtggtccctgatgtattttcaccggcgcgatctgagactcgctagcaacgccatttgctctgccgttcctgtgcattgggtccccacctcccggacaacctggagcatccacgctcatcaccagtggatgacaaccgaggacatgctgacggtgtggaatagagtctggattgaagataacccttggatggaggacaagacccccgtgacaacctgggaggatgttccgtaccttggcaagcgcgaagaccaatggtgtgggtccctgatcggcctcacaagccgggccacctgggcgcagaatatccctacggctattcaacaggtgagatctctgatcggaaacgaggagttccttgattacatgcccagcatgaaacgctttcggaaggaggaggaatccgagggcgccatttggtga

SEQ ID NO: 20628 - RNA, 9873 nt, synthetic construct
  misc_feature 1..9873: note = derived and/or modified CDS sequence (opt5) from DENV-3__KJ189279__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggtcaccctgcccgaatatggcacgctggggctcgagtgctcccctcgcaccggactggacttcaatgagatgatccttctgacaatgaaaaacaaggcttggatggtgcatagacagtggtttttcgatctccccctgccgtggaccagcggcgccacaaccgaaacgcctacatggaatcggaaagagcttctggtcacctttaagaacgcccacgctaaaaagcaagaagtggttgtgctcgggtctcaggagggagcgatgcacacagccctgaccggcgctaccgaaattcaaaattccgggggcacaagcatcttcgccggacatctgaagtgtcgcctcaaaatggacaagctggagcttaaaggcatgtcttacgccatgtgcacgaacacctttgtcctgaagaaagaggtgtccgaaacacagcacgggaccattctcatcaaggttgagtacaagggagaagatgctccctgtaaaatccctttcagcacagaggacggccatgggaaggcccacaacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcatcaaatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcacacctggacagaacagtacaaatttcaggccgattcccccaagcggctggcgaccgccattgctggcgcctgggagaatggagtgtgtggcatcagaagcacaacccgcatggaaaaccttctctggaaacaaattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccagaactccagcttcatcattgatggacctaatacacccgagtgcccgtctgcttccagagcgtggaacgtgtgggaagtggaggactatggctttggcgtcttcaccacgaatatctggctccgcctgcgggaagtttacacacaactgtgtgaccacagacttatgagcgccgctatcaaagatgagcgcgccgtgcatgccgacatggggtactggattgagtcccagaagaacggatcttggaaactcgaaaaggctagcctgatcgaggtgaaaacctgcacctggcctaagtcccacacactgtggtctaatggcgtcctcgaaagcgatatgattatccccaagtccctggccgggcctattagccagcataaccaccggcccggatatcacacccagacggcgggcccttggcatcttgggaaactggagctcgactttaattactgcgagggaacaaccgtggttatcacagaaaactgtggcaccagaggcccctctctgcgcacaaccacggtgtccgggaagctgatccacgagtggtgctgtcggagctgcacccttccgcctctcagatatatgggagaagatggctgttggtacgggatggagattcggcccatctctgaaaaagaggagaatatggtcaagtccctggtgagcgctggatctggcaaagttgacaacttcacaatgggggtgctgtgcctcgccattctgtttgaagaggtcatgcgcggaaagttcggcaagaaacatatgatcgccggcgtgttctttaccttcgttcttctgctcagcgggcaaattacatggagagatatggctcacaccctgatcatgattggatccaatgccagcgaccggatgggcatgggggtgacgtatctggcgcttatcgctacatttaagatccagcccttcctggccctcggatttttcctgagaaaactcacctctcgcgaaaacctgcttctgggcgtcgggctcgccatggctacaaccctgcagctgcctgaggatattgaacaaatggccaatggaatcgctcttggcctgatggccctcaagctgattacccagtttgagacataccagctctggacggcgctgatctcccttacctgtagcaacacaattttcaccctgacagtggcctggcggaccgctacgctcatcctggccggcgtgtccctgcttccggtctgccagtctagctccatgagaaaaacagactggctgcccatggctgttgccgccatgggggtgcctcccctccctctgtttatcttctctctcaaggataccctgaagcgcagaagctggccccttaatgagggagtgatggctgtcggcctggtgtccattctggcgtctagcctcctgcggaacgacgttcctatggccgggccccttgtggctggaggcctgctcatcgcctgttatgtcattaccgggacatccgccgatctgaccgtggaaaaagctgccgacatcacatgggaggaagaggcggaacaaacgggagttagccataacctcatgattaccgtggacgatgacggcacaatgcgcatcaaggatgacgagaccgagaatatcctgacagtccttctgaaaaccgctctgctcattgtgtctggcatctttccgtactccattcctgccacgctgcttgtctggcacacctggcagaagcagacacagagaagcggggtgctgtgggatgttccctctcctcccgaaacccaaaaagccgagctcgaagagggagtgtaccggatcaagcagcagggcattttcgggaaaacacaggtcggagtgggcgttcaaaaggagggggtgtttcacaccatgtggcatgtcacacgcggagctgtgctgacgtataacggcaagagactcgaaccgaattgggcctccgtgaaaaaggacctgatcagctacggcgggggatggcggctttctacccagtggcagaaaggcgaggaagttcaagtcattgcggtggagcctgggaagaaccccaaaaatttccagacaatgcctggaaccttccagaccacaacgggcgaaatcggggctatcgccctggattttaagcccggaacctccggcagccccattatcaaccgcgagggcaaggtggtcgggctgtatggaaatggcgtggttaccaagaacgggggatacgtgtccggcattgcccagaccaatgctgagcctgacgggccgacacccgaactcgaggaagagatgttcaagaaaagaaacctgaccatcatggatcttcaccctggcagcggaaagacgcggaaatatctgcccgccattgtccgcgaagctatcaagagacggctcagaacactgatcctcgcccctacccgcgtggttgcggccgagatggaggaagctctgaagggccttcccattcggtaccaaaccacagccaccaaatctgagcatacagggagagaaatcgtggacctgatgtgccacgctacctttacgatgcgcctgctcagccctgtccgggtgccgaattataacctgattatcatggatgaggcccatttcacagaccccgcctccattgctgcgagaggatacatctctacccgcgttggcatgggggaagccgctgccatctttatgacagccacccctcccggaacggctgatgccttccctcagagcaatgcgcccattcaggacgaggagcgggacatcccggaaagatcctggaactctggcaatgagtggattaccgattttgctgggaagacagtgtggttcgtccctagcatcaaagccggcaacgacattgccaactgtcttcgcaagaatggcaaaaaggtgatccagctgtcccggaagacctttgatacagaataccagaaaacaaagctcaacgactgggatttcgtggtcacaaccgacatttctgagatgggagctaattttaaagccgatagagttatcgacccccggcgctgcctgaagcccgtgatcctgacggatgggcctgagagagtgattctcgcgggacccatgcctgtcacagccgctagcgccgctcagcggcgcggcagagtggggcggaacccgcagaaagaaaatgaccagtatatcttcaccggacaaccccttaacaatgatgaggaccacgcccactggaccgaagctaagatgctgctggacaacattaatacacctgagggcatcattcccgccctcttcgaacctgagagagagaagtccgcggccatcgatggggaataccgcctgaaaggcgagagccggaagacctttgttgaacttatgagacgcggagacctgcccgtgtggctcgctcataaagtcgcctctgagggcatcaagtatacagatcggaaatggtgcttcgacgggcagagaaacaatcagattctggaagagaacatggatgtggagatctggacgaaggaaggagagaaaaagaagctgcgcccgcggtggctcgacgctagaacctactccgatcctcttgccctgaaagaatttaaggacttcgccgctggccgcaaaagcattgcgctggatctcgttacagagatcgggagagtgccctctcacctggcccatcggacccgcaatgctcttgacaacctggtcatgctccacacatccgaacacggaggcagagcctatcggcatgccgtggaggagctgcctgaaaccatggagacgctgctccttctgggcctgatgattctcctgaccgggggagctatgctttttctgatcagcggcaaggggatcggaaaaacatccattggcctcatctgtgtcattgcctctagcgggatgctgtggatggcggaaatccccctgcagtggattgcctccgctatcgtgctcgagttctttatgatggttcttctgattcctgagcccgaaaagcaacgcaccccgcaggataatcagctggcctacgtggtgatcggaatcctcacactggctgccattatcgcggccaacgagatgggccttctggaaaccacgaagagagacctcggcatgagcaaagagcctggggtcgtttctcccacatcctatctggatgtggacctgcaccccgctagcgcctggaccctctacgctgtggccacaaccgtcattacccctatgcttcggcatacaatcgaaaattctacggctaacgtgagcctggccgcgattgccaaccaagctgttgtgctgatgggactcgacaagggctggccgatctccaaaatggatctgggggtcccccttctggccctcggatgctactctcaggtgaatcctctgaccctgacagctgccgtcctccttctgatcacccactatgccattatcggccccgggctgcaggcgaaggctacaagagaggcccagaaacgcaccgctgccggaattatgaagaaccctacggtggacggcatcatgacaattgatctcgaccccgttatctacgatagcaagttcgagaaacaactgggccaggtgatgcttctggtcctctgtgccgtgcagctgctgctcatgcggacctcctgggctctttgcgaagccctgaccctggcgacagggcctatcaccacactctgggagggatctccgggcaagttttggaatacgaccattgccgttagcatggctaacatcttcagagggtcctatctggccggagctggccttgcctttagcattatgaaatctgtggggacaggaaagcgcggcaccggctcccagggggaaacactgggagagaaatggaagaagaaactcaatcaactgagccggaaggagttcgacctgtacaaaaagtccggcatcaccgaggtcgatagaacggaggcgaaagaagggctcaagcggggagagattacccatcacgccgtgtctcgcggcagcgctaaacttcagtggtttgtggaaagaaacatggttatccccgaggggcgggtcattgacctgggatgtggccgcggcgggtggtcctattactgcgccggactgaagaaggtgacagaagtgagaggctataccaaagggggacctggccacgaggagcccgtccctatgtctacatacgggtggaatatcgttaagctcatgagcggaaaagatgtgttctacctgcccccggaaaagtgtgacacccttctgtgcgatatcggcgagtccagcccttctcccacagtggaagagtcccggaccattcgcgtcctcaaaatggtggagccctggctgaagaacaatcagttctgtatcaaggttctgaacccttatatgcccacggtgattgaacatctcgagagacttcagcggaaacacggcgggatgctggtccgcaatcctctgagcagaaactctacacatgaaatgtactggatctccaatggaaccggcaacattgtggctagcgttaatatggtgtctcggctcctgcttaacagatttaccatgacacaccgccggccgacgatcgagaaggacgtcgatctgggggccggaaccagacacgtgaacgctgaacccgagacacctaatatggacgtgatcggcgagcgcattaaacggatcaaggaagaacacaacagcacctggcactatgacgatgaaaatccctacaaaacatgggcctatcatgggtcctacgaggtcaaggcgaccggatctgccagctccatgattaacggcgttgtgaagctcctgacaaaaccttgggacgtggtccccatggtgacccaaatggctatgacggataccacaccgttcggccagcagagagtttttaaggaaaaagtggacacccgcacacctcggagcatgcccgggaccagacgcgtcatgggaatcacggccgagtggctgtggcggacactcggcagaaataagaaacctcgcctgtgcacccgggaggagttcacaaagaaggtgagaaccaacgctgccatgggggccgtttttacggaggaaaatcaatgggattccgcgaaagctgccgtggaggacgaagatttctggaaacttgtcgaccgcgagagagagctgcacaaactcggaaagtgtggctcttgcgtgtataacatgatggggaaacgggaaaagaaactgggcgagtttggaaaggccaagggcagccgcgctatttggtacatgtggcttggggccagatacctggagttcgaggctctcggatttctgaatgaggatcattggttctcccgggaaaactcttatagcggcgttgagggggaaggactgcacaaactcggctacatcctgagagacatctccaagattcccgggggcgccatgtatgcggatgacaccgccggatgggacacacggatcaccgaggatgaccttcacaatgaagagaaaattacacagcagatggatcctgagcatcgccagctggctaacgccatctttaagctcacctaccaaaataaagtggtcaaggtgcagagacccacaccgaccggcacggtcatggacattatctctcggaaggatcagcgcgggagcggacaggtgggcacatatgggctgaacaccttcaccaatatggaagctcaacttatcagacagatggagggagaaggcgttctgtccaaagccgacctcgagaaccctcatctgcccgaaaagaaaattacacagtggctggagaccaagggggtggagcggctcaaacgcatggcgatcagcggcgatgactgcgtcgtgaagcccattgatgacagatttgccaacgctctgcttgccctgaatgatatgggaaaggtgcggaaagacatccctcagtggcaaccgtctaagggctggcatgattggcagcaggttcccttctgttcccaccacttccatgaactcattatgaaagacgggcgcaagctggtggtcccttgcagaccccaggacgagcttatcggacgggctcgcattagccaaggcgccgggtggtctctgagagaaacagcttgtctcggaaaagcctacgcgcagatgtggtccctgatgtattttcaccggcgcgatctgagactcgccagcaacgctatctgctctgccgtgcctgttcattgggtgcccacgtcccggaccacatggagcatccacgcccatcaccagtggatgaccacagaggacatgctgaccgtctggaatagagtgtggattgaagataacccttggatggaggacaagacgcccgtcaccacatgggaggatgtgccgtaccttggcaagcgcgaagaccaatggtgtgggtccctgatcggcctcaccagccgggctacatgggcccagaatattcctaccgcgatccagcaggttagatctctgattggaaacgaggagttccttgattacatgcccagcatgaaacgctttcggaaggaggaggaatccgagggcgctatctggtga

SEQ ID NO: 20629 - RNA, 9873 nt, synthetic construct
  misc_feature 1..9873: note = derived and/or modified CDS sequence (opt5) from DENV-3__KJ189280__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaacacaatcttcaccctgacagtggcttggcggaccgccacgctcattctggctggcgtgtccctgcttccggtctgccagtctagctccatgagaaaaacagactggctgcccatggccgttgccgctatgggggtgcctcccctccctctgtttatcttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacatccgctgatctgaccgtggaaaaagccgcggacattacatgggaggaagaggctgaacaaacgggagttagccataacctcatgatcaccgtggacgatgacggcacaatgcgcattaaggatgacgagaccgagaatatcctgacagtccttctgaaaaccgccctgctcatcgtgtctggcatttttccgtactccatccctgccacgctgcttgtctggcacacctggcagaagcagacacagagaagcggggtgctgtgggatgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataacggcaagagactcgaaccgaattgggcgtccgtgaaaaaggacctgattagctacggcgggggatggcggctttctacccagtggcagaaaggcgaggaagttcaagtcatcgctgtggagcctgggaagaaccccaaaaatttccagacaatgcctggaaccttccagaccacaacgggcgaaattggggccatcgccctggattttaagcccggaacctccggcagccccatcattaaccgcgagggcaaggtggtcgggctgtatggaaatggcgtggttaccaagaacgggggatacgtgtccggcatcgctcagaccaatgccgagcctgacgggccgacacccgaactcgaggaagagatgttcaagaaaagaaacctgaccattatggatcttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggacctgatgtgccacgccacctttacgatgcgcctgctcagccctgtccgggtgccgaattataacctgatcattatggatgaggcccatttcacagaccccgcttccatcgcggccagaggatacatttctacccgcgttggcatgggggaagctgccgccatctttatgacagctacccctcccggaacggccgatgcgttccctcagagcaatgctcccatccaggacgaggagcgggacattccggaaagatcctggaactctggcaatgagtggatcaccgattttgccgggaagacagtgtggttcgtccctagcattaaagccggcaacgacatcgctaactgtcttcgcaagaatggcaaaaaggtgattcagctgtcccggaagacctttgatacagaataccagaaaacaaagctcaacgactgggatttcgtggtcacaaccgacatctctgagatgggagccaattttaaagcggatagagttattgacccccggcgctgcctgaagcccgtgatcctgacggatgggcctgagagagtgatcctcgccggacccatgcctgtcacagctgccagcgctgcccagcggcgcggcagagtggggcggaacccgcagaaagaaaatgaccagtatattttcaccggacaaccccttaacaatgatgaggaccacgctcactggaccgaagccaagatgctgctggacaacatcaatacacctgagggcattatccccgccctcttcgaacctgagagagagaagtccgccgctattgatggggaataccgcctgaaaggcgagagccggaagacctttgttgaacttatgagacgcggagacctgcccgtgtggctcgcccataaagtctcttccgagggcatcaagtatacagatcggaaatggtgcttcgacgggcagagaaacaatcagatcctggaagagaacatggatgtggagatttggacgaaggaaggagagaaaaagaagctgcgcccgcggtggctcgacgctagaacctacagcgatcctcttgccctgaaagaatttaaggacttcgccgctggccgcaaatctatcgcgctggatctcgttacagagattgggagagtgccctcccacctggcccatcggacccgcaatgctcttgacaacctggtcatgctccacacaagcgaacacggaggcagagcctatcggcatgccgtggaggagctgcctgaaaccatggagacgctgctccttctgggcctgatgatcctcctgaccgggggagctatgctttttctgatttccggcaaggggatcggaaaaacatctatcggcctcatttgtgtcatcgccagctccgggatgctgtggatggcggaaattcccctgcagtggatcgccagcgctattgtgctcgagttctttatgatggttcttctgatccctgagcccgaaaagcaacgcaccccgcaggataatcagctggcctacgtggtgattggaatcctcacactggctgccatcattgcggccaacgagatgggccttctggaaaccacgaagagagacctcggcatgtctaaagagcctggggtcgtttcccccacaagctatctggatgtggacctgcaccccgcttctgcctggaccctctacgctgtggccacaaccgtcatcacccctatgcttcggcatacaattgaaaatagcacggctaacgtgtccctggccgcgatcgccaaccaagctgttgtgctgatgggactcgacaagggctggccgatttctaaaatggatctgggggtcccccttctggccctcggatgctacagccaggtgaatcctctgaccctgacagctgccgtcctccttctgatcacccactatgccatcattggccccgggctgcaggcgaaggctacaagagaggcccagaaacgcaccgctgccggaatcatgaagaaccctacggtggacggcattatgacaatcgatctcgaccccgttatttacgattccaagttcgagaaacaactgggccaggtgatgcttctggtcctctgtgccgtgcagctgctgctcatgcggacctcttgggctctttgcgaagccctgaccctggcgacagggcctatcaccacactctgggagggaagcccgggcaagttttggaatacgaccatcgccgtttccatggctaacattttcagagggagctatctggccggagctggccttgccttttctatcatgaaatccgtggggacaggaaagcgcggcaccggcagccagggggaaacactgggagagaaatggaagaagaaactcaatcaactgtcccggaaggagttcgacctgtacaaaaagtctggcattaccgaggtcgatagaacggaggcgaaagaagggctcaagcggggagagatcacccatcacgccgtgagccgcggctccgctaaacttcagtggtttgtggaaagaaacatggttattcccgaggggcgggtcatcgacctgggatgtggccgcggcgggtggtcttattactgcgccggactgaagaaggtgacagaagtgagaggctataccaaagggggacctggccacgaggagcccgtccctatgagcacatacgggtggaatattgttaagctcatgtccggaaaagatgtgttctacctgcccccggaaaagtgtgacacccttctgtgcgatatcggcgagagctctccttcccccacagtggaagagagccggaccatccgcgtcctcaaaatggtggagccctggctgaagaacaatcagttctgtattaaggttctgaacccttatatgcccacggtgatcgaacatctcgagagacttcagcggaaacacggcgggatgctggtccgcaatcctctgtctagaaactccacacatgaaatgtactggattagcaatggaaccggcaacatcgtggcttctgttaatatggtgagccggctcctgcttaacagatttaccatgacacaccgccggccgacgattgagaaggacgtcgatctgggggccggaaccagacacgtgaacgctgaacccgagacacctaatatggacgtgatcggcgagcgcatcaaacggattaaggaagaacacaactccacctggcactatgacgatgaaaatccctacaaaacatgggcctatcatgggtcttacgaggtcaaggcgaccggaagcgcctccagcatgatcaacggcgttgtgaagctcctgacaaaaccttgggacgtggtccccatggtgacccaaatggctatgacggataccacaccgttcggccagcagagagtttttaaggaaaaagtggacacccgcacacctcggtccatgcccgggaccagacgcgtcatgggaattacggccgagtggctgtggcggacactcggcagaaataagaaacctcgcctgtgcacccgggaggagttcacaaagaaggtgagaaccaacgctgccatgggggccgtttttacggaggaaaatcaatgggattctgcgaaagctgccgtggaggacgaagatttctggaaacttgtcgaccgcgagagagagctgcacaaactcggaaagtgtggcagctgcgtgtataacatgatggggaaacgggaaaagaaactgggcgagtttggaaaggccaagggctcccgcgctatctggtacatgtggcttggggccagatacctggagttcgaggctctcggatttctgaatgaggatcattggttctctcgggaaaacagctattccggcgttgagggggaaggactgcacaaactcggctacattctgagagacatctctaagatccccgggggcgccatgtatgcggatgacaccgccggatgggacacacggattaccgaggatgaccttcacaatgaagagaaaatcacacagcagatggatcctgagcatcgccagctggctaacgccatttttaagctcacctaccaaaataaagtggtcaaggtgcagagacccacaccgaccggcacggtcatggacatcattagccggaaggatcagcgcgggtccggacaggtgggcacatatgggctgaacaccttcaccaatatggaagctcaacttatcagacagatggagggagaaggcgttctgagcaaagccgacctcgagaaccctcatctgcccgaaaagaaaatcacacagtggctggagaccaagggggtggagcggctcaaacgcatggcgatttctggcgatgactgcgtcgtgaagcccatcgatgacagatttgccaacgctctgcttgccctgaatgatatgggaaaggtgcggaaagacattcctcagtggcaaccgtccaagggctggcatgattggcagcaggttcccttctgtagccaccacttccatgaactcatcatgaaagacgggcgcaagctggtggtcccttgcagaccccaggacgagcttattggacgggctcgcatctctcaaggcgccgggtggtccctgagagaaacagcttgtctcggaaaagcctacgcgcagatgtggagcctgatgtattttcaccggcgcgatctgagactcgcctctaacgctatttgctccgccgtgcctgttcattgggtgcccacgagccggaccacatggtccatccacgcccatcaccagtggatgaccacagaggacatgctgaccgtctggaatagagtgtggatcgaagataacccttggatggaggacaagacgcccgtcaccacatgggaggatgtgccgtaccttggcaagcgcgaagaccaatggtgtgggagcctgattggcctcacctctcgggctacatgggcccagaatatccctaccgcgattcagcaggttagaagcctgatcggaaacgaggagttccttgattacatgccctccatgaaacgctttcggaaggaggaggaatctgagggcgctatttggtga

SEQ ID NO: 20630 - RNA, 9873 nt, synthetic construct
  misc_feature 1..9873: note = derived and/or modified CDS sequence (opt5) from DENV-3__KJ189281__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggtcctcggatttttcctgagaaaactcacctctcgcgaaaacctgcttctgggcgtggggctcgccatggctacaaccctgcagctgcctgaggatatcgaacaaatggccaatggaattgctcttggcctgatggccctcaagctgatcacccagtttgagacataccagctctggacggcgctgatttcccttacctgtagcaacacaatcttcaccctgacagtggcctggcggaccgctacgctcattctggccggcgtctccctgcttccggtttgccagtctagctccatgagaaaaacagactggctgcccatggctgtggccgccatgggggtgcctcccctccctctgtttatcttctctctcaaggataccctgaagcgcagaagctggccccttaatgagggagtcatggctgtgggcctggtttccatcctggcgtctagcctcctgcggaacgacgtgcctatggccgggccccttgtcgctggaggcctgctcattgcctgttatgtgatcaccgggacatccgccgatctgaccgttgaaaaagctgccgacattacatgggaggaagaggcggaacaaacgggagtgagccataacctcatgatcaccgtcgacgatgacggcacaatgcgcattaaggatgacgagaccgagaatatcctgacagtgcttctgaaaaccgctctgctcatcgtctctggcatttttccgtactccatccctgccacgctgcttgtgtggcacacctggcagaagcagacacagagaagcggggttctgtgggatgtgccctctcctcccgaaacccaaaaagccgagctcgaagagggagtctaccggattaagcagcagggcatcttcgggaaaacacaggtgggagttggcgtgcaaaaggagggggtctttcacaccatgtggcatgtgacacgcggagctgtgctgacgtataacggcaagagactcgaaccgaattgggcctccgttaaaaaggacctgattagctacggcgggggatggcggctttctacccagtggcagaaaggcgaggaagtccaagtgatcgcggtggagcctgggaagaaccccaaaaatttccagacaatgcctggaaccttccagaccacaacgggcgaaattggggctatcgccctggattttaagcccggaacctccggcagccccatcattaaccgcgagggcaaggtcgtggggctgtatggaaatggcgttgtgaccaagaacgggggatacgtctccggcatcgcccagaccaatgctgagcctgacgggccgacacccgaactcgaggaagagatgttcaagaaaagaaacctgaccattatggatcttcaccctggcagcggaaagacgcggaaatatctgcccgccatcgtgcgcgaagctattaagagacggctcagaacactgatcctcgcccctacccgcgttgtggcggccgagatggaggaagctctgaagggccttcccatccggtaccaaaccacagccaccaaatctgagcatacagggagagaaattgtcgacctgatgtgccacgctacctttacgatgcgcctgctcagccctgtgcgggttccgaattataacctgatcattatggatgaggcccatttcacagaccccgcctccatcgctgcgagaggatacatttctacccgcgtgggcatgggggaagccgctgccatctttatgacagccacccctcccggaacggctgatgccttccctcagagcaatgcgcccatccaggacgaggagcgggacattccggaaagatcctggaactctggcaatgagtggatcaccgattttgctgggaagacagtctggttcgtgcctagcattaaagccggcaacgacatcgccaactgtcttcgcaagaatggcaaaaaggtgattcagctgtcccggaagacctttgatacagaataccagaaaacaaagctcaacgactgggatttcgtcgttacaaccgacatctctgagatgggagctaattttaaagccgatagagtgattgacccccggcgctgcctgaagcccgtgatcctgacggatgggcctgagagagtcatcctcgcgggacccatgcctgtgacagccgctagcgccgctcagcggcgcggcagagttgggcggaacccgcagaaagaaaatgaccagtatattttcaccggacaaccccttaacaatgatgaggaccacgcccactggaccgaagctaagatgctgctggacaacatcaatacacctgagggcattatccccgccctcttcgaacctgagagagagaagtccgcggccattgatggggaataccgcctgaaaggcgagagccggaagacctttgtggaacttatgagacgcggagacctgcccgtctggctcgctcataaagtggcctctgagggcatcaagtatacagatcggaaatggtgcttcgacgggcagagaaacaatcagatcctggaagagaacatggatgttgagatttggacgaaggaaggagagaaaaagaagctgcgcccgcggtggctcgacgctagaacctactccgatcctcttgccctgaaagaatttaaggacttcgccgctggccgcaaaagcatcgcgctggatctcgtgacagagattgggagagtcccctctcacctggcccatcggacccgcaatgctcttgacaacctggtgatgctccacacatccgaacacggaggcagagcctatcggcatgccgtcgaggagctgcctgaaaccatggagacgctgctccttctgggcctgatgatcctcctgaccgggggagctatgctttttctgattagcggcaaggggatcggaaaaacatccatcggcctcatttgtgtgatcgcctctagcgggatgctgtggatggcggaaattcccctgcagtggatcgcctccgctattgttctcgagttctttatgatggtgcttctgatccctgagcccgaaaagcaacgcaccccgcaggataatcagctggcctacgtggtcattggaatcctcacactggctgccatcattgcggccaacgagatgggccttctggaaaccacgaagagagacctcggcatgagcaaagagcctggggttgtgtctcccacatcctatctggatgtggacctgcaccccgctagcgcctggaccctctacgctgtcgccacaaccgtgatcacccctatgcttcggcatacaattgaaaattctacggctaacgttagcctggccgcgatcgccaaccaagctgtggtcctgatgggactcgacaagggctggccgatttccaaaatggatctgggggtgccccttctggccctcggatgctactctcaggtcaatcctctgaccctgacagctgccgtgctccttctgatcacccactatgccatcattggccccgggctgcaggcgaaggctacaagagaggcccagaaacgcaccgctgccggaatcatgaagaaccctacggttgacggcattatgacaatcgatctcgaccccgtgatttacgatagcaagttcgagaaacaactgggccaggtcatgcttctggtgctctgtgccgttcagctgctgctcatgcggacctcctgggctctttgcgaagccctgaccctggcgacagggcctatcaccacactctgggagggatctccgggcaagttttggaatacgaccatcgccgtgagcatggctaacattttcagagggtcctatctggccggagctggccttgcctttagcatcatgaaatctgtcgggacaggaaagcgcggcaccggctcccagggggaaacactgggagagaaatggaagaagaaactcaatcaactgagccggaaggagttcgacctgtacaaaaagtccggcattaccgaggtggatagaacggaggcgaaagaagggctcaagcggggagagatcacccatcacgccgtgtctcgcggcagcgctaaacttcagtggtttgttgaaagaaacatggtcattcccgaggggcgggtgatcgacctgggatgtggccgcggcgggtggtcctattactgcgccggactgaagaaggtgacagaagtcagaggctataccaaagggggacctggccacgaggagcccgttcctatgtctacatacgggtggaatattgtgaagctcatgagcggaaaagatgtgttctacctgcccccggaaaagtgtgacacccttctgtgcgatatcggcgagtccagcccttctcccacagtcgaagagtcccggaccatccgcgtgctcaaaatggttgagccctggctgaagaacaatcagttctgtattaaggtgctgaacccttatatgcccacggtcatcgaacatctcgagagacttcagcggaaacacggcgggatgctggtgcgcaatcctctgagcagaaactctacacatgaaatgtactggatttccaatggaaccggcaacatcgttgctagcgtgaatatggtctctcggctcctgcttaacagatttaccatgacacaccgccggccgacgattgagaaggacgtggatctgggggccggaaccagacacgtgaacgctgaacccgagacacctaatatggacgtcatcggcgagcgcatcaaacggattaaggaagaacacaacagcacctggcactatgacgatgaaaatccctacaaaacatgggcctatcatgggtcctacgaggttaaggcgaccggatctgccagctccatgatcaacggcgtggtgaagctcctgacaaaaccttgggacgtcgtgcccatggttacccaaatggctatgacggataccacaccgttcggccagcagagagtgtttaaggaaaaagtcgacacccgcacacctcggagcatgcccgggaccagacgcgtgatgggaattacggccgagtggctgtggcggacactcggcagaaataagaaacctcgcctgtgcacccgggaggagttcacaaagaaggttagaaccaacgctgccatgggggccgtgtttacggaggaaaatcaatgggattccgcgaaagctgccgtcgaggacgaagatttctggaaacttgtggaccgcgagagagagctgcacaaactcggaaagtgtggctcttgcgtttataacatgatggggaaacgggaaaagaaactgggcgagtttggaaaggccaagggcagccgcgctatctggtacatgtggcttggggccagatacctggagttcgaggctctcggatttctgaatgaggatcattggttctcccgggaaaactcttatagcggcgtggagggggaaggactgcacaaactcggctacattctgagagacatctccaagatccccgggggcgccatgtatgcggatgacaccgccggatgggacacacggattaccgaggatgaccttcacaatgaagagaaaatcacacagcagatggatcctgagcatcgccagctggctaacgccatttttaagctcacctaccaaaataaagtcgtgaaggtccagagacccacaccgaccggcacggtgatggacatcatttctcggaaggatcagcgcgggagcggacaggttggcacatatgggctgaacaccttcaccaatatggaagctcaacttatcagacagatggagggagaaggcgtgctgtccaaagccgacctcgagaaccctcatctgcccgaaaagaaaatcacacagtggctggagaccaagggggtcgagcggctcaaacgcatggcgattagcggcgatgactgcgtggtgaagcccatcgatgacagatttgccaacgctctgcttgccctgaatgatatgggaaaggttcggaaagacattcctcagtggcaaccgtctaagggctggcatgattggcaacaggtgcccttctgttcccaccacttccatgaactcatcatgaaagacgggcgcaagctggtcgtgccttgcagaccccaggacgagcttattggacgggctcgcatcagccaaggcgccgggtggtctctgagagaaacagcttgtctcggaaaagcctacgcgcagatgtggtccctgatgtattttcaccggcgcgatctgagactcgccagcaacgctatttgctctgccgttcctgtgcattgggtccccacgtcccggaccacatggagcatccacgcccatcaccagtggatgaccacagaggacatgctgaccgtgtggaatagagtctggatcgaagataacccttggatggaggacaagacgcccgtgaccacatgggaggatgttccgtaccttggcaagcgcgaagaccaatggtgtgggtccctgattggcctcaccagccgggctacatgggcccagaatatccctaccgcgattcaacaggtgagatctctgatcggaaacgaggagttccttgattacatgcccagcatgaaacgctttcggaaggaggaggaatccgagggcgctatttggtga

SEQ ID NO: 20631 - RNA, 9873 nt, synthetic construct
  misc_feature 1..9873: note = derived and/or modified CDS sequence (opt5) from DENV-3__KJ189282__SS-prME
  source 1..9873: mol_type = other RNA
accagcctgtgcctcatgatgatcctgcccgccgctcttgccttccacctgacatcccgggacggagaacctcggatgattgtggggaaaaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggcattctggagcagggcaaacggacccttacacctcagcccatggagctgaagtactcttggaaaacctgggggaaggccaagatcgttacagctgaaacccagaactccagcttcattatcgatggacctaatacacccgagtgcccgtctgcgtccagagcctggaacgtgtgggaagtcgaggactatggctttggcgtgttcaccacgaatatctggctccgcctgcgggaggcttacacacaactgtgtgaccacagacttatgagcgccgccgtgaaagatgagcgcgctgtccatgccgacatggggtactggattgagtcccagaagaacggatcttggaaactcgaaaaggcgagcctgatcgaggttaaaacctgcacctggcctaagtcccacacactgtggtctaatggcgtgctcgaaagcgatatgattatccccaagtccctggctgggcctattagccagcataaccaccggcccggatatcacacccagacggccggcccttggcatcttgggaaactggagctcgactttaattactgcgagggaacaaccgtggtcatcacagaaaactgtggcaccagaggcccctctctgcgcacaaccacggtgtccgggaagctgatccacgagtggtgctgtcggagctgcacccttccgcctctcagatatatgggagaagatggctgttggtacgggatggagattcggcccatctctgaaaaagaggagaatatggttaagtccctggtgagcgccggatctggcaaagtcgacaacttcacaatgggggtgctgtgcctcgctattctgtttgaagaggttatgcgcggaaagttcggcaagaaacatatgatcgccggcgtgttctttaccttcgtccttctgctcagcgggcaaattacatggagagatatggcgcacaccctgatcatgattggatccaatgctagcgaccggatgggcatgggggtgacgtatctggcccttatcgccacatttaagatccagcccttcctggctctcggatttttcctgagaaaactcacctctcgcgaaaacctgcttctgggcgttgggctcgccatggctacaaccctgcagctgcctgaggatattgaacaaatggccaatggaatcgcgcttggcctgatggccctcaagctgattacccagtttgagacataccagctctggacggctctgatctcccttacctgtagcaacacaattttcaccctgacagtggcctggcggaccgctacgctcatcctggccggcgtctccctgcttccggtgtgccagtctagctccatgagaaaaacagactggctgcccatggccgtggctgcgatgggggtccctcccctccctctgtttatcttctctctcaaggataccctgaagcgcagaagctggccccttaatgagggagttatggccgtgggcctggtgtccattctggcttctagcctcctgcggaacgacgtccctatggccgggccccttgtggccggaggcctgctcatcgcttgttatgttattaccgggacatccgccgatctgaccgtggaaaaagcggctgacatcacatgggaggaagaggccgaacaaacgggagtcagccataacctcatgattaccgtggacgatgacggcacaatgcgcatcaaggatgacgagaccgagaatatcctgacagttcttctgaaaaccgccctgctcattgtgtctggcatctttccgtactccattcctgctacgctgcttgtctggcacacctggcagaagcagacacagagaagcggggtgctgtgggatgtcccctctcctcccgaaacccaaaaagccgagctcgaagagggagtgtaccggatcaagcagcagggcattttcgggaaaacacaggttggagtgggcgtccaaaaggagggggtgtttcacaccatgtggcatgttacacgcggagcggtgctgacgtataacggcaagagactcgaaccgaattgggcttccgtcaaaaaggacctgatcagctacggcgggggatggcggctttctacccagtggcagaaaggcgaggaagtgcaagtgattgccgttgagcctgggaagaaccccaaaaatttccagacaatgcctggaaccttccagaccacaacgggcgaaatcggggccatcgctctggattttaagcccggaacctccggcagccccattatcaaccgcgagggcaaggtcgtggggctgtatggaaatggcgtggtcaccaagaacgggggatacgtgtccggcattgcccagaccaatgctgagcctgacgggccgacacccgaactcgaggaagagatgttcaagaaaagaaacctgaccatcatggatcttcaccctggcagcggaaagacgcggaaatatctgcccgccattgttcgcgaagcgatcaagagacggctcagaacactgatcctcgcccctacccgcgtggtcgctgccgagatggaggaagctctgaagggccttcccattcggtaccaaaccacagccaccaaatctgagcatacagggagagaaatcgtggacctgatgtgccacgccacctttacgatgcgcctgctcagccctgttcgggtgccgaattataacctgattatcatggatgaggctcatttcacagaccccgcgtccattgccgctagaggatacatctctacccgcgtcggcatgggggaagccgccgctatctttatgacagccacccctcccggaacggcggatgctttccctcagagcaatgcccccattcaggacgaggagcgggacatcccggaaagatcctggaactctggcaatgagtggattaccgattttgccgggaagacagtgtggttcgttcctagcatcaaagctggcaacgacattgccaactgtcttcgcaagaatggcaaaaaggtgatccagctgtcccggaagacctttgatacagaataccagaaaacaaagctcaacgactgggatttcgtcgtgacaaccgacatttctgagatgggagcgaattttaaagccgatagagtgatcgacccccggcgctgcctgaagcccgtcatcctgacggatgggcctgagagagttattctcgctggacccatgcctgtgacagccgctagcgccgctcagcggcgcggcagagtggggcggaacccgcagaaagaaaatgaccagtatatcttcaccggacaaccccttaacaatgatgaggaccacgcccactggaccgaagcgaagatgctgctggacaacattaatacacctgagggcatcattcccgccctcttcgaacctgagagagagaagtccgctgccatcgatggggaataccgcctgaaaggcgagagccggaagacctttgtcgaacttatgagacgcggagacctgcccgtgtggctcgctcataaagttgcctctgagggcatcaagtatacagatcggaaatggtgcttcgacgggcagagaaacaatcagattctggaagagaacatggatgtggagatctggacgaaggaaggagagaaaaagaagctgcgcccgcggtggctcgacgccagaacctactccgatcctcttgctctgaaagaatttaaggacttcgcggccggccgcaaaagcattgctctggatctcgtcacagagatcgggagagtgccctctcacctggcccatcggacccgcaatgcccttgacaacctggttatgctccacacatccgaacacggaggcagagcttatcggcatgccgtggaggagctgcctgaaaccatggagacgctgctccttctgggcctgatgattctcctgaccgggggagcgatgctttttctgatcagcggcaaggggatcggaaaaacatccattggcctcatctgtgtcattgcctctagcgggatgctgtggatggctgaaatccccctgcagtggattgcctccgctatcgtgctcgagttctttatgatggtccttctgattcctgagcccgaaaagcaacgcaccccgcaggataatcagctggcctacgtggttatcggaatcctcacactggcggccattatcgctgccaacgagatgggccttctggaaaccacgaagagagacctcggcatgagcaaagagcctggggtggtgtctcccacatcctatctggatgtcgacctgcaccccgctagcgcctggaccctctacgctgttgccacaaccgtgattacccctatgcttcggcatacaatcgaaaattctacggcgaacgtgagcctggccgctattgccaaccaagctgtcgtgctgatgggactcgacaagggctggccgatctccaaaatggatctgggggttccccttctggccctcggatgctactctcaggtgaatcctctgaccctgacagccgcggtcctccttctgatcacccactatgctattatcggccccgggctgcaggccaaggctacaagagaggcccagaaacgcaccgccgctggaattatgaagaaccctacggtggacggcatcatgacaattgatctcgaccccgtcatctacgatagcaagttcgagaaacaactgggccaggtgatgcttctggttctctgtgccgtgcagctgctgctcatgcggacctcctgggcgctttgcgaagccctgaccctggctacagggcctatcaccacactctgggagggatctccgggcaagttttggaatacgaccattgccgtcagcatggctaacatcttcagagggtcctatctggccggagcgggccttgcctttagcattatgaaatctgtggggacaggaaagcgcggcaccggctcccagggggaaacactgggagagaaatggaagaagaaactcaatcaactgagccggaaggagttcgacctgtacaaaaagtccggcatcaccgaggttgatagaacggaggctaaagaagggctcaagcggggagagattacccatcacgccgtgtctcgcggcagcgctaaacttcagtggtttgtcgaaagaaacatggtgatccccgaggggcgggtgattgacctgggatgtggccgcggcgggtggtcctattactgcgccggactgaagaaggttacagaagtcagaggctataccaaagggggacctggccacgaggagcccgtgcctatgtctacatacgggtggaatatcgtgaagctcatgagcggaaaagatgtcttctacctgcccccggaaaagtgtgacacccttctgtgcgatatcggcgagtccagcccttctcccacagttgaagagtcccggaccattcgcgtgctcaaaatggtggagccctggctgaagaacaatcagttctgtatcaaggtcctgaacccttatatgcccacggtgattgaacatctcgagagacttcagcggaaacacggcgggatgctggttcgcaatcctctgagcagaaactctacacatgaaatgtactggatctccaatggaaccggcaacattgtggctagcgtcaatatggtgtctcggctcctgcttaacagatttaccatgacacaccgccggccgacgatcgagaaggacgttgatctgggggccggaaccagacacgtgaacgcggaacccgagacacctaatatggacgtcatcggcgagcgcattaaacggatcaaggaagaacacaacagcacctggcactatgacgatgaaaatccctacaaaacatgggcctatcatgggtcctacgaggtgaaggctaccggatctgccagctccatgattaacggcgtggtcaagctcctgacaaaaccttgggacgttgtgcccatggtgacccaaatggctatgacggataccacaccgttcggccagcagagagtctttaaggaaaaagtggacacccgcacacctcggagcatggccgggaccagacgcgttatgggaatcacggccgagtggctgtggcggacactcggcagaaataagaaaccccgcctgtgcacccgggaggagttcacaaagaaggtgagaaccaacgcggctatgggggccgtctttacggaggaaaatcaatgggattccgccaaagctgccgtggaggacgaagatttctggaaacttgttgaccgcgagagagagctgcacaaactcggaaagtgtggctcttgcgtgtataacatgatggggaaacgggaaaagaaactgggcgagtttggaaaggctaagggcagccgcgccatttggtacatgtggcttggggcgagatacctggagttcgaggccctcggatttctgaatgaggatcattggttctcccgggaaaactcttatagcggcgtcgagggggaaggactgcacaaactcggctacatcctgagagacatctccaagattcctgggggcgctatgtatgccgatgacaccgctggatgggacacacggatcaccgaggatgaccttcacaatgaagagaaaattacacagcagatggatcccgagcatcgccagctggccaacgcgatctttaagctcacctaccaaaataaagtggttaaggtgcagagacctacacccaccggcacggtcatggacattatctctcggaaggatcagcgcgggagcggacaggtgggcacatatgggctgaacaccttcaccaatatggaagcccaacttatcagacagatggagggagaaggcgtcctgtccaaagctgacctcgagaacccgcatctgcctgaaaagaaaattacacagtggctggagaccaagggggtggagcggctcaaacgcatggccatcagcggcgatgactgcgttgtgaagcccattgatgacagatttgctaacgccctgcttgctctgaatgatatgggaaaggtccggaaagacatcccccagtggcaaccttctaagggctggcatgattggcaacaggtgccgttctgttcccaccacttccatgaactcattatgaaagacgggcgcaagctggtggttccctgcagacctcaggacgagcttatcggacgggcccgcattagccaaggcgcggggtggtctctgagagaaacagcctgtctcggaaaggcttacgcccagatgtggtccctgatgtattttcaccggcgcgatctgagactcgccagcaacgctatctgctctgccgtgcccgtccattgggtgcctacgtcccggaccacatggagcatccacgcgcatcaccagtggatgaccacagaggacatgctgaccgtttggaatagagtgtggattgaagataacccctggatggaggacaagacgcctgtcaccacatgggaggatgtgccctaccttggcaagcgcgaagaccaatggtgtgggtccctgatcggcctcaccagccgggctacatgggcccagaatattccgaccgccatccagcaggtcagatctctgattggaaacgaggagttccttgattacatgcctagcatgaaacgctttcggaaggaggaggaatccgagggcgctatctggtga

SEQ ID NO: 20632 - RNA, 9873 nt, synthetic construct
  misc_feature 1..9873: note = derived and/or modified CDS sequence (opt5) from DENV-3__KJ189283__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagcccggggggctagacgcatggccattcttggagacaccgcgtgggatttcggctccgtggggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaaaacaatcttcaccctgacagtggcttggcggaccgccacgctcattctggctggcgtgtccctgcttccggtctgccagtctagctccatgagaaagacagactggctgcccatggccgttgccgctatgggggtgcctcccctccctctgtttatcttctctctcaaggataccctgaaacgcagaagctggccccttaacgagggagtgatggcggtcggcctggtgtccatcctggcctctagcctcctgcggaatgacgttcctatggctgggccccttgtggccggaggcctgctcattgcctgttatgtcatcaccgggacatccgctgatctgaccgtggaaaaggccgcggacattacatgggaggaagaggctgaacaaacgggagttagccataacctcatgatcaccgtggacgatgacggcacaatgcgcattaaagatgacgagaccgagaacatcctgacagtccttctgaagaccgccctgctcatcgtgtctggcatttttccgtactccatccctgccacgctgcttgtctggcacacctggcagaaacagacacagagaagcggggtgctgtgggatgttccctctcctcccgaaacccaaaaggctgagctcgaagagggagtgtaccggattaaacagcagggcatcttcgggaagacacaggtcggagtgggcgttcaaaaggagggggtgtttcacaccatgtggcatgtcacacgcggagccgtgctgacgtataatggcaaaagactcgaaccgaactgggcgtccgtgaagaaagacctgattagctacggcgggggatggcggctttctacccagtggcagaagggcgaggaagttcaagtcatcgctgtggagcctgggaaaaatcccaagaacttccagacaatgcctggaaccttccagaccacaacgggcgaaattggggccatcgccctggattttaagcccggaacctccggcagccccatcattaatcgcgagggcaaagtggtcgggctgtatggaaacggcgtggttacaaagaatgggggatacgtgtccggcatcgctcagaccaacgccgagcctgacgggccgacacccgaactcgaggaagagatgttcaaaaagagaaatctgaccattatggatcttcaccctggcagcggaaaaacgcggaagtatctgcccgctatcgtccgcgaagccattaagagacggctcagaacactgatcctcgcgcctacccgcgtggttgccgctgagatggaggaagccctgaaaggccttcccatccggtaccaaaccacagctaccaagtctgagcatacagggagagaaattgtggacctgatgtgccacgccacctttacgatgcgcctgctcagccctgtccgggtgccgaactataatctgatcattatggatgaggcccatttcacagaccccgcttccatcgcggccagaggatacatttctacccgcgttggcatgggggaagctgccgccatctttatgacagctacccctcccggaacggccgatgcgttccctcagagcaacgctcccatccaggacgaggagcgggacattccggaaagatcctggaattctggcaacgagtggatcaccgattttgccgggaaaacagtgtggttcgtccctagcattaaggccggcaatgacatcgctaactgtcttcgcaaaaacggaaagaaggtgattcagctgtcccggaaaacctttgatacagaataccaaaagaccaaactcaatgactgggatttcgtggtcacaaccgacatctctgagatgggcgccaactttaaggcggatagagttattgacccccggcgctgcctgaaacccgtgatcctgacggatgggcctgagagagtgatcctcgccggacccatgcctgtcacagctgccagcgctgcccagcggcgcggcagagtggggcggaatccgcagaaggaaaacgaccagtatattttcaccggacaaccccttaataacgatgaggaccacgctcactggaccgaagccaagatgctgctggacaatatcaacacacctgagggcattatccccgcgctcttcgaacctgagagagagaaatccgccgctattgatggggaataccgcctgaagggcgagagccggaaaacctttgttgaacttatgagacgcggagacctgcccgtgtggctcgcccataaggtcgcttctgagggcatcaaatatacagatcggaagtggtgcttcgacgggcagagaaataaccagatcctggaagagaatatggatgtggagatttggacgaaagaaggagagaagaagaaactgcgcccgcggtggctcgacgccagaacctactccgatcctcttgccctgaaggaatttaaagacttcgctgcgggccgcaagagcatcgccctggatctcgttacagagattgggagagtgccctctcacctggctcatcggacccgcaacgcccttgacaatctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaagggatcggaaagacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggataaccagctggcttacgtggtgattggaatcctcacactggccgcgatcattgccgctaatgagatgggccttctggaaaccacgaaaagagacctcggcatgagcaaggagcctggggtcgtttctcccacatcctatctggatgtggacctgcaccccgccagcgcttggaccctctacgccgtggctacaaccgtcatcacccctatgcttcggcatacaattgaaaactctacggccaatgtgagcctggcggccatcgctaaccaagccgttgtgctgatgggactcgacaaaggctggccgatttccaagatggatctgggggtcccccttctggctctcggatgctactctcaggtgaaccctctgaccctgacagccgccgtcctccttctgatcacccactatgcgatcattggccccgggctgcaggctaaagccacaagagaggctcagaagcgcaccgccgccggaatcatgaagaatcctacggtggacggcattatgacaatcgatctcgaccccgttatttacgatagcaaattcgagaagcaactgggccaggtgatgcttctggtcctctgtgctgtgcagctgctgctcatgcggacctcctgggccctttgcgaagcgctgaccctggccacagggcctatcaccacactctgggagggatctccgggcaaattttggaacacgaccatcgctgttagcatggccaatattttcagagggtcctatctggctggagccggccttgcgtttagcatcatgaagtctgtggggacaggaaaacgcggcaccggctcccagggggaaacactgggagagaagtggaagaaaaagctcaaccaactgagccggaaagaattcgacctgtacaagaaatccggcattaccgaggtcgatagaacggaggccaaggaagggctcaaacggggagagatcacccatcacgctgtgtctcgcggcagcgccaagcttcagtggtttgtggaaagaaatatggttattcccgaggggcgggtcatcgacctgggatgtggccgcggcgggtggtcctattactgcgctggactgaagaaagtgacagaagtgagaggctataccaaggggggacctggccacgaggagcccgtccctatgtctacatacgggtggaacattgttaaactcatgagcggaaaggatgtgttctacctgcccccggaaaaatgtgacacccttctgtgcgatatcggcgagtccagcccttctcccacagtggaagagtcccggaccatccgcgtcctcaagatggtggagccctggctgaagaataaccagttctgtattaaagttctgaatccttatatgcccacggtgatcgaacatctcgagagacttcagcggaagcacggcgggatgctggtccgcaaccctctgagcagaaattctacacatgaaatgtactggatttccaacggaaccggcaatatcgtggccagcgttaacatggtgtctcggctcctgcttaatagatttaccatgacacaccgccggccgacgattgagaaagacgtcgatctgggggctggaaccagacacgtgaacgccgaacccgagacacctaacatggacgtgatcggcgagcgcatcaagcggattaaagaagagcataatagcacctggcactatgacgatgaaaacccctacaagacatgggcgtatcatgggtcctacgaggtcaaggccaccggatctgctagctccatgatcaatggcgttgtgaaactcctgacaaagccttgggacgtggtccccatggtgacccaaatggccatgacggataccacaccgttcggccagcagagagtttttaaagaaaaggtggacacccgcacacctcggagcatgcccgggaccagacgcgtcatgggaattacggctgagtggctgtggcggacactcggcagaaacaaaaagcctcgcctgtgcacccgggaggaattcacaaagaaagtgagaaccaatgccgccatgggggcggtttttacggaggaaaaccaatgggattccgctaaggccgccgtggaggacgaagatttctggaaacttgtcgaccgcgagagagagctgcacaagctcggaaaatgtggctcttgcgtgtataatatgatggggaagcgggaaaaaaagctgggcgagtttggaaaggctaaaggcagccgcgccatctggtacatgtggcttggggctagatacctggaattcgaggccctcggatttctgaacgaggatcattggttctcccgggaaaattcttatagcggcgttgagggggaaggactgcacaagctcggctacattctgagagacatctccaaaatccccgggggcgcgatgtatgccgatgacaccgctggatgggacacacggattaccgaggatgaccttcacaacgaagagaagatcacacagcagatggatcctgagcatcgccagctggccaatgctatttttaaactcacctaccaaaacaaggtggtcaaggtgcagagacccacaccgaccggcacggtcatggacatcatttctcggaaagatcagcgcgggagcggacaggtgggcacatatgggctgaataccttcaccaacatggaagcccaacttatcagacagatggagggagaaggcgttctgtccaaggcggacctcgagaatcctcacctgcccgaaaaaaagatcacacagtggctggagaccaaaggggtggagcggctcaagcgcatggccattagcggcgatgactgcgtcgtgaagcccatcgatgacagatttgctaacgccctgcttgctctgaacgatatgggaaaagtgcggaaggacattcctcagtggcaaccgtctaaaggctggcatgattggcagcaggttcccttctgttcccaccacttccatgaactcatcatgaaggacgggcgcaaactggtggtcccttgcagaccccaggacgagcttattggacgggcccgcatcagccaaggcgctgggtggtctctgagagaaacagcctgtctcggaaaggcgtacgcccagatgtggtccctgatgtattttcaccggcgcgatctgagactcgctagcaatgccatttgctctgccgtgcctgttcattgggtgcccacgtcccggaccacatggagcatccacgctcatcaccagtggatgaccacagaggacatgctgaccgtctggaacagagtgtggatcgaagataatccttggatggaggacaagacgcccgtcaccacatgggaggatgtgccgtaccttggcaaacgcgaagaccaatggtgtgggtccctgattggcctcaccagccgggccacatgggcgcagaacatcctgaccgctattcagcaggttagatctcttatcggaaatgaggaattcctggattacatgcctagcatgaagcgctttcggaaagaggaggaatccgagggcgccatttggtga

SEQ ID NO: 20633 - RNA, 9873 nt, synthetic construct
  misc_feature 1..9873: note = derived and/or modified CDS sequence (opt5) from DENV-3__KJ189284__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggtcaccctgcccgaatatggcacgctggggctcgagtgctcccctcgcaccggactggacttcaatgagatgatccttctgacaatgaaaaacaaggcttggatggtgcatagacagtggtttttcgatctccccctgccgtggaccagcggcgccacaaccgaaacgcctacatggaatcggaaagagcttctggtcacctttaagaacgcccacgctaaaaagcaagaagtggttgtgctcgggtctcaggagggagcgatgcacacagccctgaccggcgctaccgaaattcaaaattccgggggcacaagcatcttcgccggacatctgaagtgtcgcctcaaaatggacaagctggagcttaaaggcatgtcttacgccatgtgcacgaacacctttgtcctgaagaaagaggtgtccgaaacacagcacgggaccattctcatcaaggttgagtacaagggagaagatgctccctgtaaaatccctttcagcacagaggacggccatgggaaggcccacaacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcatcaaatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcacacctggacagaacagtacaaatttcaggccgattcccccaagcggctggcgaccgccattgctggcgcctgggagaatggagtgtgtggcatcagaagcacaacccgcatggaaaaccttctctggaaacaaattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccagaactccagcttcatcattgatggacctaatacacccgagtgcccgtctgcttccagagcgtggaacgtgtgggaagtggaggactatggctttggcgtcttcaccacgaatatctggctccgcctgcgggaagtttacacacaactgtgtgaccacagacttatgagcgccgctgtgaaagatgagcgcgccgtgcatgccgacatggggtactggatcgagtcccagaagaacggatcttggaaactcgaaaaggctagcctgattgaggtcaaaacctgcacctggcctaagtcccacacactgtggtctaatggcgtgctcgaaagcgatatgatcattcccaagtccctggccgggcctatcagccagcataaccaccggcccggatatcacacccagacggcgggcccttggcatcttgggaaactggagctcgactttaattactgcgagggaacaaccgttgtgattacagaaaactgtggcaccagaggcccctctctgcgcacaaccacggtctccgggaagctgatccacgagtggtgctgtcggagctgcacccttccgcctctcagatatatgggagaagatggctgttggtacgggatggagatccggcccatttctgaaaaagaggagaatatggtgaagtccctggttagcgctggatctggcaaagtggacaacttcacaatgggggtcctgtgcctcgccatcctgtttgaagaggtgatgcgcggaaagttcggcaagaaacatatgattgccggcgttttctttaccttcgtgcttctgctcagcgggcaaatcacatggagagatatggctcacaccctgattatgatcggatccaatgccagcgaccggatgggcatgggggtcacgtatctggcgcttattgctacatttaagatccagcccttcctggccctcggatttttcctgagaaaactcacctctcgcgaaaacctgcttctgggcgtggggctcgccatggctacaaccctgcagctgcctgaggatatcgaacaaatggccaatggaattgctcttggcctgatggccctcaagctgatcacccagtttgagacataccagctctggacggcgctgatttcccttacctgtagcaacacaatcttcaccctgacagtggcctggcggaccgctacgctcattctggccggcgtctccctgcttccggtttgccagtctagctccatgagaaaaacagactggctgcccatggctgtggccgccatgggggtgcctcccctccctctgtttatcttctctctcaaggataccctgaagcgcagaagctggccccttaatgagggagtcatggctgtgggcctggtttccatcctggcgtctagcctcctgcggaacgacgtgcctatggccgggccccttgtcgctggaggcctgctcattgcctgttatgtgatcaccgggacatccgccgatctgaccgttgaaaaagctgccgacattacatgggaggaagaggcggaacaaacgggagtgagccataacctcatgatcaccgtcgacgatgacggcacaatgcgcattaaggatgacgagaccgagaatatcctgacagtgcttctgaaaaccgctctgctcatcgtctctggcatttttccgtactccatccctgccacgctgcttgtgtggcacacctggcagaagcagacacagagaagcggggttctgtgggatgtgccctctcctcccgaaacccaaaaagccgagctcgaagagggagtctaccggattaagcagcagggcatcttcgggaaaacacaggtgggagttggcgtgcaaaaggagggggtctttcacaccatgtggcatgtgacacgcggagctgtgctgacgtataacggcaagagactcgaaccgaattgggcctccgttaaaaaggacctgattagctacggcgggggatggcggctttctacccagtggcagaaaggcgaggaagtccaagtgatcgcggtggagcctgggaagaaccccaaaaatttccagacaatgcctggaaccttccagaccacaacgggcgaaattggggctatcgccctggattttaagcccggaacctccggcagccccatcattaaccgcgagggcaaggtcgtggggctgtatggaaatggcgttgtgaccaagaacgggggatacgtctccggcatcgcccagaccaatgctgagcctgacgggccgacacccgaactcgaggaagagatgttcaagaaaagaaacctgaccattatggatcttcaccctggcagcggaaagacgcggaaatatctgcccgccatcgtgcgcgaagctattaagagacggctcagaacactgatcctcgcccctacccgcgttgtggcggccgagatggaggaagctctgaagggccttcccatccggtaccaaaccacagccaccaaatctgagcatacagggagagaaattgtcgacctgatgtgccacgctacctttacgatgcgcctgctcagccctgtgcgggttccgaattataacctgatcattatggatgaggcccatttcacagaccccgcctccatcgctgcgagaggatacatttctacccgcgtgggcatgggggaagccgctgccatctttatgacagccacccctcccggaacggctgatgccttccctcagagcaatgcgcccatccaggacgaggagcgggacattccggaaagatcctggaactctggcaatgagtggatcaccgattttgctgggaagacagtctggttcgtgcctagcattaaagccggcaacgacatcgccaactgtcttcgcaagaatggcaaaaaggtgattcagctgtcccggaagacctttgatacagaataccagaaaacaaagctcaacgactgggatttcgtcgttacaaccgacatctctgagatgggagctaattttaaagccgatagagtgattgacccccggcgctgcctgaagcccgtgatcctgacggatgggcctgagagagtcatcctcgcgggacccatgcctgtgacagccgctagcgccgctcagcggcgcggcagagttgggcggaacccgcagaaagaaaatgaccagtatattttcaccggacaaccccttaacaatgatgaggaccacgcccactggaccgaagctaagatgctgctggacaacatcaatacacctgagggcattatccccgccctcttcgaacctgagagagagaagtccgcggccattgatggggaataccgcctgaaaggcgagagccggaagacctttgtggaacttatgagacgcggagacctgcccgtctggctcgctcataaagtggcctctgagggcatcaagtatacagatcggaaatggtgcttcgacgggcagagaaacaatcagatcctggaagagaacatggatgttgagatttggacgaaggaaggagagaaaaagaagctgcgcccgcggtggctcgacgctagaacctactccgatcctcttgccctgaaagaatttaaggacttcgccgctggccgcaaaagcatcgcgctggatctcgtgacagagattgggagagtcccctctcacctggcccatcggacccgcaatgctcttgacaacctggtgatgctccacacatccgaacacggaggcagagcctatcggcatgccgtcgaggagctgcctgaaaccatggagacgctgctccttctgggcctgatgatcctcctgaccgggggagctatgctttttctgattagcggcaaggggatcggaaaaacatccatcggcctcatttgtgtgatcgcctctagcgggatgctgtggatggcggaaattcccctgcagtggatcgcctccgctattgttctcgagttctttatgatggtgcttctgatccctgagcccgaaaagcaacgcaccccgcaggataatcagctggcctacgtggtcattggaatcctcacactggctgccatcattgcggccaacgagatgggccttctggaaaccacgaagagagacctcggcatgagcaaagagcctggggttgtgtctcccacatcctatctggatgtggacctgcaccccgctagcgcctggaccctctacgctgtcgccacaaccgtgatcacccctatgcttcggcatacaattgaaaattctacggctaacgttagcctggccgcgatcgccaaccaagctgtggtcctgatgggactcgacaagggctggccgatttccaaaatggatctgggggtgccccttctggccctcggatgctactctcaggtcaatcctctgaccctgacagctgccgtgctccttctgatcacccactatgccatcattggccccgggctgcaggcgaaggctacaagagaggcccagaaacgcaccgctgccggaatcatgaagaaccctacggttgacggcattatgacaatcgatctcgaccccgtgatttacgatagcaagttcgagaaacaactgggccaggtcatgcttctggtgctctgtgccgttcagctgctgctcatgcggacctcctgggctctttgcgaagccctgaccctggcgacagggcctatcaccacactctgggagggatctccgggcaagttttggaatacgaccatcgccgtgagcatggctaacattttcagagggtcctatctggccggagctggccttgcctttagcatcatgaaatctgtcgggacaggaaagcgcggcaccggctcccagggggaaacactgggagagaaatggaagaagaaactcaatcaactgagccggaaggagttcgacctgtacaaaaagtccggcattaccgaggtggatagaacggaggcgaaagaagggctcaagcggggagagatcacccatcacgccgtgtctcgcggcagcgctaaacttcagtggtttgttgaaagaaacatggtcattcccgaggggcgggtgatcgacctgggatgtggccgcggcgggtggtcctattactgcgccggactgaagaaggtgacagaagtcagaggctataccaaagggggacctggccacgaggagcccgttcctatgtctacatacgggtggaatattgtgaagctcatgagcggaaaagatgtgttctacctgcccccggaaaagtgtgacacccttctgtgcgatatcggcgagtccagcccttctcccacagtcgaagagtcccggaccatccgcgtgctcaaaatggttgagccctggctgaagaacaatcagttctgtattaaggtgctgaacccttatatgcccacggtcatcgaacatctcgagagacttcagcggaaacacggcgggatgctggtgcgcaatcctctgagcagaaactctacacatgaaatgtactggatttccaatggaaccggcaacatcgttgctagcgtgaatatggtctctcggctcctgcttaacagatttaccatgacacaccgccggccgacgattgagaaggacgtggatctgggggccggaaccagacacgtgaacgctgaacccgagacacctaatatggacgtcatcggcgagcgcatcaaacggattaaggaagaacacaacagcacctggcactatgacgatgaaaatccctacaaaacatgggcctatcatgggtcctacgaggttaaggcgaccggatctgccagctccatgatcaacggcgtggtgaagctcctgacaaaaccttgggacgtcgtgcccatggttacccaaatggctatgacggataccacaccgttcggccagcagagagtgtttaaggaaaaagtcgacacccgcacacctcggagcatgcccgggaccagacgcgtgatgggaattacggccgagtggctgtggcggacactcggcagaaataagaaacctcgcctgtgcacccgggaggagttcacaaagaaggttagaaccaacgctgccatgggggccgtgtttacggaggaaaatcaatgggattccgcgaaagctgccgtcgaggacgaagatttctggaaacttgtggaccgcgagagagagctgcacaaactcggaaagtgtggctcttgcgtttataacatgatggggaaacgggaaaagaaactgggcgagtttggaaaggccaagggcagccgcgctatctggtacatgtggcttggggccagatacctggagttcgaggctctcggatttctgaatgaggatcattggttctcccgggaaaactcttatagcggcgtggagggggaaggactgcacaaactcggctacattctgagagacatctccaagatccccgggggcgccatgtatgcggatgacaccgccggatgggacacacggattaccgaggatgaccttcacaatgaagagaaaatcacacagcagatggatcctgagcatcgccagctggctaacgccatttttaagctcacctaccaaaataaagtcgtgaaggtccagagacccacaccgaccggcacggtgatggacatcatttctcggaaggatcagcgcgggagcggacaggttggcacatatgggctgaacaccttcaccaatatggaagctcaacttatcagacagatggagggagaaggcgtgctgtccaaagccgacctcgagaaccctcatctgcccgaaaagaaaatcacacagtggctggagaccaagggggtcgagcggctcaaacgcatggcgattagcggcgatgactgcgtggtgaagcccatcgatgacagatttgccaacgctctgcttgccctgaatgatatgggaaaggttcggaaagacattcctcagtggcaaccgtctaagggctggcatgattggcaacaggtgcccttctgttcccaccacttccatgaactcatcatgaaagacgggcgcaagctggtcgtgccttgcagaccccaggacgagcttattggacgggctcgcatcagccaaggcgccgggtggtctctgagagaaacagcttgtctcggaaaagcctacgcgcagatgtggtccctgatgtattttcaccggcgcgatctgagactcgccagcaacgctatttgctctgccgttcctgtgcattgggtccccacgtcccggaccacatggagcatccacgcccatcaccagtggatgaccacagaggacatgctgaccgtgtggaatagagtctggatcgaagataacccttggatggaggacaagacgcccgtgaccacatgggaggatgttccgtaccttggcaagcgcgaagaccaatggtgtgggtccctgattggcctcaccagccgggctacatgggcccagaatatccctaccgcgattcaacaggtgagatctctgatcggaaacgaggagttccttgattacatgcccagcatgaaacgctttcggaaggaggaggaatccgagggcgctatttggtga

SEQ ID NO: 20634 - RNA, 9873 nt, synthetic construct
  misc_feature 1..9873: note = derived and/or modified CDS sequence (opt5) from DENV-3__KJ189286__SS-prME
  source 1..9873: mol_type = other RNA
accagcttctgcctgatgatgatcctccccgccgctctggcctttcaccttacatcccgggacggcgagcctcggatgattgtggggaagaatgaacgcggaaaatctctcctgttcaagacggcgagcggcatcaatatgtgtaccctgattgctatggatcttggggagatgtgcgacgatacagtgacctacaaatgtccgcatatcacagaagttgagcccgaagacattgattgctggtgtaacctgacctccacatgggtgacctatggaacgtgcaatcaggccggcgagcaccggcgggacaagcgctctgtggccctcgctcctcatgtcgggatgggactggataccagaacacaaacctggatgagcgccgagggcgcttggagacaggtggaaaaagttgagacatgggccctgcgccaccccggctttaccatcctcgcgctgttccttgcccattacatcgggacgtccctgacacagaaggtggtcatttttatcctcctgatgcttgtgaccccttctatgacaatgagatgtgttggagtgggcaaccgggacttcgtcgaagggctgagcggagctacctgggtggatgtggtcctcgagcacggcgggtgcgttaccacaatggccaagaataaacccacgctggacattgagctgcagaagaccgaagctacacaactcgccaccctgcgcaaactttgtatcgagggaaagattacaaacatcaccacggattccagatgccctacacagggcgaagcggtgctgccggaggaacaggaccagaattatgtgtgtaaacacacctacgtcgatcggggctgggggaacggatgcggcctctttgggaagggaagcctggtgacctgcgccaagttccaatgtcttgagcccattgagggcaaagttgtgcagtatgaaaatctgaagtacacagtcatcatcaccgtgcatacaggggaccagcaccaggttggaaacgagacgcaaggcgtgaccgctgaaattacacctcaggcctctaccacagaggctaccctccccgaatatggcacgctggggctggagtgctcccctcgcaccggactcgactttaatgagatgatcctgcttacaatgaaaaacaaggcctggatggtccatagacagtggttctttgatctgcccctcccgtggaccagcggcgccacaaccgaaacgcctacatggaatcggaaagagctgcttgtgaccttcaagaacgctcacgcgaaaaagcaagaagtcgtggttctggggtctcaggagggagccatgcacacagctctcaccggcgccaccgaaattcaaaattccgggggcacaagcatctttgccggacatctgaagtgtcgcctgaaaatggacaagctcgagctgaaaggcatgtcttacgctatgtgcacgaacaccttcgtgcttaagaaagaggtctccgaaacacagcacgggaccattctgatcaaggtggagtacaagggagaagatgccccctgtaaaatccctttcagcacagaggacggccatgggaaggcgcacaacggaagactcattaccgctaatcccgttgtgacgaaaaaggaggaacccgtcaacatcgaggccgaacctccgtttggcgagtccaatattgtgatcgggattggcgataacgccctgaaaatcaattggtataagaagggatctagcatcggcaaaatgttcgaagctacagccagaggggctagacgcatggccattctgggagacaccgcgtgggattttggctccgtcgggggagttcttaacagcctcggcaagatggtccatcaaatcttcgggtctgcctacaccgctctgttttccggcgtgagctgggtgatgaaaattggaatcggcgtcctgctcacatggattgggctcaattctaagaacaccagcatgtccttctcttgcatcgccattggaatcatcacactttatctgggcgctgtggttcaggccgacatggggtgtgtgattaattggaaaggaaaggagctcaagtgcggcagcgggatctttgtcacgaacgaggtgcacacctggacagaacagtacaaattccaggcggattcccccaagcggctggccaccgctattgccggcgcttgggagaatggagtttgtggcatcagaagcacaacccgcatggaaaacctgctttggaaacaaattgccaatgagctcaactatatcctgtgggaaaataacatcaagctgacggtggtcgtgggggacattatcggagttctcgagcagggcaaacggaccctgacacctcagcccatggagcttaagtactcttggaaaacctgggggaaggccaagattgtgacagctgaaacccagaactccagctttatcattgatggacctaatacacccgagtgcccgtctgcgtccagagcctggaacgtctgggaagtggaggactatggcttcggcgtgtttaccacgaatatctggctgcgcctccgggaagtctacacacaactgtgtgaccacagactgatgagcgctgccgttaaagatgagcgcgccgtgcatgctgacatggggtactggatcgagtcccagaagaacggatcttggaaacttgaaaaggccagcctcattgaggtgaaaacctgcacctggcctaagtcccacacactgtggtctaatggcgtcctggaaagcgatatgatcattcccaagtccctcgcggggcctatcagccagcataaccaccggcccggatatcacacccagacggctggcccttggcatctggggaaacttgagctggacttcaattactgcgagggaacaaccgtggttattacagaaaactgtggcaccagaggcccctctctccgcacaaccacggtgtccgggaagctgatccacgagtggtgctgtcggagctgcaccctgccgcctcttagatatatgggagaagatggctgttggtacgggatggagatccggcccatttctgaaaaagaggagaatatggtcaagtccctcgtgagcgccggatctggcaaagttgacaactttacaatgggggtgctgtgcctggccatcctcttcgaagaggtcatgcgcggaaagttcggcaagaaacatatgattgctggcgtgtttttcacctttgttctgcttctgagcgggcaaatcacatggagagatatggcccacaccctcattatgatcggatccaatgcgagcgaccggatgggcatgggggtgacgtatctggctctgattgccacattcaagatccagccctttcttgccctgggattctttctcagaaaactgacctctcgcgaaaacctcctgcttggcgtcgggctggctatggccacaaccctccagctgcctgaggatatcgaacaaatggctaatggaattgccctgggccttatggcgctgaagctcatcacccagttcgagacataccagctgtggacggccctcatttccctgacctgtagcaacacaatctttacccttacagtggcttggcggaccgccacgctgattctcgctggcgtgtccctgctgccggtctgccagtctagctccatgagaaaaacagactggcttcccatggccgttgccgctatgggggtgcctcccctgcctctcttcatctttaatctgaaggataccctcaagcgcagatcttggcccctgaacgagggagtgatggcggtcggccttgtgagcatcctggcctcctctctgctccggaacgacgttcctatggctgggcccctggtggccggaggccttctgattgcctgttatgtcatcaccgggacaagcgctgatctcaccgtggaaaaagccgcggacattacatgggaggaagaggctgaacaaacgggagtttcccataatctgatgatcaccgtggacgatgacggcacaatgcgcattaaggatgacgagaccgagaacatcctcacagtcctgcttaaaaccgccctgctgatcgtgagcggcattttcccgtactctatccctgccacgctcctggtctggcacacctggcagaagcagacacagagatccggggtgctttgggatgttcccagccctcccgaaacccaaaaagctgagctggaagagggagtgtaccggattaagcagcagggcatctttgggaaaacacaggtcggagtgggcgttcaaaaggagggggtgttccacaccatgtggcatgtcacacgcggagccgtgctcacgtataatggcaagagactggaaccgaactgggcgtctgtgaaaaaggacctcatttcctacggcgggggatggcggctgagcacccagtggcagaaaggcgaggaagttcaagtcatcgctgtggagcctgggaagaatcccaaaaacttccagacaatgcctggaacctttcagaccacaacgggcgaaattggggccatcgcccttgatttcaagcccggaacctctggctcccccatcattaatcgcgagggcaaggtggtcgggctgtatggaaacggcgtggttaccaaaaatgggggatacgtgagcggcatcgctcagaccaacgccgagcctgacgggccgacacccgaactggaggaagagatgtttaagaaaagaaatctcaccattatggatctgcaccctggctccggaaagacgcggaaatatcttcccgctatcgtccgcgaagccattaagagacggctgagaacactcatcctggcgcctacccgcgtggttgccgctgagatggaggaagccctcaagggcctgcccatccggtaccaaaccacagctaccaaaagcgagcatacagggagagaaattgtggaccttatgtgccacgccaccttcacgatgcgcctgctgtctcctgtccgggtgccgaactataatctcatcattatggatgaggcccattttacagaccccgctagcatcgcggccagaggatacatttccacccgcgttggcatgggggaagctgccgccatcttcatgacagctacccctcccggaacggccgatgcgtttcctcagtctaacgctcccatccaggacgaggagcgggacattccggaaagaagctggaactccggcaacgagtggatcaccgatttcgccgggaagacagtgtggtttgtcccttctattaaagccggcaacgacatcgctaattgtctgcgcaagaacggcaaaaaggtgattcagcttagccggaagaccttcgatacagaataccagaaaacaaagctgaatgactgggattttgtggtcacaaccgacatctccgagatgggagccaacttcaaagcggatagagttattgacccccggcgctgcctcaagcccgtgatcctgacggatgggcctgagagagtgatcctggccggacccatgcctgtcacagctgcctctgctgcccagcggcgcggcagagtggggcggaatccgcagaaagaaaacgaccagtatattttcaccggacaacccctcaataacgatgaggaccacgctcactggaccgaagccaagatgcttctggacaatatcaacacacctgagggcattatccccgcgctgtttgaacctgagagagaaaagagcgccgctattgatggggaataccgcctcaaaggcgagtcccggaagaccttcgttgaactgatgagacgcggagaccttcccgtgtggctggcccataaagtcgctagcgagggcatcaagtatacagatcggaaatggtgctttgacgggcagagaaataaccagatcctcgaagagaatatggatgtggagatttggacgaaggaaggagagaaaaagaagctgcgcccgcggtggctggacgccagaacctactctgatcctctcgcccttaaagagttcaaggactttgctgcgggccgcaaatccatcgccctggatctggttacagagattgggagagtgcccagccacctcgctcatcggacccgcaacgccctggacaatcttgtcatgctgcacacatctgaacacggaggcagagcctatcggcatgctgtggaggagctccctgaaaccatggagacgctgctgctccttggcctgatgatcctgctcaccgggggagccatgctgttccttatttccggcaaggggatcggaaaaacaagcatcggcctgatttgtgtcatcgcgtcctctgggatgctctggatggccgaaattcccctgcagtggatcgctagcgccattgtgctggagtttttcatgatggttctccttatccctgagcccgaaaagcaacgcaccccgcaggataaccagctggcttacgtggtgattggaatcctgacactcgccgcgatcattgccgctaatgagatgggcctgcttgaaaccacgaagagagacctgggcatgtccaaagagcctggggtcgttagccccacatcttatctcgatgtggacctgcaccccgcctccgcttggaccctgtacgccgtggctacaaccgtcatcacccctatgctccggcatacaattgaaaacagcacggccaacgtgtctcttgcggccatcgctaatcaagccgttgtgctgatgggactggacaagggctggccgattagcaaaatggatctcggggtccccctgcttgctctgggatgctactcccaggtgaaccctctcaccctgacagccgccgtcctgctccttatcacccactatgcgatcattggccccgggctgcaggctaaggccacaagagaggctcagaaacgcaccgccgccggaatcatgaagaatcctacggtggacggcattatgacaatcgatctggaccccgttatttacgattctaagtttgagaaacaactcggccaggtgatgctgcttgtcctgtgtgctgtgcagctcctgctgatgcggaccagctgggccctctgcgaagcgcttaccctggccacagggcctatcaccacactgtgggagggatccccgggcaagttctggaacacgaccatcgctgtttctatggccaatatttttagagggagctatctcgctggagccggcctggcgttctccatcatgaaaagcgtggggacaggaaagcgcggcaccggctctcagggggaaacacttggagagaaatggaagaagaaactgaaccaactctcccggaaggaatttgacctgtacaaaaagagcggcattaccgaggtcgatagaacggaggccaaagaagggctgaagcggggagagatcacccatcacgctgtgtcccgcggctctgccaaactccagtggttcgtggaaagaaatatggttattcccgaggggcgggtcatcgaccttggatgtggccgcggcgggtggagctattactgcgctggactgaagaaggtgacagaagtgagaggctataccaaagggggacctggccacgaggagcccgtccctatgtccacatacgggtggaacattgttaagctgatgtctggaaaagatgtgttctacctgcccccggaaaagtgtgacaccctgctttgcgatatcggcgagagctcccctagccccacagtggaagagtctcggaccatccgcgtcctgaaaatggtggagccctggctcaagaataaccagttttgtattaaggttctgaatccttatatgcccacggtgatcgaacatctggagagactccagcggaaacacggcgggatgcttgtccgcaaccctctgtccagaaatagcacacatgaaatgtactggatttctaacggaaccggcaatatcgtggcctccgttaacatggtgagccggctgctcctgaacagattcaccatgacacaccgccggccgacgattgagaaggacgtcgatcttggggctggaaccagacacgtgaatgccgaacccgagacacctaacatggacgtgatcggcgagcgcatcaaacggattaaggaggaacataattctacctggcactatgacgatgaaaacccctacaaaacatgggcgtatcatgggagctacgaggtcaaggccaccggatccgcttctagcatgatcaatggcgttgtgaagctgctcacaaaaccttgggacgtggtccccatggtgacccaaatggccatgacggataccacaccgtttggccagcagagagttttcaaggaaaaagtggacacccgcacacctcggtccatgcccgggaccagacgcgtcatgggaattacggctgagtggctgtggcggacactgggcagaaacaagaaacctcgcctctgcacccgggaggaatttacaaagaaggtgagaaccaatgccgccatgggggcggttttcacggaggaaaaccaatgggatagcgctaaagccgccgtggaggacgaagatttttggaagctggtcgaccgcgagagagagcttcacaaactgggaaagtgtggctcctgcgtgtataatatgatggggaaacgggaaaagaaactcggcgagttcggaaaggctaagggctctcgcgccatctggtacatgtggctgggggctagataccttgaatttgaggccctgggattcctcaacgaggatcattggtttagccgggaaaattcctattctggcgttgagggggaaggactgcacaaactgggctacattctcagagacatcagcaagatccccgggggcgcgatgtatgccgatgacaccgctggatgggacacacggattaccgaggatgacctgcacaacgaagagaaaatcacacagcagatggatcctgagcatcgccagcttgccaatgctattttcaagctgacctaccaaaacaaagtggtcaaggtgcagagacccacaccgaccggcacggtcatggacatcatttcccggaaggatcagcgcgggtctggacaggtgggcacatatgggctcaatacctttaccaacatggaagcccaactgatcagacagatggagggagaaggcgttcttagcaaagcggacctggagaaccctcacctccccgaaaagaaaatcacacagtggctggagaccaagggggtggagcggctgaaacgcatggccatttccggcgatgactgcgtcgtgaagcccatcgatgacagattcgctaatgccctcctggctcttaacgatatgggaaaggtgcggaaagacattcctcagtggcaaccgagcaagggctggcatgattggcagcaggttcccttctgttctcaccactttcatgaactgatcatgaaagacgggcgcaagctcgtggtcccttgcagaccccaggacgagctgattggacgggcccgcatctcccaaggcgctgggtggagccttagagaaacagcctgtctgggaaaagcgtacgcccagatgtggtctctcatgtatttccaccggcgcgatctgagactggcttccaatgccatttgcagcgccgtgcctgttcattgggtgcccacgtctcggaccacatggtccatccacgctcatcaccagtggatgaccacagaggacatgctcaccgtctggaacagagtgtggatcgaagataatccttggatggaggacaagacgcccgtcaccacatgggaggatgtgccgtacctgggcaagcgcgaagaccaatggtgtgggagccttattggcctgacctcccgggccacatgggcgcagaacatccctaccgctattcagcaggttagaagcctcatcggaaatgaggaatttctggattacatgccctctatgaaacgcttccggaaggaggaggaaagcgagggcgccatttggtga

SEQ ID NO: 20635 - RNA, 9873 nt, synthetic construct
  misc_feature 1..9873: note = derived and/or modified CDS sequence (opt5) from DENV-3__KJ189287__SS-prME
  source 1..9873: mol_type = other RNA
accagcctgtgcctcatgatgatcctgcccgccgctcttgccttccacctgacatcccgggacggagaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggcattctggagcagggcaaacggacccttacacctcagcccatggagctgaagtactcttggaaaacctgggggaaggccaagatcgttacagctgaaacccagaactccagcttcattatcgatggacctaatacacccgagtgcccgtctgcgtccagagcctggaacgtgtgggaagtcgaggactatggctttggcgtgttcaccacgaatatctggctccgcctgcgggaagtgtacacacaactgtgtgaccacagacttatgagcgctgccgtcaaagatgagcgcgccgttcatgctgacatggggtactggattgagtcccagaagaacggatcttggaaactcgaaaaggccagcctgatcgaggtgaaaacctgcacctggcctaagtcccacacactgtggtctaatggcgtgctcgaaagcgatatgattatccccaagtccctggcggggcctattagccagcataaccaccggcccggatatcacacccagacggctggcccttggcatcttgggaaactggagctcgactttaattactgcgagggaacaaccgtcgtgatcacagaaaactgtggcaccagaggcccctctctgcgcacaaccacggtttccgggaagctgatccacgagtggtgctgtcggagctgcacccttccgcctctcagatatatgggagaagatggctgttggtacgggatggagattcggcccatctctgaaaaagaggagaatatggtgaagtccctggtcagcgccggatctggcaaagtggacaacttcacaatgggggttctgtgcctcgccattctgtttgaagaggtgatgcgcggaaagttcggcaagaaacatatgatcgctggcgtcttctttaccttcgtgcttctgctcagcgggcaaattacatggagaaatatggcccacaccctgatcatgattggatccaacgcgagcgatcggatgggcatgggggttacgtatctggctcttatcgccacatttaagatccagcccttcctggtgctcggatttttcctgagaaaactcacctctcgcgaaaatctgcttctgggcgtcgggctcgccatggctacaaccctgcagctgcctgaggacattgaacaaatggccaacggaatcgctcttggcctgatggccctcaagctgattacccagtttgagacataccagctctggacggcgctgatctcccttacctgtagcaatacaattttcaccctgacagtggcctggcggaccgctacgctcatcctggccggcgtgtccctgcttccggtctgccagtctagctccatgagaaaaacagattggctgcccatggctgttgccgccatgggggtgcctcccctccctctgtttatcttctctctcaaggacaccctgaagcgcagaagctggccccttaacgagggagtgatggctgtcggcctggtgtccattctggcgtctagcctcctgcggaacgatgttcctatggccgggccccttgtggctggaggcctgctcatcgcctgttatgtcattaccgggacatccgccgacctgaccgtggaaaaagctgccgatatcacatgggaggaagaggcggaacaaacgggagttagccataatctcatgattaccgtggacgacgatggcacaatgcgcatcaaggacgatgagaccgagaacatcctgacagtccttctgaaaaccgctctgctcattgtgtctggcatctttccgtactccattcctgccacgctgcttgtctggcacacctggcagaagcagacacagagaagcggggtgctgtgggacgttccctctcctcccgaaacccaaaaagccgagctcgaagagggagtgtaccggatcaagcagcagggcattttcgggaaaacacaggtcggagtgggcgttcaaaaggagggggtgtttcacaccatgtggcatgtcacacgcggagctgtgctgacgtataatggcaagagactcgaaccgaactgggcctccgtgaaaaaggatctgatcagctacggcgggggatggcggctttctacccagtggcagaaaggcgaggaagttcaagtcattgcggtggagcctgggaagaatcccaaaaacttccagacaatgcctggaaccttccagaccacaacgggcgaaatcggggctatcgccctggactttaagcccggaacctccggcagccccattatcaatcgcgagggcaaggtggtcgggctgtatggaaacggcgtggttaccaagaatgggggatacgtgtccggcattgcccagaccaacgctgagcctgatgggccgacacccgaactcgaggaagagatgttcaagaaaagaaatctgaccatcatggaccttcaccctggcagcggaaagacgcggaaatatctgcccgccattgtccgcgaagctatcaagagacggctcagaacactgatcctcgcccctacccgcgtggttgcggccgagatggaggaagctctgaagggccttcccattcggtaccaaaccacagccaccaaatctgagcatacagggagagaaatcgtggatctgatgtgccacgctacctttacgatgcgcctgctcagccctgtccgggtgccgaactataatctgattatcatggacgaggcccatttcacagatcccgcctccattgctgcgagaggatacatctctacccgcgttggcatgggggaagccgctgccatctttatgacagccacccctcccggaacggctgacgccttccctcagagcaacgcgcccattcaggatgaggagcgggacatcccggaaagatcctggaactctggcaacgagtggattaccgactttgctgggaagacagtgtggttcgtccctagcatcaaagccggcaacgatattgccaattgtcttcgcaagaacggcaaaaaggtgatccagctgtcccggaagacctttgacacagaataccagaaaacaaagctcaatgattgggacttcgtggtcacaaccgatatttctgagatgggagctaactttaaagccgacagagttatcgatccccggcgctgcctgaagcccgtgatcctgacggacgggcctgagagagtgattctcgcgggacccatgcctgtcacagccgctagcgccgctcagcggcgcggcagagtggggcggaatccgcagaaagaaaacgatcagtatatcttcaccggacaaccccttaataacgacgaggatcacgcccactggaccgaagctaagatgctgctggacaatattaacacacctgagggcatcattcccgccctcttcgaacctgagagagagaagtccgcggccatcgacggggaataccgcctgaaaggcgagagccggaagacctttgttgaacttatgagacgcggagatctgcccgtgtggctcgctcataaagtcgcctctgagggcatcaagtatacagaccggaaatggtgcttcgatgggcagagaaataaccagattctggaagagaatatggacgtggagatctggacgaaggaaggagagaaaaagaagctgcgcccgcggtggctcgatgctagaacctactccgaccctcttgccctgaaagaatttaaggatttcgccgctggccgcaaaagcattgcgctggacctcgttacagagatcgggagagtgccctctcacctggcccatcggacccgcaacgctcttgataatctggtcatgctccacacatccgaacacggaggcagagcctatcggcatgccgtggaggagctgcctgaaaccatggagacgctgctccttctgggcctgatgattctcctgaccgggggagctatgctttttctgatcagcggcaaggggatcggaaaaacatccattggcctcatctgtgtcattgcctctagcgggatgctgtggatggcggaaatccccctgcagtggattgcctccgctatcgtgctcgagttctttatgatggttcttctgattcctgagcccgaaaagcaacgcaccccgcaggacaaccagctggcctacgtggtgatcggaatcctcacactggctgccattatcgcggccaatgagatgggccttctggaaaccacgaagagagatctcggcatgagcaaagagcctggggtcgtttctcccacatcctatctggacgtggatctgcaccccgctagcgcctggaccctctacgctgtggccacaaccgtcattacccctatgcttcggcatacaatcgaaaactctacggctaacgtgagcctggccgcgattgccaatcaagctgttgtgctgatgggactcgacaagggctggccgatctccaaaatggacctgggggtcccccttctggccctcggatgctactctcaggtgaaccctctgaccctgacagctgccgtcctccttctgatcacccactatgccattatcggccccgggctgcaggcgaaggctacaagagaggcccagaaacgcaccgctgccggaattatgaagaatcctacggtggatggcatcatgacaattgacctcgatcccgttatctacgacagcaagttcgagaaacaactgggccaggtgatgcttctggtcctctgtgccgtgcagctgctgctcatgcggacctcctgggctctttgcgaagccctgaccctggcgacagggcctatcaccacactctgggagggatctccgggcaagttttggaacacgaccattgccgttagcatggctaatatcttcagagggtcctatctggccggagctggccttgcctttagcattatgaaatctgtggggacaggaaagcgcggcaccggctcccagggggaaacactgggagagaaatggaagaagaaactcaaccaactgagccggaaggagttcgatctgtacaaaaagtccggcatcaccgaggtcgacagaacggaggcgaaagaagggctcaagcggggagagattacccatcacgccgtgtctcgcggcagcgctaaacttcagtggtttgtggaaagaaatatggttatccccgaggggcgggtcattgatctgggatgtggccgcggcgggtggtcctattactgcgccggactgaagaaggtgacagaagtgagaggctataccaaagggggacctggccacgaggagcccgtccctatgtctacatacgggtggaacatcgttaagctcatgagcggaaaagacgtgttctacctgcccccggaaaagtgtgatacccttctgtgcgacatcggcgagtccagcccttctcccacagtggaagagtcccggaccattcgcgtcctcaaaatggtggagccctggctgaagaataaccagttctgtatcaaggttctgaatccttatatgcccacggtgattgaacatctcgagagacttcagcggaaacacggcgggatgctggtccgcaaccctctgagcagaaattctacacatgaaatgtactggatctccaacggaaccggcaatattgtggctagcgttaacatggtgtctcggctcctgcttaacagatttaccatgacacaccgccggccgacgatcgagaaggatgtcgacctgggggccggaaccagacacgtgaatgctgaacccgagacacctaacatggatgtgatcggcgagcgcattaaacggatcaaggaagaacacaatagcacctggcactatgacgacgaaaacccctacaaaacatgggcctatcatgggtcctacgaggtcaaggcgaccggatctgccagctccatgattaatggcgttgtgaagctcctgacaaaaccttgggatgtggtccccatggtgacccaaatggctatgacggacaccacaccgttcggccagcagagagtttttaaggaaaaagtggatacccgcacacctcggagcatggccgggaccagacgcgtcatgggaatcacggctgagtggctgtggcggacactcggcagaaacaagaaaccccgcctgtgcacccgggaggagttcacaaagaaggtgagaaccaatgccgccatgggggcggtttttacggaggaaaaccaatgggactccgctaaagccgccgtggaggatgaagacttctggaaacttgtcgatcgcgagagagagctgcacaaactcggaaagtgtggctcttgcgtgtataatatgatggggaaacgggaaaagaaactgggcgagtttggaaaggctaagggcagccgcgccatttggtacatgtggcttggggctagatacctggagttcgaggccctcggatttctgaacgaggaccattggttctcccgggaaaattcttatagcggcgttgagggggaaggactgcacaaactcggctacatcctgagagatatctccaagattcctgggggcgcgatgtatgccgacgataccgctggatgggacacacggatcaccgaggacgatcttcacaacgaagagaaaattacacagcagatggaccccgagcatcgccagctggccaatgctatctttaagctcacctaccaaaacaaagtggtcaaggtgcagagacctacacccaccggcacggtcatggatattatctctcggaaggaccagcgcgggagcggacaggtgggcacatatgggctgaataccttcaccaacatggaagcccaacttatcagacagatggagggagaaggcgttctgtccaaagcggatctcgagaacccgcatctgcctgaaaagaaaattacacagtggctggagaccaagggggtggagcggctcaaacgcatggccatcagcggcgacgattgcgtcgtgaagcccattgacgatagatttgctaatgccctgcttgctctgaacgacatgggaaaggtgcggaaagatatcccccagtggcaaccttctaagggctggcatgactggcagcaggttccgttctgttcccaccacttccatgaactcattatgaaagatgggcgcaagctggtggtcccctgcagacctcaggacgagcttatcggacgggcccgcattagccaaggcgctgggtggtctctgagagaaacagcctgtctcggaaaagcgtacgcccagatgtggtccctgatgtattttcaccggcgcgacctgagactcgctagcaatgccatctgctctgccgtgcccgttcattgggtgcctacgtcccggaccacatggagcatccacgctcatcaccagtggatgaccacagaggatatgctgaccgtctggaacagagtgtggattgaagacaatccctggatggaggataagacgcctgtcaccacatgggaggacgtgccctaccttggcaagcgcgaagatcaatggtgtgggtccctgatcggcctcaccagccgggccacatgggcgcagaacattccgaccgctatccagcaggttagatctctgattggaaatgaggagttccttgactacatgcctagcatgaaacgctttcggaaggaggaggaatccgagggcgccatctggtga

SEQ ID NO: 20636 - RNA, 9873 nt, synthetic construct
  misc_feature 1..9873: note = derived and/or modified CDS sequence (opt5) from DENV-3__KJ189288__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaaatctctcctgtttaagacggcgagcggcaccaatatgtgtacacttatcgctatggatctgggggaaatgtgcgacgataccgtgacatacaaatgtccgcatattaccgaagttgaacccgaagacatcgattgctggtgtaacctcacatccacctgggtgacgtatggaacctgcaatcaggccggcgaacacagacgggacaagcgctctgtggccctggctcctcatgtcgggatgggactggatacaagaacccagacatggatgagcgccgagggcgcttggcggcaagtggaaaaagttgagacctgggccctccgccaccccggcttcacgattctggcgctttttctggcccattacatcgggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaaatggttcagtatgaaaatctcaagtacaccgtgattatcacagtccatacgggggaccagcaccaggtgggaaacgagacccaaggcgttacagctgaaatcacccctcaggcctctacaaccgaggctacgctgcccgaatatggcaccctggggctcgagtgctcccctcgcacaggactggacttcaatgagatgattcttctgaccatgaaaaacaaggcctggatggtgcatagacagtggtttttcgatctccccctgccgtggacaagcggcgccaccacggaaacacctacctggaatcggaaagagcttctggtcacatttaagaacgctcacgcgaaaaagcaagaagtggtcgtgctcgggtctcaggagggagccatgcacaccgctctgaccggcgccacagaaatccaaaattccgggggcacgagcattttcgccggacatctgaagtgtcgcctcaaaatggacaagctggagcttaaaggcatgtcttacgctatgtgcaccaacacatttgttctgaagaaagaggtgtccgaaacccagcacgggacaatcctcattaaggtcgagtacaagggagaagatgccccctgtaaaatccctttcagcaccgaggacggccatgggaaggcgcacaacggaagactgatcacggctaatcccgtggttaccaagaaggaggaacccgtgaacattgaggccgaacctccgttcggcgagtccaatatcgtcattgggatcggcgataacgccctgaaaattaattggtataagaagggatctagcatcggcaaaatgtttgaagctaccgccagaggggctagacgcatggccatccttggagacaccgcgtgggatttcggctccgtcgggggagtgctcaacagcctgggcaagatggttcatcaaatttttgggtctgcctacacagctctgttctccggcgtcagctgggtgatgaaaatcggaattggcgtgctcctgacctggatcgggcttaattctaagaacacaagcatgtccttttcttgcattgccatcggaattatcacgctgtatctcggcgctgtcgtgcaggccgacatggggtgtgttatcaattggaaaggaaaggagctgaagtgcggcagcgggattttcgtgaccaacgaggtccacacatggaccgaacagtacaaatttcaggcggattcccccaagcggctggccacagctatcgccggcgcttgggagaatggagtgtgtggcattagaagcaccacgcgcatggaaaaccttctctggaaacaaatcgccaatgagctgaactatattctgtgggaaaataacgttaagctcaccgtggtcgtgggggacatcatcggagttctggagcagggcaaacggacacttacccctcagcccatggagctgaagtactcttggaaaacatgggggaaggccaagattgtgaccgctgaaacacagaactccagcttcatcattgatggacctaatacccccgagtgcccgtctgcgtccagagcctggaacgtctgggaagtggaggactatggctttggcgtgttcacgacaaatatctggctccgcctgcgggaggcttacacccaactgtgtgaccacagacttatgagcgccgccgtcaaagatgagcgcgctgttcatgccgacatggggtactggattgagtcccagaagaacggatcttggaaactcgaaaaggcgagcctgatcgaggtgaaaacctgcacatggcctaagtcccacaccctgtggtctaatggcgtgctcgaaagcgatatgatcattcccaagtccctggctgggcctatcagccagcataaccaccggcccggatatcacacgcagacagccggcccttggcatcttgggaaactggagctcgactttaattactgcgagggaaccacagtcgtgattaccgaaaactgtggcacaagaggcccctctctgcgcaccacgaccgtttccgggaagctgatccacgagtggtgctgtcggagctgcacacttccgcctctcagatatatgggagaagatggctgttggtacgggatggagattcggcccatctctgaaaaagaggagaatatggtgaagtccctggtcagcgccggatctggcaaagtggacaacttcaccatgggggttctgtgcctcgctatcctgtttgaagaggtgatgcgcggaaagttcggcaagaaacatatgattgccggcgtcttctttacattcgtgcttctgctcagcgggcaaatcacctggagagatatggcgcacacgctgattatgatcggatccaatgctagcgaccggatgggcatgggggttacatatctggcccttattgccacctttaagatccagcccttcctggctctcggatttttcctgagaaaactcacatctcgcgaaaacctgcttctgggcgtggggctcgccatggctaccaccctgcagctgcctgaggatattgaacaaatggccaatggaatcgcgcttggcctgatggccctcaagctgatcacacagtttgagacgtaccagctctggaccgctctgatttcccttacatgtagcaacaccatcttcacactgaccgtcgcctggcggacggctacactcattctggccggcgtgtccctgcttccggtgtgccagtctagctccatgagaaaaaccgactggctgcccatggccgtcgctgcgatgggggttcctcccctccctctgtttatcttctctctcaaggataccctgaagcgcagaagctggccccttaatgagggagtgatggccgtgggcctggtctccattctggcttctagcctcctgcggaacgacgtgcctatggccgggccccttgttgccggaggcctgctcatcgcttgttatgtgatcacagggacctccgccgatctgacagtcgaaaaagcggctgacattacgtgggaggaagaggccgaacaaaccggagtgagccataacctcatgatcacagttgacgatgacggcaccatgcgcattaaggatgacgagacagagaatatcctgaccgtgcttctgaaaacggccctgctcattgtctctggcatctttccgtactccatccctgctaccctgcttgtgtggcacacatggcagaagcagacccagagaagcggggtcctgtgggatgtgccctctcctcccgaaacacaaaaagccgagctcgaagagggagtttaccggattaagcagcagggcatcttcgggaaaacccaggtgggagtcggcgtgcaaaaggagggggtttttcacacaatgtggcatgtgacgcgcggagcggtcctgacctataacggcaagagactcgaaccgaattgggcttccgtgaaaaaggacctgattagctacggcgggggatggcggctttctacacagtggcagaaaggcgaggaagtgcaagttatcgccgtcgagcctgggaagaaccccaaaaatttccagaccatgcctggaaccttccagacaacgaccggcgaaattggggccatcgctctggattttaagcccggaacatccggcagccccattatcaaccgcgagggcaaggtggtggggctgtatggaaatggcgtcgtgaccaaaaacgggggatacgtttccggcatcgcccagacaaatgctgagcctgacgggccgacccccgaactcgaggaagagatgttcaagaaaagaaacctgacgattatggatcttcaccctggcagcggaaagacacggaaatatctgcccgccatcgtgcgcgaagcgattaagagacggctcagaaccctgatcctcgcccctacccgcgtcgtggctgccgagatggaggaagctctgaagggccttcccattcggtaccaaacaaccgccacaaaatctgagcataccgggagagaaatcgttgacctgatgtgccacgccacgtttacaatgcgcctgctcagccctgtgcgggtcccgaattataacctgatcattatggatgaggctcatttcaccgaccccgcgtccatcgccgctagaggatacatttctacacgcgtgggcatgggggaagccgccgctatctttatgaccgccacgcctcccggaaccgcggatgctttccctcagagcaatgcccccattcaggacgaggagcgggacatcccggaaagatcctggaactctggcaatgagtggatcacagattttgccgggaagaccgtttggttcgtgcctagcattaaagctggcaacgacatcgccaactgtcttcgcaagaatggcaaaaaggtcattcagctgtcccggaagacatttgataccgaataccagaaaacaaagctcaacgactgggatttcgtggtgaccacggacatctctgagatgggagcgaattttaaagccgatagagtcattgacccccggcgctgcctgaagcccgttatcctgacagatgggcctgagagagtgattctcgctggacccatgcctgtgaccgccgctagcgccgctcagcggcgcggcagagtcgggcggaacccgcagaaagaaaatgaccagtatatcttcaccggacaaccccttaacaatgatgaggaccacgcccactggacagaagcgaagatgctgctggacaacatcaatacccctgagggcattatccccgccctcttcgaacctgagagagagaagtccgctgccattgatggggaataccgcctgaaaggcgagagccggaagacatttgtggaacttatgagacgcggagacctgcccgtttggctcgctcataaagtggcctctgagggcatcaagtatacggatcggaaatggtgcttcgacgggcagagaaacaatcagattctggaagagaacatggatgtcgagatctggaccaaggaaggagagaaaaagaagctgcgcccgcggtggctcgacgccagaacatactccgatcctcttgctctgaaagaatttaaggacttcgcggccggccgcaaaagcatcgctctggatctcgtgaccgagattgggagagttccctctcacctggcccatcggacacgcaatgcccttgacaacctggtgatgctccacacctccgaacacggaggcagagcttatcggcatgccgtcgaggagctgcctgaaacgatggagaccctgctccttctgggcctgatgatcctcctgacagggggagcgatgctttttctgattagcggcaaggggatcggaaaaacctccattggcctcatctgtgtgatcgcctctagcgggatgctgtggatggctgaaattcccctgcagtggatcgcctccgctattgtcctcgagttctttatgatggtgcttctggttcctgagcccgaaaagcaacgcacaccgcaggataatcagctggcctacgtggtgatcggcattctcaccctggcggccatcattgctgccaacgagatgggccttctggaaacgacaaagagagacctcggcatgagcaaagagcctggggtcgtttctcccacctcctatctggatgtggacctgcaccccgctagcgcctggacactctacgctgtggccaccaccgtcatcacacctatgcttcggcatacgatcgaaaattctaccgcgaacgtgagcctggccgctattgccaaccaagctgttgtgctgatgggactcgacaagggctggccgatctccaaaatggatctgggggtcccccttctggccctcggatgctactctcaggtgaatcctctgacactgaccgccgcggtcctccttctgattacacactatgctatcattggccccgggctgcaggccaaggctaccagagaggcccagaaacgcacggccgctggaatcatgaagaaccctacagtggacggcatcatgaccattgatctcgaccccgttatctacgatagcaagttcgagaaacaactgggccaggtgatgcttctggtcctctgtgccgtgcagctgctgctcatgcggacctcctgggcgctttgcgaagccctgacactggctaccgggcctattacaacgctctgggagggatctccgggcaagttttggaataccacaatcgccgttagcatggctaacattttcagagggtcctatctggccggagcgggccttgcctttagcatcatgaaatctgtggggaccggaaagcgcggcacaggctcccagggggaaaccctgggagagaaatggaagaagaaactcaatcaactgagccggaaggagttcgacctgtacaaaaagtccggcatcacggaggtcgatagaaccgaggctaaagaagggctcaagcggggagagattacacatcacgccgtgtctcgcggcagcgctaaacttcagtggtttgtggaaagaaacatggttatccccgaggggcgggtcattgacctgggatgtggccgcggcgggtggtcctattactgcgccggactgaagaaggtgaccgaagtgagaggctatacaaaagggggacctggccacgaggagcccgtccctatgtctacctacgggtggaatatcgttaagctcatgagcggaaaagatgtgttctacctgcccccggaaaagtgtgacacacttctgtgcgatattggcgagtccagcccttctcccaccgtggaagagtcccggacgatccgcgtcctcaaaatggtggagccctggctgaagaacaatcagttctgtattaaggttctgaacccttatatgcccacagtgatcgaacatctcgagagacttcagcggaaacacggcgggatgctggtccgcaatcctctgagcagaaactctacccatgaaatgtactggatctccaatggaaccggcaacattgtggctagcgttaatatggtgtctcggctcctgcttaacagatttacaatgacgcaccgccggccgaccatcgagaaggacgtcgatctgggggccggaacaagacacgtgaacgcggaacccgagacccctaatatggacgtgattggcgagcgcatcaaacggattaaggaagaacacaacagcacatggcactatgacgatgaaaatccctacaaaacctgggcctatcatgggtcctacgaggtcaaggctacaggatctgccagctccatgatcaacggcgttgtgaagctcctgaccaaaccttgggacgtggtccccatggtgacgcaaatggctatgaccgatacaaccccgttcggccagcagagagtttttaaggaaaaagtggacacacgcacccctcggagcatgcccgggacgagacgcgtcatgggaatcacagccgagtggctgtggcggaccctcggcagaaataagaaacctcgcctgtgcacacgggaggagttcaccaagaaggtgagaacgaacgccgcgatgggggctgtttttaccgaggaaaatcaatgggattccgccaaagccgctgtggaggacgaagatttctggaaacttgtcgaccgcgagagagagctgcacaaactcggaaagtgtggctcttgcgtgtataacatgatggggaaacgggaaaagaaactgggcgagtttggaaaggccaagggcagccgcgctatttggtacatgtggcttggggccagatacctggagttcgaggcgctcggatttctgaatgaggatcattggttctcccgggaaaactcttatagcggcgttgagggggaaggactgcacaaactcggctacatcctgagagacatttccaagatccccgggggcgccatgtatgctgatgacacagccggatgggacacccggattacagaggatgaccttcacaatgaagagaaaatcacccagcagatggatcctgagcatcgccagctggctaacgccatctttaagctcacataccaaaataaagtggtcaaggtgcagagacccaccccgacgggcacagtcatggacattatctctcggaaggatcagcgcgggagcggacaggtgggcacctatgggctgaacaccttcacaaatatggaagcgcaacttattagacagatggagggagaaggcgttctgtccaaagccgacctcgagaaccctcatctgcccgaaaagaaaatcacccagtggctggagacaaagggggtggagcggctcaaacgcatggctattagcggcgatgactgcgtcgtgaagcccatcgatgacagatttgccaacgctctgcttgccctgaatgatatgggaaaggtgcggaaagacatccctcagtggcaaccgtctaagggctggcatgattggcagcaggttcccttctgttcccaccacttccatgaactcattatgaaagacgggcgcaagctggtggtcccttgcagaccccaggacgagcttatcggacgggctcgcattagccaaggcgccgggtggtctctgagagaaacggcgtgtctcggaaaagcctacgctcagatgtggtccctgatgtattttcaccggcgcgatctgagactcgccagcaacgccatctgctctgctgtgcctgttcattgggtgcccacctcccggacaacctggagcattcacgcccatcaccagtggatgacaaccgaggacatgctgacggtctggaatagagtgtggatcgaagataacccttggatggaggacaagacccccgtcacaacctgggaggatgtgccgtaccttggcaagcgcgaagaccaatggtgtgggtccctgattggcctcacaagccgggcgacctgggctcagaatatccctacggccatccagcaggttagatctctgattggaaacgaggagttccttgattacatgcccagcatgaaacgctttcggaaggaggaggaatccgagggcgccatctggtga

SEQ ID NO: 20637 - RNA, 9873 nt, synthetic construct
  misc_feature 1..9873: note = derived and/or modified CDS sequence (opt5) from DENV-3__KJ189289__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacaccattggagttctggagcagggcaaacggacacttacccctcagcccatggagctgaagtactcttggaaaacatgggggaaggccaagatcgtgaccgctgaaacacagaactccagcttcattatcgatggacctaatacccccgagtgcccgtctgcgtccagagcctggaacgtctgggaagtggaggactatggctttggcgtgttcacgacaaatatttggctccgcctgcgggaagtctacacccaactgtgtgaccacagacttatgagcgctgccgttaaagatgagcgcgccgtgcatgctgacatggggtactggatcgagtcccagaagaacggatcttggaaactcgaaaaggccagcctgatcgaggtgaaaacctgcacatggcctaagtcccacaccctgtggtctaatggcgtcctcgaaagcgatatgattatccccaagtccctggcggggcctattagccagcataaccaccggcccggatatcacacgcagacagctggcccttggcatcttgggaaactggagctcgactttaattactgcgagggaaccacagtggttatcaccgaaaactgtggcacaagaggcccctctctgcgcaccacgaccgtgtccgggaagctgattcacgagtggtgctgtcggagctgcacacttccgcctctcagatatatgggagaagatggctgttggtacgggatggagatccggcccatctctgaaaaagaggagaatatggtcaagtccctggtgagcgccggatctggcaaagttgacaacttcaccatgggggtgctgtgcctcgccattctgtttgaagaggtcatgcgcggaaagttcggcaagaaacatatgatcgctggcgtgttctttacattcgttcttctgctcagcgggcaaattacctggagagatatggcccacacgctgatcatgattggatccaatgcgagcgaccggatgggcatgggggtgacatatctggctcttatcgccacctttaagattcagcccttcctggccctcggatttttcctgagaaaactcacatctcgcgaaaacctgcttctgggcgtcgggctcgctatggccaccaccctgcagctgcctgaggatatcgaacaaatggctaatggaatcgcccttggcctgatggcgctcaagctgattacacagtttgagacgtaccagctctggaccgccctgatctcccttacatgtagcaacaccattttcacactgaccgtggcttggcggacggccacactcatcctggctggcgtgtccctgcttccggtctgccagtctagctccatgagaaaaaccgactggctgcccatggccgttgccgctatgggggtgcctcccctccctctgtttattttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcatcgcctgttatgtcattacagggacctccgctgatctgacagtggaaaaagccgcggacatcacgtgggaggaagaggctgaacaaaccggagttagccataacctcatgattacagtggacgatgacggcaccatgcgcatcaaggatgacgagacagagaatattctgaccgtccttctgaaaacggccctgctcatcgtgtctggcatctttccgtactccattcctgccaccctgcttgtctggcacacatggcagaagcagacccagagaagcggggtgctgtgggatgttccctctcctcccgaaacacaaaaagctgagctcgaagagggagtgtaccggatcaagcagcagggcattttcgggaaaacccaggtcggagtgggcgttcaaaaggagggggtgtttcacacaatgtggcatgtcacgcgcggagccgtgctgacctataacggcaagagactcgaaccgaattgggcgtccgtgaaaaaggacctgatcagctacggcgggggatggcggctttctacacagtggcagaaaggcgaggaagttcaagtcattgctgtggagcctgggaagaaccccaaaaatttccagaccatgcctggaaccttccagacaacgaccggcgaaatcggggccattgccctggattttaagcccggaacatccggcagccccatcatcaaccgcgagggcaaggtggtcgggctgtatggaaatggcgtggttaccaaaaacgggggatacgtgtccggcattgctcagacaaatgccgagcctgacgggccgacccccgaactcgaggaagagatgttcaagaaaagaaacctgacgatcatggatcttcaccctggcagcggaaagacacggaaatatctgcccgctattgtccgcgaagccatcaagagacggctcagaaccctgattctcgcgcctacccgcgtggttgccgctgagatggaggaagccctgaagggccttcccatccggtaccaaacaaccgctacaaaatctgagcataccgggagagaaatcgtggacctgatgtgccacgccacgtttacaatgcgcctgctcagccctgtccgggtgccgaattataacctgattatcatggatgaggcccatttcaccgaccccgcttccattgcggccagaggatacatctctacacgcgttggcatgggggaagctgccgccatttttatgaccgctacgcctcccggaaccgccgatgcgttccctcagagcaatgctcccatccaggacgaggagcgggacatcccggaaagatcctggaactctggcaatgagtggattacagattttgccgggaagaccgtgtggttcgtccctagcatcaaagccggcaacgacattgctaactgtcttcgcaagaatggcaaaaaggtgatccagctgtcccggaagacatttgataccgaataccagaagacaaagctcaacgactgggatttcgtggtcaccacggacatttctgagatgggagccaattttaaagcggatagagttatcgacccccggcgctgcctgaagcccgtgattctgacagatgggcctgagagagtgatcctcgccggacccatgcctgtcaccgctgccagcgctgcccagcggcgcggcagagtggggcggaacccgcagaaagaaaatgaccagtatatcttcaccggacaaccccttaacaatgatgaggaccacgctcactggacagaagccaagatgctgctggacaacattaatacccctgagggcatcattcccgccctcttcgaacctgagagagagaagtccgccgctatcgatggggaataccgcctgaaaggcgagagccggaagacatttgttgaacttatgagacgcggagacctgcccgtgtggctcgcccataaagtcgcttctgagggcattaagtatacggatcggaaatggtgcttcgacgggcagagaaacaatcagatcctggaagagaacatggatgtggagatctggaccaaggaaggagagaaaaagaagctgcgcccgcggtggctcgacgccagaacatactccgatcctcttgccctgaaagaatttaaggacttcgctgcgggccgcaaaagcattgccctggatctcgttaccgagatcgggagagtgccctctcacctggctcatcggacacgcaatgcccttgacaacctggtcatgctccacacctccgaacacggaggcagagcctatcggcatgctgtggaggagctgcctgaaacgatggagaccctgctccttctgggcctgatgattctcctgacagggggagccatgctttttctgatcagcggcaaggggattggaaaaacctccatcggcctcatctgtgtcattgcgtctagcgggatgctgtggatggccgaaatccccctgcagtggattgcttccgccatcgtgctcgagttctttatgatggttcttctgattcctgagcccgaaaagcaacgcacaccgcaggataatcagctggcttacgtggtgatcggcattctcaccctggccgcgatcatcgccgctaacgagatgggccttctggaaacgacaaagagagacctcggcatgagcaaagagcctggggtcgtttcttccaccagctatctggatgtggacctgcaccccgcctctgcttggacactctacgccgtggctaccaccgtcattacacccatgcttcggcatacgatcgaaaatagcaccgccaacgtgtccctggcggccattgctaaccaagccgttgtgctgatgggactcgacaagggctggcctatctctaaaatggatctgggggtcccgcttctggctctcggatgctacagccaggtgaatcccctgacactgaccgccgccgtcctccttctgattacacactatgcgatcatcggccctgggctgcaggctaaggccaccagagaggctcagaaacgcacggccgccggaattatgaagaaccccacagtggacggcatcatgaccattgatctcgaccctgttatctacgattccaagttcgagaaacaactgggccaggtgatgcttctggtcctctgtgctgtgcagctgctgctcatgcggacctcttgggccctttgcgaagcgctgacactggccaccgggcccattacaacgctctgggagggaagccctggcaagttttggaataccacaatcgctgtttccatggccaacatcttcagagggagctatctggctggagccggccttgcgttttctattatgaaatccgtggggaccggaaagcgcggcacaggcagccagggggaaaccctgggagagaaatggaagaagaaactcaatcaactgtcccggaaggagttcgacctgtacaaaaagtctggcatcacggaggtcgatagaaccgaggccaaagaagggctcaagcggggagagattacacatcacgctgtgagccgcggctccgccaaacttcagtggtttgtggaaagaaacatggttatcccggaggggcgggtcattgacctgggatgtggccgcggcgggtggtcttattactgcgctggactgaagaaggtgaccgaagtgagaggctatacaaaagggggacccggccacgaggagcctgtccccatgagcacctacgggtggaatatcgttaagctcatgtccggaaaagatgtgttctacctgcctcccgaaaagtgtgacacacttctgtgcgatattggcgagagctctccgtcccctaccgtggaagagagccggacgatccgcgtcctcaaaatggtggagccctggctgaagaacaatcagttctgtatcaaggttctgaacccctatatgcctacagtgattgaacatctcgagagacttcagcggaaacacggcgggatgctggtccgcaatcccctgtctagaaactccacccatgaaatgtactggatcagcaatggaaccggcaacattgtggcctctgttaatatggtgagccggctcctgcttaacagatttacaatgacgcaccgccggcctaccatcgagaaggacgtcgatctgggggctggaacaagacacgtgaacgccgaaccggagacccccaatatggacgtgattggcgagcgcatcaaacggatcaaggaagaacacaactccacatggcactatgacgatgaaaatccttacaaaacctgggcgtatcatgggtcttacgaggtcaaggccacaggaagcgcttccagcatgattaacggcgttgtgaagctcctgaccaaaccctgggacgtggtccctatggtgacgcaaatggccatgaccgatacaacccccttcggccagcagagagtttttaaggaaaaagtggacacacgcaccccgcggtccatgcctgggacgagacgcgtcatgggaatcacagctgagtggctgtggcggaccctcggcagaaataagaaaccccgcctgtgcacacgggaggagttcaccaagaaggtgagaacgaacgccgccatgggggcggtttttaccgaggaaaatcaatgggattctgctaaaacagccgtggaggacgaagatttctggaaacttgtcgaccgcgagagagagctgcacaaactcggaaagtgtggcagctgcgtgtataacatgatggggaaacgggaaaagaaactgggcgagtttggaaaggccaagggctcccgcgctatttggtacatgtggcttggggccagatacctggagttcgaggctctcggatttctgaatgaggatcattggttctctcgggaaaacagctattccggcgttgagggggaaggactgcacaaactcggctacatcctgagagacatttctaagatccctgggggcgccatgtatgcggatgacaccgccggatgggacacacggatcaccgaggatgaccttcacaatgaagagaaaattacacagcagatggatcccgagcatcgccagctggctaacgccatctttaagctcacctaccaaaataaagtggtcaaggtgcagagacctacgcccacaggcaccgtcatggacattatcagccggaaggatcagcgcgggtccggacaggtgggcacctatgggctgaacacattcaccaatatggaagctcaacttattagacagatggagggagaaggcgttctgagcaaagccgacctcgagaacccgcatctgcctgaaaagaaaatcacacagtggctggagacgaagggggtggagcggctcaaacgcatggcgatctctggcgatgactgcgtcgtgaagcccattgatgacagatttgccaacgctctgcttgccctgaatgatatgggaaaggtgcggaaagacatcccccagtggcaaccttccaagggctggcatgattggcagcaggttccgttctgtagccaccacttccatgaactcattatgaaagacgggcgcaagctggtggtcccctgcagacctcaggacgagcttatcggacgggctcgcatttctcaaggcgccgggtggtccctgagagaaaccgcttgtctcggaaaagcctacgcgcagatgtggagcctgatgtattttcaccggcgcgatctgagactcgcctctaacgctatctgctccgccgtgcccgttcattgggtgcctacaagccggaccacatggtccattcacgcccatcaccagtggatgaccacggaggacatgctgaccgtctggaatagagtgtggatcgaagataacccctggatggaggacaagacacctgtcaccacatgggaggatgtgccctaccttggcaagcgcgaagaccaatggtgtgggagcctgatcggcctcacctctcgggctacgtgggcccagaatattccgacagcgatccagcaggttagaagcctgattggaaacgaggagttccttgattacatgccttccatgaaacgctttcggaaggaggaggaatctgagggcgctatctggtga

SEQ ID NO: 20638 - RNA, 9873 nt, synthetic construct
  misc_feature 1..9873: note = derived and/or modified CDS sequence (opt5) from DENV-3__KJ189290__SS-prME
  source 1..9873: mol_type = other RNA
acaagcctgtgcctcatgatgatcctgcccgcggctcttgccttccacctgacatcccgggacggcgagcctcggatgattgtggggaagaatgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagaaatatggcccacaccctgattatgatcggatccaacgcgagcgatcggatgggcatgggggtgacgtatctggctcttattgccacatttaagatccagcccttcctggccctcggatttttcctgagaaaactcacctctcgcgaaaatctgcttctgggcgtcgggctcgctatggccacaaccctgcagctgcctgaggacatcgaacaaatggctaacggaattgcccttggcctgatggcgctcaagctgatcacccagtttgagacataccagctctggacggccctgatttcccttacctgtagcaatacaatcttcaccctgacagtggcttggcggaccgccacgctcattctggctggcgtgtccctgcttccggtctgccagtctagctccatgagaaaaacagattggctgcccatggccgttgccgctatgggggtgcctcccctccctctgtttatcttctctctcaaggacaccctgaagcgcagaagctggccccttaacgagggagtgatggcggtcggcctggtgtccatcctggcctctagcctcctgcggaacgatgttcctatggctgggccccttgtggccggaggcctgctcattgcctgttatgtcatcaccgggacatccgctgacctgaccgtggaaaaagccgcggatattacatgggaggaagaggctgaacaaacgggagttagccataatctcatgatcaccgtggacgacgatggcacaatgcgcattaaggacgatgagaccgagaacatcctgacagtccttctgaaaaccgccctgctcatcgtgtctggcatttttccgtactccatccctgccacgctgcttgtctggcacacctggcagaagcagacacagagaagcggggtgctgtgggacgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataatggcaagagactcgaaccgaactgggcgtccgtgaaaaaggatctgattagctacggcgggggatggcggctttctacccagtggcagaaaggcgaggaagttcaagtcatcgctgtggagcctgggaagaatcccaaaaacttccagacaatgcctggaaccttccagaccacaacgggcgaaattggggccatcgccctggactttaagcccggaacctccggcagccccatcattaatcgcgagggcaaggtggtcgggctgtatggaaacggcgtggttaccaagaatgggggatacgtgtccggcatcgctcagaccaacgccgagcctgatgggccgacacccgaactcgaggaagagatgttcaagaaaagaaatctgaccattatggaccttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggatctgatgtgccacgccacctttacgatgcgcctgctcagccctgtccgggtgccgaactataatctgatcattatggacgaggcccatttcacagatcccgcttccatcgcggccagaggatacatttctacccgcgttggcatgggggaagctgccgccatctttatgacagctacccctcccggaacggccgacgcgttccctcagagcaacgctcccatccaggatgaggagcgggacattccggaaagatcctggaactctggcaacgagtggatcaccgactttgccgggaagacagtgtggttcgtccctagcattaaagccggcaacgatatcgctaattgtcttcgcaagaacggcaaaaaggtgattcagctgtcccggaagacctttgacacagaataccagaagacaaagctcaatgattgggacttcgtggtcacaaccgatatctctgagatgggagccaactttaaagcggacagagttattgatccccggcgctgcctgaagcccgtgatcctgacggacgggcctgagagagtgatcctcgccggacccatgcctgtcacagctgccagcgctgcccagcggcgcggcagagtggggcggaatccgcagaaagaaaacgatcagtatattttcaccggacaaccccttaataacgacgaggatcacgctcactggaccgaagccaagatgctgctggacaatatcaacacacctgagggcattatccccgccctcttcgaacctgagagagagaagtccgccgctattgacggggaataccgcctgaaaggcgagagccggaagacctttgttgaacttatgagacgcggagatctgcccgtgtggctcgcccataaagtcgcttctgagggcatcaagtatacagaccggaaatggtgcttcgatgggcagagaaataaccagatcctggaagagaatatggacgtggagatttggacgaaggaaggagagaaaaagaagctgcgcccgcggtggctcgatgccagaacctactccgaccctcttgccctgaaagaatttaaggatttcgctgcgggccgcaaaagcatcgccctggacctcgttacagagattgggagagtgccctctcacctggctcatcggacccgcaacgcccttgataatctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggacaaccagctggcttacgtggtgattggaatcctcacactggccgcgatcattgccgctaatgagatgggccttctggaaaccacgaagagagatctcggcatgagcaaagagcctggggtcgtttctcccacatcctatctggacgtggatctgcaccccgccagcgcttggaccctctacgccgtggctacaaccgtcatcacccctatgcttcggcatacaattgaaaactctacggccaacgtgagcctggcggccatcgctaatcaagccgttgtgctgatgggactcgacaagggctggccgatttccaaaatggacctgggggtcccccttctggctctcggatgctactctcaggtgaaccctctgaccctgacagccgccgtcctccttctgatcacccactatgcgatcattggccccgggctgcaggctaaggccacaagagaggctcagaaacgcaccgccgccggaatcatgaagaatcctacggtggatggcattatgacaatcgacctcgatcccgttatttacgacagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaacacgaccatcgctgttagcatggccaatattttcagagggtcctatctggctggagccggccttgcgtttagcatcatgaaatctgtggggacaggaaagcgcggcaccggctcccagggggaaacactgggagagaaatggaagaagaaactcaaccaactgagccggaaggagttcgatctgtacaaaagatccggcattaccgaggtcgaccggacggaggccaaggaagggctcaaacgcggagagatcacccatcacgctgtgtctagaggcagcgccaaacttcagtggtttgtggaacggaatatggttattcccgaggggcgcgtcatcgatctgggatgtggcagaggcgggtggtcctattactgcgctggactgaaaaaggtgacagaagtgcggggctataccaaagggggacctggccacgaggagcccgtccctatgtctacatacgggtggaacattgttaaactcatgagcggaaaggacgtgttctacctgcccccggaaaaatgtgatacccttctgtgcgacatcggcgagtccagcccttctcccacagtggaagagtcccgcaccatcagagtcctcaagatggtggagccctggctgaaaaataaccagttctgtattaaggttctgaatccttatatgcccacggtgatcgaacatctcgagcggcttcagcgcaagcacggcgggatgctggtcagaaaccctctgagcagaaattctacacatgaaatgtactggatttccaacggaaccggcaatatcgtggccagcgttaacatggtgtctagactcctgcttaaccgctttaccatgacacaccggagaccgacgattgagaaagatgtcgacctgggggctggaacccgccacgtgaatgccgaacccgagacacctaacatggatgtgatcggcgagcggatcaagagaattaaagaggaacacaatagcacctggcactatgacgaagagaacccctacaagacatgggcgtatcatgggtcctacgaagtcaaagccaccggatctgctagctccatgatcaatggcgttgtgaagctcctgacaaagccttgggacgtggtccccatggtgacccaaatggccatgacggataccacaccgttcggccagcagcgcgtttttaaagagaaggtggacacccggacacctagaagcatgcccgggacccgccgggtcatgggaattacggctgagtggctgtggagaacactcggccgcaacaaaaagcctcggctgtgcaccagagaagagttcaccaaaaaggtgcgcaccaatgccgccatgggggcggtttttacggaagagaaccaatgggattccgctaaggccgccgtggaagacgaggatttctggaaacttgtcgacagagagcgggaactgcacaagctcggaaaatgtggctcttgcgtgtataatatgatggggaagcgcgagaaaaagctgggcgaatttggaaaagctaagggcagcagagccatctggtacatgtggcttggggctcggtacctggagttcgaggccctcggatttctgaacgaagatcattggttctccagagaaaattcttatagcggcgttgaaggggagggactgcacaagctcggctacattctgcgggacatctccaaaatccccgggggcgcgatgtatgccgatgacaccgctggatgggatacacgcattaccgaagacgaccttcacaacgaggagaagatcacacagcagatggatcctgaacatagacagctggccaatgctatttttaaactcacctaccaaaacaaggtggtcaaagtgcagcggcccacaccgaccggcacggtcatggacatcatttctcgcaaggatcagagagggagcggacaggtgggcacatatgggctgaataccttcaccaacatggaggcccaacttatccggcagatggaaggagagggcgttctgtccaaggcggacctcgaaaaccctcatctgcccgagaaaaagatcacacagtggctggagaccaaaggggtggaacgcctcaagagaatggccattagcggcgatgactgcgtcgtgaaacccatcgatgaccggtttgctaatgccctgcttgctctgaacgatatgggaaaggtgcgcaaggacattcctcagtggcaaccgtctaaaggctggcatgattggcagcaggttcccttctgttcccaccacttccatgagctcatcatgaaggacgggagaaaactggtggtcccttgccggccccaggatgaacttattggacgcgccagaatcagccaaggcgctgggtggtctctgcgggagacagcctgtctcggaaaggcgtacgcccagatgtggtccctgatgtattttcaccgcagagacctgcggctcgctagcaatgccatttgctctgccgtgcctgttcattgggtgcccacgtccagaaccacatggagcatccacgctcatcaccagtggatgaccacagaagacatgctgaccgtctggaaccgcgtgtggatcgaggataatccttggatggaggacaaaacgcccgtcaccacatgggaagatgtgccgtaccttggcaagcgggaggaccaatggtgtgggtccctgattggcctcaccagcagagccacatgggcgcagaacatccctaccgctattcagcaggttcgctctctgatcggaaatgaagagttccttgattacatgcccagcatgaagcggtttagaaaagaggaagagtccgaaggcgccatttggtga

SEQ ID NO: 20639 - RNA, 9873 nt, synthetic construct
  misc_feature 1..9873: note = derived and/or modified CDS sequence (opt5) from DENV-3__KJ189291__SS-prME
  source 1..9873: mol_type = other RNA
acaagcctgtgcctcatgatgatcctgcccgcggctcttgccttccacctgacatcccgggacggcgagcctcggatgattgtggggaagaatgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagaaatatggcccacaccctgattatgatcggatccaacgcgagcgatcggatgggcatgggggtgacgtatctggctcttattgccacatttaagatccagcccttcctggccctcggatttttcctgagaaaactcacctctcgcgaaaatctgcttctgggcgtcgggctcgctatggccacaaccctgcagctgcctgaggacatcgaacaaatggctaacggaattgcccttggcctgatggcgctcaagctgatcacccagtttgagacataccagctctggacggccctgatttcccttacctgtagcaatacaatcttcaccctgacagtggcttggcggaccgccacgctcattctggctggcgtgtccctgcttccggtctgccagtctagctccatgagaaaaacagattggctgcccatggccgttgccgctatgggggtgcctcccctccctctgtttatcttctctctcaaggacaccctgaagcgcagaagctggccccttaacgagggagtgatggcggtcggcctggtgtccatcctggcctctagcctcctgcggaacgatgttcctatggctgggccccttgtggccggaggcctgctcattgcctgttatgtcatcaccgggacatccgctgacctgaccgtggaaaaagccgcggatattacatgggaggaagaggctgaacaaacgggagttagccataatctcatgatcaccgtggacgacgatggcacaatgcgcattaaggacgatgagaccgagaacatcctgacagtccttctgaaaaccgccctgctcatcgtgtctggcatttttccgtactccatccctgccacgctgcttgtctggcacacctggcagaagcagacacagagaagcggggtgctgtgggacgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataatggcaagagactcgaaccgaactgggcgtccgtgaaaaaggatctgattagctacggcgggggatggcggctttctacccagtggcagaaaggcgaggaagttcaagtcatcgctgtggagcctgggaagaatcccaaaaacttccagacaatgcctggaaccttccagaccacaacgggcgaaattggggccatcgccctggactttaagcccggaacctccggcagccccatcattaatcgcgagggcaaggtggtcgggctgtatggaaacggcgtggttaccaagaatgggggatacgtgtccggcatcgctcagaccaacgccgagcctgatgggccgacacccgaactcgaggaagagatgttcaagaaaagaaatctgaccattatggaccttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggatctgatgtgccacgccacctttacgatgcgcctgctcagccctgtccgggtgccgaactataatctgatcattatggacgaggcccatttcacagatcccgcttccatcgcggccagaggatacatttctacccgcgttggcatgggggaagctgccgccatctttatgacagctacccctcccggaacggccgacgcgttccctcagagcaacgctcccatccaggatgaggagcgggacattccggaaagatcctggaactctggcaacgagtggatcaccgactttgccgggaagacagtgtggttcgtccctagcattaaagccggcaacgatatcgctaattgtcttcgcaagaacggcaaaaaggtgattcagctgtcccggaagacctttgacacagaataccagaagacaaagctcaatgattgggacttcgtggtcacaaccgatatctctgagatgggagccaactttaaagcggacagagttattgatccccggcgctgcctgaagcccgtgatcctgacggacgggcctgagagagtgatcctcgccggacccatgcctgtcacagctgccagcgctgcccagcggcgcggcagagtggggcggaatccgcagaaagaaaacgatcagtatattttcaccggacaaccccttaataacgacgaggatcacgctcactggaccgaagccaagatgctgctggacaatatcaacacacctgagggcattatccccgccctcttcgaacctgagagagagaagtccgccgctattgacggggaataccgcctgaaaggcgagagccggaagacctttgttgaacttatgagacgcggagatctgcccgtgtggctcgcccataaagtcgcttctgagggcatcaagtatacagaccggaaatggtgcttcgatgggcagagaaataaccagatcctggaagagaatatggacgtggagatttggacgaaggaaggagagaaaaagaagctgcgcccgcggtggctcgatgccagaacctactccgaccctcttgccctgaaagaatttaaggatttcgctgcgggccgcaaaagcatcgccctggacctcgttacagagattgggagagtgccctctcacctggctcatcggacccgcaacgcccttgataatctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggacaaccagctggcttacgtggtgattggaatcctcacactggccgcgatcattgccgctaatgagatgggccttctggaaaccacgaagagagatctcggcatgagcaaagagcctggggtcgtttctcccacatcctatctggacgtggatctgcaccccgccagcgcttggaccctctacgccgtggctacaaccgtcatcacccctatgcttcggcatacaattgaaaactctacggccaacgtgagcctggcggccatcgctaatcaagccgttgtgctgatgggactcgacaagggctggccgatttccaaaatggacctgggggtcccccttctggctctcggatgctactctcaggtgaaccctctgaccctgacagccgccgtcctccttctgatcacccactatgcgatcattggccccgggctgcaggctaaggccacaagagaggctcagaaacgcaccgccgccggaatcatgaagaatcctacggtggatggcattatgacaatcgacctcgatcccgttatttacgacagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaacacgaccatcgctgttagcatggccaatattttcagagggtcctatctggctggagccggccttgcgtttagcatcatgaaatctgtggggacaggaaagcgcggcaccggctcccagggggaaacactgggagagaaatggaagaagaaactcaaccaactgagccggaaggagttcgatctgtacaaaagatccggcattaccgaggtcgaccggacggaggccaaggaagggctcaaacgcggagagatcacccatcacgctgtgtctagaggcagcgccaaacttcagtggtttgtggaacggaatatggttattcccgaggggcgcgtcatcgatctgggatgtggcagaggcgggtggtcctattactgcgctggactgaaaaaggtgacagaagtgcggggctataccaaagggggacctggccacgaggagcccgtccctatgtctacatacgggtggaacattgttaaactcatgagcggaaaggacgtgttctacctgcccccggaaaaatgtgatacccttctgtgcgacatcggcgagtccagcccttctcccacagtggaagagtcccgcaccatcagagtcctcaagatggtggagccctggctgaaaaataaccagttctgtattaaggttctgaatccttatatgcccacggtgatcgaacatctcgagcggcttcagcgcaagcacggcgggatgctggtcagaaaccctctgagcagaaattctacacatgaaatgtactggatttccaacggaaccggcaatatcgtggccagcgttaacatggtgtctagactcctgcttaaccgctttaccatgacacaccggagaccgacgattgagaaagatgtcgacctgggggctggaacccgccacgtgaatgccgaacccgagacacctaacatggatgtgatcggcgagcggatcaagagaattaaagaggaacacaatagcacctggcactatgacgaagagaacccctacaagacatgggcgtatcatgggtcctacgaagtcaaagccaccggatctgctagctccatgatcaatggcgttgtgaagctcctgacaaagccttgggacgtggtccccatggtgacccaaatggccatgacggataccacaccgttcggccagcagcgcgtttttaaagagaaggtggacacccggacacctagaagcatgcccgggacccgccgggtcatgggaattacggctgagtggctgtggagaacactcggccgcaacaaaaagcctcggctgtgcaccagagaagagttcaccaaaaaggtgcgcaccaatgccgccatgggggcggtttttacggaagagaaccaatgggattccgctaaggccgccgtggaagacgaggatttctggaaacttgtcgacagagagcgggaactgcacaagctcggaaaatgtggctcttgcgtgtataatatgatggggaagcgcgagaaaaagctgggcgaatttggaaaagctaagggcagcagagccatctggtacatgtggcttggggctcggtacctggagttcgaggccctcggatttctgaacgaagatcattggttctccagagaaaattcttatagcggcgttgaaggggagggactgcacaagctcggctacattctgcgggacatctccaaaatccccgggggcgcgatgtatgccgatgacaccgctggatgggatacacgcattaccgaagacgaccttcacaacgaggagaagatcacacagcagatggatcctgaacatagacagctggccaatgctatttttaaactcacctaccaaaacaaggtggtcaaagtgcagcggcccacaccgaccggcacggtcatggacatcatttctcgcaaggatcagagagggagcggacaggtgggcacatatgggctgaataccttcaccaacatggaggcccaacttatccggcagatggaaggagagggcgttctgtccaaggcggacctcgaaaaccctcatctgcccgagaaaaagatcacacagtggctggagaccaaaggggtggaacgcctcaagagaatggccattagcggcgatgactgcgtcgtgaaacccatcgatgaccggtttgctaatgccctgcttgctctgaacgatatgggaaaggtgcgcaaggacattcctcagtggcaaccgtctaaaggctggcatgattggcagcaggttcccttctgttcccaccacttccatgagctcatcatgaaggacgggagaaaactggtggtcccttgccggccccaggatgaacttattggacgcgccagaatcagccaaggcgctgggtggtctctgcgggagacagcctgtctcggaaaggcgtacgcccagatgtggacgctgatgtattttcaccgcagagacctgcggctcgcttccaatgccatttgcagcgccgtgcctgttcattgggtgcccacctctagaacaacctggtccatccacgctcatcaccagtggatgacaaccgaagacatgctgacggtctggaaccgcgtgtggatcgaggataatccttggatggaggacaaaacccccgtcacaacctgggaagatgtgccgtaccttggcaagcgggaggaccaatggtgtgggagcctgattggcctcacatccagagccacctgggcgcagaacatccctacggctattcagcaggttcgcagcctgatcggaaatgaagagttccttgattacatgccctctatgaagcggtttagaaaagaggaagagagcgaaggcgccatttggtga

SEQ ID NO: 20640 - RNA, 9873 nt, synthetic construct
  misc_feature 1..9873: note = derived and/or modified CDS sequence (opt5) from DENV-3__KJ189292__SS-prME
  source 1..9873: mol_type = other RNA
accagcctgtgcctcatgatgatcctgcccgccgctcttgccttccacctgacctcccgggacggagaacctcggatgattgtggggaagaacgaacgcggaaaatctctcctgtttaagacggcgagcggcatcaatatgtgtacccttattgctatggatctgggggaaatgtgcgacgataccgtcacctacaaatgtccgcatatcacagaagccgagcccgaagacattgattgctggtgtaacctcacctccacatgggttacctatggaacgtgcaatcaggccggcgagcacagacgggacaagcgctctgtggctctggcccctcatgtggggatgggactggataccagaacacagacctggatgagcgctgagggcgcctggcggcaggtcgaaaaagtggagacatgggcgctccgccaccccggcttcaccatcctggccctttttctggctcattacatcgggacgtccctcacacagaaggttgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacaactggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtcacatgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccaccctgcccgaatatggcacgctggggctcgagtgctcccctcgcaccggactggacttcaatgagatgatccttctgacaatgaaaaacaaggcctggatggtgcatagacagtggtttttcgatctccccctgccgtggaccagcggcgctacaaccgaaacgcctacatggaatcggaaagagcttctggtcacctttaagaacgcgcacgccaaaaagcaagaagtggtcgtgctcgggtctcaggagggagctatgcacacagccctgaccggcgccaccgaaattcaaaattccgggggcacaagcatcttcgctggacatctgaagtgtcgcctcaaaatggacaagctggagcttaaaggcatgtcttacgccatgtgcacgaacacctttgttctgaagaaagaggtgtccgaaacacagcacgggaccattctcatcaaggtcgagtacaagggagaagatgcgccctgtaaaatccctttcagcacagaggacggccatgggaaggctcacaacggaagactgattaccgccaatcccgtggttacgaaaaaggaggaacccgtgaacatcgaggccgaacctccgttcggcgagtccaatattatgatcgggattggcgataacgctctgaaaatcaattggtataagaagggatctagcatcggcaaaatgtttgaagccacagctagaggggcgagacgcatggcgattcttggagacaccgcctgggatttcggctccgtcgggggagtgctcaacagcctgggcaagatggtgcatcaaatctttgggtctgcttacaccgccctgttctccggcgttagctgggtcatgaaaattggaatcggcgtgctcctgacatggattgggcttaattctaagaacaccagcatgtccttttcttgcatcgctattggaatcatcacactgtatctcggcgccgtggtccaggcggacatggggtgtattatcaattggaaaggaaaggagctgaagtgcggcagcgggattttcgtgacgaacgaggttcacacctggacagaacagtacaaatttcaggccgattcccccaagcggctggctaccgccatcgctggcgcctgggagaatggagtgtgtggcattagaagcacaacccgcatggaaaaccttctctggaaacaaatcgccaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagcggaaacccagaactccagcttcattatcgatggacctaatacacccgagtgcccgtctgcctccagagcttggaacgtgtgggaagttgaggactatggctttggcgtgttcaccacgaatatctggctccgcctgcgggaagtctacacacaactgtgtgaccacagacttatgagcgccgccgtgaaagatgagcgcgctgtgcatgccgacatggggtactggattgagtcccagaagaacggatcttggaaactcgaaaaggcgagcctgatcgaggtcaaaacctgcacctggcctaagtcccacacactgtggtctaatggcgttctcgaaagcgatatgattatccccaagtccctggctgggcctattagccagcataaccaccggcccggatatcacacccagacggccggcccttggcatcttgggaaactggagctcgactttaattactgcgagggaacaaccgtggtgatcacagaaaactgtggcaccagaggcccctctctgcgcacaaccacggtctccgggaagctgatccacgagtggtgctgtcggagctgcacccttccgcctctcagatatatgggagaagatggctgttggtacgggatggagattcggcccatctctgaaaaagaggagaatatggtgaagtccctggttagcgccggatctggcaaagtggacaacttcacaatgggggtcctgtgcctcgctattctgtttgaagaggtgatgcgcggaaagttcggcaagaaacatatgatcgccggcgttttctttaccttcgtgcttctgctcagcgggcaaattacatggagagatatggcgcacaccctgatcatgattggatccaatgctagcgaccggatgggcatgggggtcacgtatctggcccttatcgccacatttaagatccagcccttcctggctctcggatttttcctgagaaaactcacctctcgcgaaaacctgcttctgggcgtggggctcgccatggctacaaccctgcagctgcctgaggatattgaacaaatggccaatggaatcgcgcttggcctgatggccctcaagctgattacccagtttgagacataccagctctggacggctctgatctcccttacctgtagcaacacaattttcaccctgacagttgcctggcggaccgctacgctcatcctggccggcgtgtccctgcttccggtctgccagtctagctccatgagaaaaacagactggctgcccatggccgtggctgcgatgggggtgcctcccctccctctgtttatcttctctctcaaggataccctgaagcgcagaagctggccccttaatgagggagtcatggccgttggcctggtgtccattctggcttctagcctcctgcggaacgacgtgcctatggccgggccccttgtcgccggaggcctgctcatcgcttgttatgtgattaccgggacatccgccgatctgaccgttgaaaaagcggctgacatcacatgggaggaagaggccgaacaaacgggagtgagccataacctcatgattaccgtcgacgatgacggcacaatgcgcatcaaggatgacgagaccgagaatatcctgacagtgcttctgaaaaccgccctgctcattgtttctggcatctttccgtactccattcctgctacgctgcttgtgtggcacacctggcagaagcagacacagagaagcggggtcctgtgggatgtgccctctcctcccgaaacccaaaaagccgagctcgaagagggagtctaccggatcaagcagcagggcattttcgggaaaacacaggtgggagttggcgtgcaaaaggagggggtctttcacaccatgtggcatgtgacacgcggagcggttctgacgtataacggcaagagactcgaaccgaattgggcttccgtgaaaaaggacctgatcagctacggcgggggatggcggctttctacccagtggcagaaaggcgaggaagtccaagtgattgccgtggagcctgggaagaaccccaaaaatttccagacaatccctggaaccttccagaccacaacgggcgaaatcggggccattgctctggattttaagcccggaacctccggcagccccatcattaaccgcgagggcaaggttgtcgggctgtatggaaatggcgtggtgaccaagaacgggggatacgtctccggcatcgcccagaccaatgctgagcctgacgggagcacaccggaactcgaggaagagatgttcaagaaaagaaacctgaccattatggatcttcaccccggctctggaaagacgcggaaatatctgcctgccatcgtgcgcgaagcgatcaagagacggctcagaacactgattctcgcccccacccgcgttgtggctgccgagatggaggaagctctgaagggccttcctatccggtaccaaaccacagccaccaaaagcgagcatacagggagagaaattgtcgacctgatgtgccacgccacctttacgatgcgcctgctctcccccgtgcgggttcctaattataacctgatcattatggatgaggctcatttcacagacccggcgtctatcgccgctagaggatacatcagcacccgcgtgggcatgggggaagccgccgctatttttatgacagccacaccccctggaacggcggatgctttcccccagtccaatgcccctatccaggacgaggagcgggacattcccgaaagatcttggaacagcggcaatgagtggatcaccgattttgccgggaagacagtctggttcgtgccgtccattaaagctggcaacgacatcgccaactgtcttcgcaagaatggcaaaaaggttattcagctgtctcggaagacctttgatacagaataccagaaaaccaagctcaacgactgggatttcgtggtcacaaccgacatcagcgagatgggagcgaattttaaagccgatagagtgatcgaccctcggcgctgcctgaagcccgtgattctgacggatgggcccgagagagtcatcctcgctggacctatgcccgttacagtggcctccgctgcccagcggcgcggcagagtggggcggaaccctcagaaagaaaatgaccagtatattttcaccggacaaccgcttaacaatgatgaggaccacgctcactggaccgaagccaagatgctgctggacaacatcaatacacccgagggcattatccctgccctcttcgaacccgagagagaaaagagcgccgctatcgatggggaataccgcctgaaaggcgagtctcggaagacctttgtcgaacttatgagacgcggagacctgcctgtgtggctcgcccataaagttgcttccgagggcattaagtatacagatcggaaatggtgcttcgacgggcagagaaacaatcagatcctggaagagaacatggatgtggagatttggacgaaggaaggagagaaaaagaagctgcgcccccggtggctcgacgccagaacctacagcgatccgcttgccctgaaagaatttaaggacttcgctgcgggccgcaaatctatcgccctggatctcgtcacagagattgggagagtgccttcccacctggctcatcggacccgcaatgcccttgacaacctggttatgctccacacaagcgaacacggaggcagagcctatcggcatgctgtggaggagctgcccgaaaccatggagacgctgctccttctgggcctgatgatcctcctgaccgggggagccatgctttttctgatctccggcaaggggattggaaaaacatctatcggcctcatttgtgtcatcgcgagctccgggatgctgtggatggccgaaattcctctgcagtggatcgctagcgccattgtgctcgagttctttatgatggtccttctgatccccgagcctgaaaagcaacgcacaccccaggataatcagctggcttacgtggttatcggcattctcacactggccgcgatcattgccgctaacgagatgggccttctggaaaccacgaagagagacctcggcatgtctaaagagccgggggtggtgtcccctacaagctatctggatgtcgacctgcaccccgcctctgcttggaccctctacgccgttgctacaaccgtgatcacccccatgcttcggcatacaattgaaaatagcacggccaacgtgtccctggcggccatcgctaaccaagccgtcgtgctgatgggactcgacaagggctggcctatctctaaaatggatctgggggttccgcttctggctctcggatgctacagccaggtgaatcccctgaccctgacagccgccgtcctccttctgattacccactatgcgatcattggccctgggctgcaggctaaggccacaagagaggctcagaaacgcaccgccgccggaatcatgaagaaccccacggtggacggcattatgacaatcgatctcgaccctgtcatctacgattccaagttcgagaaacaactgggccaggtgatgcttctggttctctgtgctgtgcagctgctgctcatgcggacctcttgggccctttgcgaagcgctgaccctggccacagggcccattaccacactctgggagggaagccctggcaagttttggaatacgaccatcgctgtctccatggccaacattttcagagggagctatctggctggagccggccttgcgttttctatcatgaaatccgtggggacaggaaagcgcggcaccggcagccagggggaaacactgggagagaaatggaagaagaaactcaatcaactgtcccggaaggagttcgacctgtacaaaaagtctggcattaccgaggttgatagaacggaggccaaagaagggctcaagcggggagagatcacccatcacgctgtgagccgcggctccgccaaacttcagtggtttgtcgaaagaaacatggtgattccggaggggcgggtgatcgacctgggatgtggccgcggcgggtggtcttattactgcgctggactgaagaaggttacagaagtcagaggctataccaaagggggacccggccacgaggagcctgtgcccatgagcacatacgggtggaatatcgtgaagctcatgtccggaaaagatgtcttctacctgcctcccgaaaagtgtgacacccttctgtgcgatattggcgagagctctccgtcccctacagttgaagagagccggaccatccgcgtgctcaaaatggtggagccctggctgaagaacaatcagttctgtattaaggtcctgaacccctatatgcctacggtgatcgaacatctcgagagacttcagcggaaacacggcgggatgctggttcgcaatcccctgtctagaaactccacacatgaaatgtactggattagcaatggaaccggcaacatcgtggcctctgtcaatatggtgagccggctcctgcttaacagatttaccatgacacaccgccggcctacgatcgagaaggacgttgatctgggggctggaaccagacacgtgaacgccgaaccggagacacccaatatggacgtcattggcgagcgcatcaaacggattaaggaagaacacaactccacctggcactatgacgatgaaaatccttacaaaacatgggcgtatcatgggtcttacgaggtgaaggccaccggaagcgcttccagcatgatcaacggcgtggtcaagctcctgacaaaaccctgggacgttgtgcctatggtgacccaaatggccatgacggataccacacccttcggccagcagagagtctttaaggaaaaagtggacacccgcacaccgcggtccatgcctgggaccagacgcgttatgggaattacggctgagtggctgtggcggacactcggcagaaataagaaaccccgcctgtgcacccgggaggagttcacaaagaaggtgagaaccaacgccgccatgggggcggtctttacggaggaaaatcaatgggattctgctaaagccgccgtggaggacgaagatttctggaaacttgttgaccgcgagagagagctgcacaaactcggaaagtgtggcagctgcgtgtataacatgatggggaaacgggaaaagaaactgggcgagtttggaaaggctaagggctcccgcgccatctggtacatgtggcttggggctagatacctggagttcgaggccctcggatttctgaatgaggatcattggttctctcgggaaaacagctattccggcgtcgagggggaaggactgcacaaactcggctacatcctgagagacatttctaagatccctgggggcgcgatgtatgccgatgacaccgctggatgggacacacggattaccgaggatgaccttcacaatgaagagaaaatcacacagcagatggatcccgagcatcgccagctggccaacgctatttttaagctcacctaccaaaataaagtggttaaggtgcagagacctacacccaccggcacggtcatggacatcatcagccggaaggatcagcgcgggtccggacaggtgggcacatatgggctgaacaccttcaccaatatggaagtccaacttattagacagatggagggagaaggcgtgctgagcaaagccgacctcgagaacccgcatctgcctgaaaagaaaatcacacagtggctggagaccaagggggttgagcggctcaaacgcatggcgatttctggcgatgactgcgtggtcaagcccatcgatgacagatttgccaacgctctgcttgccctgaatgatatgggaaagattcggaaagacatcccccagtggcaaccttccaagggctggcatgattggcaacaggtgccgttctgtagccaccacttccatgaactcattatgaaagacgggcgcaagctggtggttccctgcagacctcaggacgagcttatcggacgggctcgcatctctcaaggcgccgggtggtccctgagagaaacagcttgtctcggaaaagcctacgcgcagatgtggagcctgatgtattttcaccggcgcgatctgagactcgcctctaacgctatttgctccgccgtgcccgtccattgggtgcctacgagccggaccacatggtccatccacgcccatcaccagtggatgaccacagaggacatgctgaccgtttggaatagagtgtggattgaagataacccctggatggaggacaagacgcctgtcaccacatgggaggatgtgccctaccttggcaagcgcgaagaccaatggtgtgggagcctgatcggcctcacctctcgggctacatgggcccagaatattccgaccgcgatccagcaggtcagaagcctgatcggaaacgaggagttccttgattacatgccttccatgaaacgctttcggaaggaggaggaatctgagggcgctatttggtga

SEQ ID NO: 20641 - RNA, 9873 nt, synthetic construct
  misc_feature 1..9873: note = derived and/or modified CDS sequence (opt5) from DENV-3__KJ189293__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaacacaatcttcaccctgacagtggcttggcggaccgccacgctcattctggctggcgtgtccctgcttccggtctgccagtctagctccatgagaaaaacagactggctgcccatggccgttgccgctatgggggtgcctcccctccctctgtttatcttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacatccgctgatctgaccgtggaaaaagccgcggacattacatgggaggaagaggctgaacaaacgggagttagccataacctcatgatcaccgtggacgatgacggcacaatgcgcattaaggatgacgagaccgagaatatcctgacagtccttctgaaaaccgccctgctcatcgtgtctggcatttttccgtactccatccctgccacgctgcttgtctggcacacctggcagaagcagacacagagaagcggggtgctgtgggatgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataacggcaagagactcgaaccgaattgggcgtccgtgaaaaaggacctgattagctacggcgggggatggcggctttctacccagtggcagaaaggcgaggaagttcaagtcatcgctgtggagcctgggaagaaccccaaaaatttccagacaatgcctggaaccttccagaccacaacgggcgaaattggggccatcgccctggattttaagcccggaacctccggcagccccatcattaaccgcgagggcaaggtggtcgggctgtatggaaatggcgtggttaccaagaacgggggatacgtgtccggcatcgctcagaccaatgccgagcctgacgggccgacacccgaactcgaggaagagatgttcaagaaaagaaacctgaccattatggatcttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggacctgatgtgccacgccacctttacgatgcgcctgctcagccctgtccgggtgccgaattataacctgatcattatggatgaggcccatttcacagaccccgcttccatcgcggccagaggatacatttctacccgcgttggcatgggggaagctgccgccatctttatgacagctacccctcccggaacggccgatgcgttccctcagagcaatgctcccatccaggacgaggagcgggacattccggaaagatcctggaactctggcaatgagtggatcaccgattttgccgggaagacagtgtggttcgtccctagcattaaagccggcaacgacatcgctaactgtcttcgcaagaatggcaaaaaggtgattcagctgtcccggaagacctttgatacagaataccagaaaacaaagctcaacgactgggatttcgtggtcacaaccgacatctctgagatgggagccaattttaaagcggatagagttattgacccccggcgctgcctgaagcccgtgatcctgacggatgggcctgagagagtgatcctcgccggacccatgcctgtcacagctgccagcgctgcccagcggcgcggcagagtggggcggaacccgcagaaagaaaatgaccagtatattttcaccggacaaccccttaacaatgatgaggaccacgctcactggaccgaagccaagatgctgctggacaacatcaatacacctgagggcattatccccgccctcttcgaacctgagagagagaagtccgccgctattgatggggaataccgcctgaaaggcgagagccggaagacctttgttgaacttatgagacgcggagacctgcccgtgtggctcgcccataaagtcgcttctgagggcatcaagtatacagatcggaaatggtgcttcgacgggcagagaaacaatcagatcctggaagagaacatggatgtggagatttggacgaaggaaggagagaaaaagaagctgcgcccgcggtggctcgacgccagaacctactccgatcctcttgccctgaaagaatttaaggacttcgctgcgggccgcaaaagcatcgccctggatctcgttacagagattgggagagtgccctctcacctggctcatcggacccgcaatgcccttgacaacctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggataatcagctggcttacgtggtgattggaatcctcacactggccgcgatcattgccgctaacgagatgggccttctggaaaccacgaagagagacctcggcatgagcaaagagcctggggtcgtttctcccacatcctatctggatgtggacctgcaccccgccagcgcttggaccctctacgccgtggctacaaccgtcatcacccctatgcttcggcatacaattgaaaattctacggccaacgtgagcctggcggccatcgctaaccaagccgttgtgctgatgggactcgacaagggctggccgatttccaaaatggatctgggggtcccccttctggctctcggatgctactctcaggtgaatcctctgaccctgacagccgccgtcctccttctgatcacccactatgcgatcattggccccgggctgcaggctaaggccacaagagaggctcagaaacgcaccgccgccggaatcatgaagaaccctacggtggacggcattatgacaatcgatctcgaccccgttatttacgatagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaatacgaccatcgctgttagcatggccaacattttcagagggtcctatctggctggagccggccttgcgtttagcatcatgaaatctgtggggacaggaaagcgcggcaccggctcccagggggaaacactgggagagaaatggaagaagaaactcaatcaactgagccggaaggagttcgacctgtacaaaaagtccggcattaccgaggtcgatagaacggaggccaaagaagggctcaagcggggagagatcacccatcacgctgtgtctcgcggcagcgccaaacttcagtggtttgtggaaagaaacatggttattcccgaggggcgggtcatcgacctgggatgtggccgcggcgggtggtcctattactgcgctggactgaagaaggtgacagaagtgagaggctataccaaagggggacctggccacgaggagcccgtccctatgtctacatacgggtggaatattgttaagctcatgagcggaaaagatgtgttctacctgcccccggaaaagtgtgacacccttctgtgcgatatcggcgagtccagcccttctcccacagtggaagagtcccggaccatccgcgtcctcaaaatggtggagccctggctgaagaacaatcagttctgtattaaggttctgaacccttatatgcccacggtgatcgaacatctcgagagacttcagcggaaacacggcgggatgctggtccgcaatcctctgagcagaaactctacacatgaaatgtactggatttccaatggaaccggcaacatcgtggccagcgttaatatggtgtctcggctcctgcttaacagatttaccatgacacaccgccggccgacgattgagaaggacgtcgatctgggggctggaaccagacacgtgaacgccgaacccgagacacctaatatggacgtgatcggcgagcgcatcaaacggattaaggaagaacacaacagcacctggcactatgacgatgaaaatccctacaaaacatgggcgtatcatgggtcctacgaggtcaaggccaccggatctgctagctccatgatcaacggcgttgtgaagctcctgacaaaaccttgggacgtggtccccatggtgacccaaatggccatgacggataccacaccgttcggccagcagagagtttttaaggaaaaagtggacacccgcacacctcggagcatgcccgggaccagacgcgtcatgggaattacggctgagtggctgtggcggacactcggcagaaataagaaacctcgcctgtgcacccgggaggagttcacaaagaaggtgagaaccaacgccgccatgggggcggtttttacggaggaaaatcaatgggattccgctaaagccgccgtggaggacgaagatttctggaaacttgtcgaccgcgagagagagctgcacaaactcggaaagtgtggctcttgcgtgtataacatgatggggaaacgggaaaagaaactgggcgagtttggaaaggctaagggcagccgcgccatctggtacatgtggcttggggctagatacctggagttcgaggccctcggatttctgaatgaggatcattggttctcccgggaaaactcttatagcggcgttgagggggaaggactgcacaaactcggctacattctgagagacatctccaagatccccgggggcgcgatgtatgccgatgacaccgctggatgggacacacggattaccgaggatgaccttcacaatgaagagaaaatcacacagcagatggatcctgagcatcgccagctggccaacgctatttttaagctcacctaccaaaataaagtggtcaaggtgcagagacccacaccgaccggcacggtcatggacatcatttctcggaaggatcagcgcgggagcggacaggtgggcacatatgggctgaacaccttcaccaatatggaagcccaacttatcagacagatggagggagaaggcgttctgtccaaagcggacctcgagaaccctcatctgcccgaaaagaaaatcacacagtggctggagaccaagggggtggagcggctcaaacgcatggccattagcggcgatgactgcgtcgtgaagcccatcgatgacagatttgctaacgccctgcttgctctgaatgatatgggaaaggtgcggaaagacattcctcagtggcaaccgtctaagggctggcatgattggcagcaggttcccttctgttcccaccacttccatgaactcatcatgaaagacgggcgcaagctggtggtcccttgcagaccccaggacgagcttattggacgggcccgcatcagccaaggcgctgggtggtctctgagagaaacagcctgtctcggaaaagcgtacgcccagatgtggtccctgatgtattttcaccggcgcgatctgagactcgctagcaacgccatttgctctgccgtgcctgttcattgggtgcccacgtcccggaccacatggagcatccacgctcatcaccagtggatgaccacagaggacatgctgaccgtctggaatagagtgtggatcgaagataacccttggatggaggacaagacgcccgtcaccacatgggaggatgtgccgtaccttggcaagcgcgaagaccaatggtgtgggtccctgattggcctcaccagccgggccacatgggcgcagaatatccctaccgctattcagcaggttagatctctgatcggaaacgaggagttccttgattacatgcccagcatgaaacgctttcggaaggaggaggaatccgagggcgccatttggtga

SEQ ID NO: 20642 - RNA, 9873 nt, synthetic construct
  misc_feature 1..9873: note = derived and/or modified CDS sequence (opt5) from DENV-3__KJ189294__SS-prME
  source 1..9873: mol_type = other RNA
accagcctgtgcctcatgatgatcctgcccgcggctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggcattctggagcagggcaaacggacccttacacctcagcccatggagctgaagtactcttggaaaacctgggggaaggccaagatcgttacagctgaaacccagaactccagcttcattatcgatggacctaatacacccgagtgcccgtctgcgtccagagcctggaacgtgtgggaagtcgaggactatggctttggcgtgttcaccacgaatatctggctccgcctgcgggaagtgtacacacaactgtgtgaccacagacttatgagcgctgccgtcaaagatgagcgcgccgttcatgctgacatggggtactggattgagtcccagaagaacggatcttggaaactcgaaaaggccagcctgatcgaggtgaaaacctgcacctggcctaagtcccacacactgtggtctaatggcgtgctcgaaagcgatatgattatccccaagtccctggcggggcctattagccagcataaccaccggcccggatatcacacccagacggctggcccttggcatcttgggaaactggagctcgactttaattactgcgagggaacaaccgtcgtgatcacagaaaactgtggcaccagaggcccctctctgcgcacaaccacggtttccgggaagctgatccacgagtggtgctgtcggagctgcacccttccgcctctcagatatatgggagaagatggctgttggtacgggatggagattcggcccatctctgaaaaagaggagaatatggtgaagtccctggtcagcgccggatctggcaaagtggacaacttcacaatgggggttctgtgcctcgccattctgtttgaagaggtgatgcgcggaaagttcggcaagaaacatatgatcgctggcgtcttctttaccttcgtgcttctgctcagcgggcaaattacatggagagatatggcccacaccctgatcatgattggatccaatgcgagcgaccggatgggcatgggggttacgtatctggctcttatcgccacatttaagatccagcccttcctggccctcggatttttcctgagaaaactcacctctcgcgaaaacctgcttctgggcgtggggctcgctatggccacaaccctgcagctgcctgaggatattgaacaaatggctaatggaatcgcccttggcctgatggcgctcaagctgattacccagtttgagacataccagctctggacggccctgatctcccttacctgtagcaacacaattttcaccctgacagtcgcttggcggaccgccacgctcatcctggctggcgtgtccctgcttccggtgtgccagtctagctccatgagaaaaacagactggctgcccatggccgtcgccgctatgggggttcctcccctccctctgtttatcttctctctcaaggataccctgaagcgcagaagctggccccttaatgagggagtgatggcggtgggcctggtctccattctggcctctagcctcctgcggaacgacgtgcctatggctgggccccttgttgccggaggcctgctcatcgcctgttatgtgattaccgggacatccgctgatctgaccgtcgaaaaagccgcggacatcacatgggaggaagaggctgaacaaacgggagtgagccataacctcatgattaccgttgacgatgacggcacaatgcgcatcaaggatgacgagaccgagaatatcctgacagtgcttctgaaaaccgccctgctcattgtctctggcatctttccgtactccattcctgccacgctgcttgtgtggcacacctggcagaagcagacacagagaagcggggtcctgtgggatgtgccctctcctcccgaaacccaaaaagctgagctcgaagagggagtttaccggatcaagcagcagggcattttcgggaaaacacaggtgggagtcggcgtgcaaaaggagggggtttttcacaccatgtggcatgtgacacgcggagccgtcctgacgtataacggcaagagactcgaaccgaattgggcgtccgtgaaaaaggacctgatcagctacggcgggggatggcggctttctacccagtggcagaaaggcgaggaagtgcaagttattgctgtcgagcctgggaagaaccccaaaaatttccagacaatgcctggaaccttccagaccacaacgggcgaaatcggggccatcgccctggattttaagcccggaacctccggcagccccattatcaaccgcgagggcaaggtggtggggctgtatggaaatggcgtcgtgaccaagaacgggggatacgtttccggcattgctcagaccaatgccgagcctgacgggccgacacccgaactcgaggaagagatgttcaagaaaagaaacctgaccatcatggatcttcaccctggcagcggaaagacgcggaaatatctgcccgctattgtgcgcgaagccatcaagagacggctcagaacactgatcctcgcgcctacccgcgtcgtggccgctgagatggaggaagccctgaagggccttcccattcggtaccaaaccacagctaccaaatctgagcatacagggagagaaatcgttgacctgatgtgccacgccacctttacgatgcgcctgctcagccctgtgcgggtcccgaattataacctgattatcatggatgaggcccatttcacagaccccgcttccattgcggccagaggatacatctctacccgcgtgggcatgggggaagctgccgccatctttatgacagctacccctcccggaacggccgatgcgttccctcagagcaatgctcccattcaggacgaggagcgggacatcccggaaagatcctggaactctggcaatgagtggattaccgattttgccgggaagacagtttggttcgtgcctagcatcaaagccggcaacgacattgctaactgtcttcgcaagaatggcaaaaaggtcatccagctgtcccggaagacctttgatacagaataccagaaaacaaagctcaacgactgggatttcgtggtgacaaccgacatttctgagatgggagccaattttaaagcggatagagtcatcgacccccggcgctgcctgaagcccgttatcctgacggatgggcctgagagagtgattctcgccggacccatgcctgtgacagctgccagcgctgcccagcggcgcggcagagtcgggcggaacccgcagaaagaaaatgaccagtatatcttcaccggacaaccccttaacaatgatgaggaccacgctcactggaccgaagccaagatgctgctggacaacattaatacacctgagggcatcattcccgccctcttcgaacctgagagagagaagtccgccgctatcgatggggaataccgcctgaaaggcgagagccggaagacctttgtggaacttatgagacgcggagacctgcccgtttggctcgcccataaagtggcttctgagggcatcaagtatacagatcggaaatggtgcttcgacgggcagagaaacaatcagattctggaagagaacatggatgtcgagatctggacgaaggaaggagagaaaaagaagctgcgcccgcggtggctcgacgccagaacctactccgatcctcttgccctgaaagaatttaaggacttcgctgcgggccgcaaaagcattgccctggatctcgtgacagagatcgggagagttccctctcacctggctcatcggacccgcaatgcccttgacaacctggtgatgctccacacatccgaacacggaggcagagcctatcggcatgctgtcgaggagctgcctgaaaccatggagacgctgctccttctgggcctgatgattctcctgaccgggggagccatgctttttctgatcagcggcaaggggatcggaaaaacatccattggcctcatctgtgtgattgcgtctagcgggatgctgtggatggccgaaatccccctgcagtggattgcttccgccatcgtcctcgagttctttatgatggtgcttctgattcctgagcccgaaaagcaacgcaccccgcaggataatcagctggcttacgttgtgatcggaatcctcacactggccgcgattatcgccgctaacgagatgggccttctggaaaccacgaagagagacctcggcatgagcaaagagcctggggtggtctctcccacatcctatctggatgttgacctgcaccccgccagcgcttggaccctctacgccgtggctacaaccgtgattacccctatgcttcggcatacaatcgaaaattctacggccaacgtcagcctggcggccattgctaaccaagccgtggttctgatgggactcgacaagggctggccgatctccaaaatggatctgggggtgccccttctggctctcggatgctactctcaggtcaatcctctgaccctgacagccgccgtgctccttctgatcacccactatgcgattatcggccccgggctgcaggctaaggccacaagagaggctcagaaacgcaccgccgccggaattatgaagaaccctacggtcgacggcatcatgacaattgatctcgaccccgtgatctacgatagcaagttcgagaaacaactgggccaggttatgcttctggtgctctgtgctgtccagctgctgctcatgcggacctcctgggccctttgcgaagcgctgaccctggccacagggcctatcaccacactctgggagggatctccgggcaagttttggaatacgaccattgctgtgagcatggccaacatcttcagagggtcctatctggctggagccggccttgcgtttagcattatgaaatctgttgggacaggaaagcgcggcaccggctcccagggggaaacactgggagagaaatggaagaagaaactcaatcaactgagccggaaggagttcgacctgtacaaaaagtccggcatcaccgaggtggatagaacggaggccaaagaagggctcaagcggggagagattacccatcacgctgtctctcgcggcagcgccaaacttcagtggtttgtggaaagaaacatggtgatccccgaggggcgggttattgacctgggatgtggccgcggcgggtggtcctattactgcgctggactgaagaaggtcacagaagtgagaggctataccaaagggggacctggccacgaggagcccgtgcctatgtctacatacgggtggaatatcgtcaagctcatgagcggaaaagatgttttctacctgcccccggaaaagtgtgacacccttctgtgcgatatcggcgagtccagcccttctcccacagtggaagagtcccggaccattcgcgtgctcaaaatggtcgagccctggctgaagaacaatcagttctgtatcaaggtgctgaacccttatatgcccacggttattgaacatctcgagagacttcagcggaaacacggcgggatgctggtgcgcaatcctctgagcagaaactctacacatgaaatgtactggatctccaatggaaccggcaacattgtcgccagcgtgaatatggtttctcggctcctgcttaacagatttaccatgacacaccgccggccgacgatcgagaaggacgtggatctgggggctggaaccagacacgtcaacgccgaacccgagacacctaatatggacgtgatcggcgagcgcattaaacggatcaaggaagaacacaacagcacctggcactatgacgatgaaaatccctacaaaacatgggcgtatcatgggtcctacgaggtgaaggccaccggatctgctagctccatgattaacggcgtcgttaagctcctgacaaaaccttgggacgtggtgcccatggtcacccaaatggccatgacggataccacaccgttcggccagcagagagtgtttaaggaaaaagttgacacccgcacacctcggagcatgcccgggaccagacgcgtgatgggaatcacggctgagtggctgtggcggacactcggcagaaataagaaacctcgcctgtgcacccgggaggagttcacaaagaaggtcagaaccaacgccgccatgggggcggtgtttacggaggaaaatcaatgggattccgctaaagccgccgttgaggacgaagatttctggaaacttgtggaccgcgagagagagctgcacaaactcggaaagtgtggctcttgcgtctataacatgatggggaaacgggaaaagaaactgggcgagtttggaaaggctaagggcagccgcgccatttggtacatgtggcttggggctagatacctggagttcgaggccctcggatttctgaatgaggatcattggttctcccgggaaaactcttatagcggcgtggagggggaaggactgcacaaactcggctacatcctgagagacatctccaagattcccgggggcgcgatgtatgccgatgacaccgctggatgggacacacggatcaccgaggatgaccttcacaatgaagagaaaattacacagcagatggatcctgagcatcgccagctggccaacgctatctttaagctcacctaccaaaataaagttgtgaaggtccagagacccacaccgaccggcacggtgatggacattatctctcggaaggatcagcgcgggagcggacaggtcggcacatatgggctgaacaccttcaccaatatggaagcccaacttatcagacagatggagggagaaggcgtgctgtccaaagcggacctcgagaaccctcatctgcccgaaaagaaaattacacagtggctggagaccaagggggttgagcggctcaaacgcatggccatcagcggcgatgactgcgtggtcaagcccattgatgacagatttgctaacgccctgcttgctctgaatgatatgggaaaggtgcggaaagacatccctcagtggcaaccgtctaagggctggcatgattggcaacaggtgcccttctgttcccaccacttccatgaactcattatgaaagacgggcgcaagctggttgtgccttgcagaccccaggacgagcttatcggacgggcccgcattagccaaggcgctgggtggtctctgagagaaacagcctgtctcggaaaagcgtacgcccagatgtggtccctgatgtattttcaccggcgcgatctgagactcgctagcaacgccatctgctctgccgtccctgtgcattgggttcccacgtcccggaccacatggagcatccacgctcatcaccagtggatgaccacagaggacatgctgaccgtgtggaatagagtctggattgaagataacccttggatggaggacaagacgcccgtgaccacatgggaggatgtcccgtaccttggcaagcgcgaagaccaatggtgtgggtccctgatcggcctcaccagccgggccacatgggcgcagaatattcctaccgctatccaacaggtgagatctctgattggaaacgaggagttccttgattacatgcccagcatgaaacgctttcggaaggaggaggaatccgagggcgccatctggtga

SEQ ID NO: 20643 - RNA, 9873 nt, synthetic construct
  misc_feature 1..9873: note = derived and/or modified CDS sequence (opt5) from DENV-3__KJ189295__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaacacaatcttcaccctgacagtggcttggcggaccgccacgctcattctggctggcgtgtccctgcttccggtctgccagtctagctccatgagaaaaacagactggctgcccatggccgttgccgctatgggggtgcctcccctccctctgtttatcttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacatccgctgatctgaccgtggaaaaagccgcggacattacatgggaggaagaggctgaacaaacgggagttagccataacctcatgatcaccgtggacgatgacggcacaatgcgcattaaggatgacgagaccgagaatatcctgacagtccttctgaaaaccgccctgctcatcgtgtctggcatttttccgtactccatccctgccacgctgcttgtctggcacacctggcagaagcagacacagagaagcggggtgctgtgggatgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataacggcaagagactcgaaccgaattgggcgtccgtgaaaaaggacctgattagctacggcgggggatggcggctttctacccagtggcagaaaggcgaggaagttcaagtcatcgctgtggagcctgggaagaaccccaaaaatttccagacaatgcctggaaccttccagaccacaacgggcgaaattggggccatcgccctggattttaagcccggaacctccggcagccccatcattaaccgcgagggcaaggtggtcgggctgtatggaaatggcgtggttaccaagaacgggggatacgtgtccggcatcgctcagaccaatgccgagcctgacgggccgacacccgaactcgaggaagagatgttcaagaaaagaaacctgaccattatggatcttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggacctgatgtgccacgccacctttacgatgcgcctgctcagccctgtccgggtgccgaattataacctgatcattatggatgaggcccatttcacagaccccgcttccatcgcggccagaggatacatttctacccgcgttggcatgggggaagctgccgccatctttatgacagctacccctcccggaacggccgatgcgttccctcagagcaatgctcccatccaggacgaggagcgggacattccggaaagatcctggaactctggcaatgagtggatcaccgattttgccgggaagacagtgtggttcgtccctagcattaaagccggcaacgacatcgctaactgtcttcgcaagaatggcaaaaaggtgattcagctgtcccggaagacctttgatacagaataccagaagacaaagctcaacgactgggatttcgtggtcacaaccgacatctctgagatgggagccaattttaaagcggatagagttattgacccccggcgctgcctgaagcccgtgatcctgacggatgggcctgagagagtgatcctcgccggacccatgcctgtcacagctgccagcgctgcccagcggcgcggcagagtggggcggaacccgcagaaagaaaatgaccagtatattttcaccggacaaccccttaacaatgatgaggaccacgctcactggaccgaagccaagatgctgctggacaacatcaatacacctgagggcattatccccgccctcttcgaacctgagagagagaagtccgccgctattgatggggaataccgcctgaaaggcgagagccggaagacctttgttgaacttatgagacgcggagacctgcccgtgtggctcgcccataaagtcgcttctgagggcatcaagtatacagatcggaaatggtgcttcgacgggcagagaaacaatcagatcctggaagagaacatggatgtggagatttggacgaaggaaggagagaaaaagaagctgcgcccgcggtggctcgacgccagaacctactccgatcctcttgccctgaaagaatttaaggacttcgctgcgggccgcaaaagcatcgccctggatctcgttacagagattgggagagtgccctctcacctggctcatcggacccgcaatgcccttgacaacctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggataatcagctggcttacgtggtgattggaatcctcacactggccgcgatcattgccgctaacgagatgggccttctggaaaccacgaagagagacctcggcatgagcaaagagcctggggtcgtttctcccacatcctatctggatgtggacctgcaccccgccagcgcttggaccctctacgccgtggctacaaccgtcatcacccctatgcttcggcatacaattgaaaattctacggccaacgtgagcctggcggccatcgctaaccaagccgttgtgctgatgggactcgacaagggctggccgatttccaaaatggatctgggggtcccccttctggctctcggatgctactctcaggtgaatcctctgaccctgacagccgccgtcctccttctgatcacccactatgcgatcattggccccgggctgcaggctaaggccacaagagaggctcagaaacgcaccgccgccggaatcatgaagaaccctacggtggacggcattatgacaatcgatctcgaccccgttatttacgatagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaatacgaccatcgctgttagcatggccaacattttcagagggtcctatctggctggagccggccttgcgtttagcatcatgaaatctgtggggacaggaaagcgcggcaccggctcccagggggaaacactgggagagaaatggaagaagaaactcaatcaactgagccggaaggagttcgacctgtacaaaaagtccggcattaccgaggtcgatagaacggaggccaaagaagggctcaagcggggagagatcacccatcacgctgtgtctcgcggcagcgccaaacttcagtggtttgtggaaagaaacatggttattcccgaggggcgggtcatcgacctgggatgtggccgcggcgggtggtcctattactgcgctggactgaagaaggtgacagaagtgagaggctataccaaagggggacctggccacgaggagcccgtccctatgtctacatacgggtggaatattgttaagctcatgagcggaaaagatgtgttctacctgcccccggaaaagtgtgacacccttctgtgcgatatcggcgagtccagcccttctcccacagtggaagagtcccggaccatccgcgtcctcaaaatggtggagccctggctgaagaacaatcagttctgtattaaggttctgaacccttatatgcccacggtgatcgaacatctcgagagacttcagcggaaacacggcgggatgctggtccgcaatcctctgagcagaaactctacacatgaaatgtactggatttccaatggaaccggcaacatcgtggccagcgttaatatggtgtctcggctcctgcttaacagatttaccatgacacaccgccggccgacgattgagaaggacgtcgatctgggggctggaaccagacacgtgaacgccgaacccgagacacctaatatggacgtgatcggcgagcgcatcaaacggattaaggaagaacacaacagcacctggcactatgacgatgaaaatccctacaaaacatgggcgtatcatgggtcctacgaggtcaaggccaccggatctgctagctccatgatcaacggcgttgtgaagctcctgacaaaaccttgggacgtggtccccatggtgacccaaatggccatgacggataccacaccgttcggccagcagagagtttttaaggaaaaagtggacacccgcacacctcggagcatgcccgggaccagacgcgtcatgggaattacggctgagtggctgtggcggacactcggcagaaataagaaacctcgcctgtgcacccgggaggagttcacaaagaaggtgagaaccaacgccgccatgggggcggtttttacggaggaaaatcaatgggattccgctaaagccgccgtggaggacgaagatttctggaaacttgtcgaccgcgagagagagctgcacaaactcggaaagtgtggctcttgcgtgtataacatgatggggaaacgggaaaagaaactgggcgagtttggaaaggctaagggcagccgcgccatctggtacatgtggcttggggctagatacctggagttcgaggccctcggatttctgaatgaggatcattggttctcccgggaaaactcttatagcggcgttgagggggaaggactgcacaaactcggctacattctgagagacatctccaagatccccgggggcgcgatgtatgccgatgacaccgctggatgggacacacggattaccgaggatgaccttcacaatgaagagaaaatcacacagcagatggatcctgagcatcgccagctggccaacgctatttttaagctcacctaccaaaataaagtggtcaaggtgcagagacccacaccgaccggcacggtcatggacatcatttctcggaaggatcagcgcgggagcggacaggtgggcacatatgggctgaacaccttcaccaatatggaagcccaacttatcagacagatggagggagaaggcgttctgctcaaagcggacctggagaaccctcatctgcccgaaaagaaaatcacacagtggctcgagaccaagggggtggagcggctgaaacgcatggccatttccggcgatgactgcgtcgtgaagcccatcgatgacagatttgctaacgcccttctggctctcaatgatatgggaaaggtgcggaaagacattcctcagtggcaaccgagcaagggctggcatgattggcagcaggttcccttctgttctcaccacttccatgaactgatcatgaaagacgggcgcaaacttgtggtcccttgcagaccccaggacgagctgattggacgggcccgcatctcccaaggcgctgggtggagcctcagagaaacagcctgtctgggaaaagcgtacgcccagatgtggtctctgatgtattttcaccggcgcgatctcagactggcttccaacgccatttgcagcgccgtgcctgttcattgggtgcccacgtctcggaccacatggtccatccacgctcatcaccagtggatgaccacagaggacatgcttaccgtctggaatagagtgtggatcgaagataacccttggatggaggaccgcacgcccgtcaccacatgggaggatgtgccgtacctgggcaagcgggaagaccaatggtgtgggagcctcattggcctgacctccagagccacatgggcgcagaatatccctaccgctattcagcaggttcgcagccttatcggaaacgaggagttcctggattacatgccctctatgaagcggtttagaaaagaggaggaaagcgagggcgccatttggtga

SEQ ID NO: 20644 - RNA, 9873 nt, synthetic construct
  misc_feature 1..9873: note = derived and/or modified CDS sequence (opt5) from DENV-3__KJ189297__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagagatatggcccacaccctgattatgatcggatccaatgcgagcgaccggatgggcatgggggtgacgtatctggctcttattgccacatttaagatccagcccttcctggccctcggatttttcctgagaaaactcacctctcgcgaaaacctgcttctgggcgtcgggctcgctatggccacaaccctgcagctgcctgaggatatcgaacaaatggctaatggaattgcccttggcctgatggcgctcaagctgatcacccagtttgagacataccagctctggacggccctgatttcccttacctgtagcaacacaatcttcaccctgacagtggcttggcggaccgccacgctcattctggctggcgtgtccctgcttccggtctgccagtctagctccatgagaaaaacagactggctgcccatggccgttgccgctatgggggtgcctcccctccctctgtttatcttctctctcaaggataccctgaagcgcagaagctggccccttaatgagggagtgatggcggtcggcctggtgtccatcctggcctctagcctcctgcggaacgacgttcctatggctgggccccttgtggccggaggcctgctcattgcctgttatgtcatcaccgggacatccgctgatctgaccgtggaaaaagccgcggacattacatgggaggaagaggctgaacaaacgggagttagccataacctcatgatcaccgtggacgatgacggcacaatgcgcattaaggatgacgagaccgagaatatcctgacagtccttctgaaaaccgccctgctcatcgtgtctggcatttttccgtactccatccctgccacgctgcttgtctggcacacctggcagaagcagacacagagaagcggggtgctgtgggatgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataacggcaagagactcgaaccgaattgggcgtccgtgaaaaaggacctgattagctacggcgggggatggcggctttctacccagtggcagaaaggcgaggaagttcaagtcatcgctgtggagcctgggaagaaccccaaaaatttccagacaatgcctggaaccttccagaccacaacgggcgaaattggggccatcgccctggattttaagcccggaacctccggcagccccatcattaaccgcgagggcaaggtggtcgggctgtatggaaatggcgtggttaccaagaacgggggatacgtgtccggcatcgctcagaccaatgccgagcctgacgggccgacacccgaactcgaggaagagatgttcaagaaaagaaacctgaccattatggatcttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggacctgatgtgccacgccacctttacgatgcgcctgctcagccctgtccgggtgccgaattataacctgatcattatggatgaggcccatttcacagaccccgcttccatcgcggccagaggatacatttctacccgcgttggcatgggggaagctgccgccatctttatgacagctacccctcccggaacggccgatgcgttccctcagagcaatgctcccatccaggacgaggagcgggacattccggaaagatcctggaactctggcaatgagtggatcaccgattttgccgggaagacagtgtggttcgtccctagcattaaagccggcaacgacatcgctaactgtcttcgcaagaatggcaaaaaggtgattcagctgtcccggaagacctttgatacagaataccagaaaacaaagctcaacgactgggatttcgtggtcacaaccgacatctctgagatgggagccaattttaaagcggatagagttattgacccccggcgctgcctgaagcccgtgatcctgacggatgggcctgagagagtgatcctcgccggacccatgcctgtcacagctgccagcgctgcccagcggcgcggcagagtggggcggaacccgcagaaagaaaatgaccagtatattttcaccggacaaccccttaacaatgatgaggaccacgctcactggaccgaagccaagatgctgctggacaacatcaatacacctgagggcattatccccgccctcttcgaacctgagagagagaagtccgccgctattgatggggaataccgcctgaaaggcgagagccggaagacctttgttgaacttatgagacgcggagacctgcccgtgtggctcgcccataaagtcgcttctgagggcatcaagtatacagatcggaaatggtgcttcgacgggcagagaaacaatcagatcctggaagagaacatggatgtggagatttggacgaaggaaggagagaaaaagaagctgcgcccgcggtggctcgacgccagaacctactccgatcctcttgccctgaaagaatttaaggacttcgctgcgggccgcaaaagcatcgccctggatctcgttacagagattgggagagtgccctctcacctggctcatcggacccgcaatgcccttgacaacctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggataatcagctggcttacgtggtgattggaatcctcacactggccgcgatcattgccgctaacgagatgggccttctggaaaccacgaagagagacctcggcatgagcaaagagcctggggtcgtttctcccacatcctatctggatgtggacctgcaccccgccagcgcttggaccctctacgccgtggctacaaccgtcatcacccctatgcttcggcatacaattgaaaattctacggccaacgtgagcctggcggccatcgctaaccaagccgttgtgctgatgggactcgacaagggctggccgatttccaaaatggatctgggggtcccccttctggctctcggatgctactctcaggtgaatcctctgaccctgacagccgccgtcctccttctgatcacccactatgcgatcattggccccgggctgcaggctaaggccacaagagaggctcagaaacgcaccgccgccggaatcatgaagaaccctacggtggacggcattatgacaatcgatctcgaccccgttatttacgatagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaatacgaccatcgctgttagcatggccaacattttcagagggtcctatctggctggagccggccttgcgtttagcatcatgaaatctgtggggacaggaaagcgcggcaccggctcccagggggaaacactgggagagaaatggaagaagaaactcaatcaactgagccggaaggagttcgacctgtacaaaaagtccggcattaccgaggtcgatagaacggaggccaaagaagggctcaagcggggagagatcacccatcacgctgtgtctcgcggcagcgccaaacttcagtggtttgtggaaagaaacatggttattcccgaggggcgggtcatcgacctgggatgtggccgcggcgggtggtcctattactgcgctggactgaagaaggtgacagaagtgagaggctataccaaagggggacctggccacgaggagcccgtccctatgtctacatacgggtggaatattgttaagctcatgagcggaaaagatgtgttctacctgcccccggaaaagtgtgacacccttctgtgcgatatcggcgagtccagcccttctcccacagtggaagagtcccggaccatccgcgtcctcaaaatggtggagccctggctgaagaacaatcagttctgtattaaggttctgaacccttatatgcccacggtgatcgaacatctcgagagacttcagcggaaacacggcgggatgctggtccgcaatcctctgagcagaaactctacacatgaaatgtactggatttccaatggaaccggcaacatcgtggccagcgttaatatggtgtctcggctcctgcttaacagatttaccatgacacaccgccggccgacgattgagaaggacgtcgatctgggggctggaaccagacacgtgaacgccgaacccgagacacctaatatggacgtgatcggcgagcgcatcaaacggattaaggaagaacacaacagcacctggcactatgacgatgaaaatccctacaaaacatgggcgtatcatgggtcctacgaggtcaaggccaccggatctgctagctccatgatcaacggcgttgtgaagctcctgacaaaaccttgggacgtggtccccatggtgacccaaatggccatgacggataccacaccgttcggccagcagagagtttttaaggaaaaagtggacacccgcacacctcggagcatgcccgggaccagacgcgtcatgggaattacggctgagtggctgtggcggacactcggcagaaataagaaacctcgcctgtgcacccgggaggagttcacaaagaaggtgagaaccaacgccgccatgggggcggtttttacggaggaaaatcaatgggattccgctaaagccgccgtggaggacgaagatttctggaaacttgtcgaccgcgagagagagctgcacaaactcggaaagtgtggctcttgcgtgtataacatgatggggaaacgggaaaagaaactgggcgagtttggaaaggctaagggcagccgcgccatctggtacatgtggcttggggctagatacctggagttcgaggccctcggatttctgaatgaggatcattggttctcccgggaaaactcttatagcggcgttgagggggaaggactgcacaaactcggctacattctgagagacatctcccagatccccgggggcgcgatgtatgccgatgacaccgctggatgggacacacggattaccgaggatgaccttcacaatgaagagaagatcacacagcagatggatcctgagcatcgccaactggccaacgctatttttaaactcacctaccagaataaggtggtcaaagtgcagagacccacaccgaccggcacggtcatggacatcatttctcggaaggatcagcgcgggagcggacaagtgggcacatatgggctgaacaccttcaccaatatggaagcccagcttatcagacagatggagggagaaggcgttctgtccaaggcggacctcgagaaccctcatctgcccgagaaaaagatcacacagtggctggagaccaaaggggtggagcggctcaagcgcatggccattagcggcgatgactgcgtcgtgaaacccatcgatgacagatttgctaacgccctgcttgctctgaatgatatgggaaaggtgcggaaggacattcctcaatggcagccgtctaaaggctggcatgattggcagcaggttcccttctgttcccaccacttccatgaactcatcatgaaggacgggcgcaaactggtggtcccttgcagaccccaagacgagcttattggacgggcccgcatcagccagggcgctgggtggtctctgagagaaacagcctgtctcggaaaggcgtacgcccagatgtggtccctgatgtattttcaccggcgcgatctgagactcgctagcaacgccatttgctctgccgtgcctgttcattgggtgcccacgtcccggaccacatggagcatccacgctcatcaccaatggatgaccacagaggacatgctgaccgtctggaatagagtgtggatcgaagataacccttggatggaggacaaaacgcccgtcaccacatgggaggatgtgccgtaccttggcaagcgcgaagaccagtggtgtgggtccctgattggcctcaccagccgggccacatgggcgcagaatatccctaccgctattcagcaagttagatctctgatcggaaacgaggagttccttgattacatgcccagcatgaagcgctttcggaaagaggaggaatccgagggcgccatttggtga

SEQ ID NO: 20645 - RNA, 9873 nt, synthetic construct
  misc_feature 1..9873: note = derived and/or modified CDS sequence (opt5) from DENV-3__KJ189298__SS-prME
  source 1..9873: mol_type = other RNA
accagcctgtgcctcatgatgatcctgcccgcggctcttgccttccacctgacatcccgggacggcgagcctcggatgattgtggggaagaatgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctaccctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgccccctgtaaaatccctttcagcacagaggacggccatgggaaggcgcacaacggaagactgattaccgctaatcccgttgtgacgaaaaaggaggaacccgtcaacatcgaggccgaacctccgttcggcgagtccaatattgtgatcgggattggcgataacgccctgaaaatcaattggtataagaagggatctagcatcggcaaaatgtttgaagctacagccagaggggctagacgcatggccattcttggagacaccgcgtgggatttcggctccgtcgggggagttctcaacagcctgggcaagatggtccatcaaatctttgggtctgcctacaccgctctgttctccggcgtgagctgggtgatgaaaattggaatcggcgtcctcctgacatggattgggcttaattctaagaacaccagcatgtccttttcttgcatcgccattggaatcatcacactgtatctcggcgctgtggttcaggccgacatggggtgtgtgattaattggaaaggaaaggagctgaagtgcggcagcgggatcttcgtcacgaacgaggtgcacacctggacagaacagtacaaatttcaggcggattcccccaagcggctggccaccgctattgccggcgcttgggagaatggagtttgtggcatcagaagcacaacccgcatggaaaaccttctctggaaacaaattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggccaagattgtgacagctgaaacccagaactccagcttcatcattgatggacctaatacacccgagtgcccgtctgcgtccagagcctggaacgtctgggaagtggaggactatggctttggcgtgttcaccacgaatatctggctccgcctgcgggaagtctacacacaactgtgtgaccacagacttatgagcgctgccgttaaagatgagcgcgccgtgcatgctgacatggggtactggatcgagtcccagaagaacggatcttggaaactcgaaaaggccagcctgattgaggtgaaaacctgcacctggcctaagtcccacacactgtggtctaatggcgtcctcgaaagcgatatgatcattcccaagtccctggcggggcctatcagccagcataaccaccggcccggatatcacacccagacggctggcccttggcatcttgggaaactggagctcgactttaattactgcgagggaacaaccgtggttattacagaaaactgtggcaccagaggcccctctctgcgcacaaccacggtgtccgggaagctgatccacgagtggtgctgtcggagctgcacccttccgcctctcagatatatgggagaagatggctgttggtacgggatggagatccggcccatttctgaaaaagaggagaatatggtcaagtccctggtgagcgccggatctggcaaagttgacaacttcacaatgggggtgctgtgcctcgccatcctgtttgaagaggtcatgcgcggaaagttcggcaagaaacatatgattgctggcgtgttctttaccttcgttcttctgctcagcgggcaaatcacatggagaaatatggcccacaccctgattatgatcggatccaacgcgagcgatcggatgggcatgggggtgacgtatctggctcttattgccacatttaagatccagcccttcctggccctcggatttttcctgagaaaactcacctctcgcgaaaatctgcttctgggcgtcgggctcgctatggccacaaccctgcagctgcctgaggacatcgaacaaatggctaacggaattgcccttggcctgatggcgctcaagctgatcacccagtttgagacataccagctctggacggccctgatttcccttacctgtagcaatacaatcttcaccctgacagtggcttggcggaccgccacgctcattctggctggcgtgtccctgcttccggtctgccagtctagctccatgagaaaaacagattggctgcccatggccgttgccgctatgggggtgcctcccctccctctgtttatcttctctctcaaggacaccctgaagcgcagaagctggccccttaacgagggagtgatggcggtcggcctggtgtccatcctggcctctagcctcctgcggaacgatgttcctatggctgggccccttgtggccggaggcctgctcattgcctgttatgtcatcaccgggacatccgctgacctgaccgtggaaaaagccgcggatattacatgggaggaagaggctgaacaaacgggagttagccataatctcatgatcaccgtggacgacgatggcacaatgcgcattaaggacgatgagaccgagaacatcctgacagtccttctgaaaaccgccctgctcatcgtgtctggcatttttccgtactccatccctgccacgctgcttgtctggcacacctggcagaagcagacacagagaagcggggtgctgtgggacgttccctctcctcccgaaacccaaaaagctgagctcgaagagggagtgtaccggattaagcagcagggcatcttcgggaaaacacaggtcggagtgggcgttcaaaaggagggggtgtttcacaccatgtggcatgtcacacgcggagccgtgctgacgtataatggcaagagactcgaaccgaactgggcgtccgtgaaaaaggatctgattagctacggcgggggatggcggctttctacccagtggcagaaaggcgaggaagttcaagtcatcgctgtggagcctgggaagaatcccaaaaacttccagacaatgcctggaaccttccagaccacaacgggcgaaattggggccatcgccctggactttaagcccggaacctccggcagccccatcattaatcgcgagggcaaggtggtcgggctgtatggaaacggcgtggttaccaagaatgggggatacgtgtccggcatcgctcagaccaacgccgagcctgatgggccgacacccgaactcgaggaagagatgttcaagaaaagaaatctgaccattatggaccttcaccctggcagcggaaagacgcggaaatatctgcccgctatcgtccgcgaagccattaagagacggctcagaacactgatcctcgcgcctacccgcgtggttgccgctgagatggaggaagccctgaagggccttcccatccggtaccaaaccacagctaccaaatctgagcatacagggagagaaattgtggatctgatgtgccacgccacctttacgatgcgcctgctcagccctgtccgggtgccgaactataatctgatcattatggacgaggcccatttcacagatcccgcttccatcgcggccagaggatacatttctacccgcgttggcatgggggaagctgccgccatctttatgacagctacccctcccggaacggccgacgcgttccctcagagcaacgctcccatccaggatgaggagcgggacattccggaaagatcctggaactctggcaacgagtggatcaccgactttgccgggaagacagtgtggttcgtccctagcattaaagccggcaacgatatcgctaattgtcttcgcaagaacggcaaaaaggtgattcagctgtcccggaagacctttgacacagaataccagaaaacaaagctcaatgattgggacttcgtggtcacaaccgatatctctgagatgggagccaactttaaagcggacagagttattgatccccggcgctgcctgaagcccgtgatcctgacggacgggcctgagagagtgatcctcgccggacccatgcctgtcacagctgccagcgctgcccagcggcgcggcagagtggggcggaatccgcagaaagaaaacgatcagtatattttcaccggacaaccccttaataacgacgaggatcacgctcactggaccgaagccaagatgctgctggacaatatcaacacacctgagggcattatccccgccctcttcgaacctgagagagagaagtccgccgctattgacggggaataccgcctgaaaggcgagagccggaagacctttgttgaacttatgagacgcggagatctgcccgtgtggctcgcccataaagtcgcttctgagggcatcaagtatacagaccggaaatggtgcttcgatgggcagagaaataaccagatcctggaagagaatatggacgtggagatttggacgaaggaaggagagaaaaagaagctgcgcccgcggtggctcgatgccagaacctactccgaccctcttgccctgaaagaatttaaggatttcgctgcgggccgcaaaagcatcgccctggacctcgttacagagattgggagagtgccctctcacctggctcatcggacccgcaacgcccttgataatctggtcatgctccacacatccgaacacggaggcagagcctatcggcatgctgtggaggagctgcctgaaaccatggagacgctgctccttctgggcctgatgatcctcctgaccgggggagccatgctttttctgattagcggcaaggggatcggaaaaacatccatcggcctcatttgtgtcatcgcgtctagcgggatgctgtggatggccgaaattcccctgcagtggatcgcttccgccattgtgctcgagttctttatgatggttcttctgatccctgagcccgaaaagcaacgcaccccgcaggacaaccagctggcttacgtggtgattggaatcctcacactggccgcgatcattgccgctaatgagatgggccttctggaaaccacgaagagagatctcggcatgagcaaagagcctggggtcgtttctcccacatcctatctggacgtggatctgcaccccgccagcgcttggaccctctacgccgtggctacaaccgtcatcacccctatgcttcggcatacaattgaaaactctacggccaacgtgagcctggcggccatcgctaatcaagccgttgtgctgatgggactcgacaagggctggccgatttccaaaatggacctgggggtcccccttctggctctcggatgctactctcaggtgaaccctctgaccctgacagccgccgtcctccttctgatcacccactatgcgatcattggccccgggctgcaggctaaggccacaagagaggctcagaaacgcaccgccgccggaatcatgaagaatcctacggtggatggcattatgacaatcgacctcgatcccgttatttacgacagcaagttcgagaaacaactgggccaggtgatgcttctggtcctctgtgctgtgcagctgctgctcatgcggacctcctgggccctttgcgaagcgctgaccctggccacagggcctatcaccacactctgggagggatctccgggcaagttttggaacacgaccatcgctgttagcatggccaatattttcagagggtcctatctggctggagccggccttgcgtttagcatcatgaaatctgtggggacaggaaagcgcggcaccggctcccagggggaaacactgggagagaaatggaagaagaaactcaaccaactgagccggaaggagttcgatctgtacaaaaagtccggcattaccgaggtcgacagaacggaggccaaagaagggctcaagcggggagagatcacccatcacgctgtgtctcgcggcagcgccaaacttcagtggtttgtggaaagaaatatggttattcccgaggggcgggtcatcgatctgggatgtggccgcggcgggtggtcctattactgcgctggactgaagaaggtgacagaagtgagaggctataccaaagggggacctggccacgaggagcccgtccctatgtctacatacgggtggaacattgttaagctcatgagcggaaaagacgtgttctacctgcccccggaaaagtgtgatacccttctgtgcgacatcggcgagtccagcccttctcccacagtggaagagtcccggaccatccgcgtcctcaaaatggtggagccctggctgaagaataaccagttctgtattaaggttctgaatccttatatgcccacggtgatcgaacatctcgagagacttcagcggaaacacggcgggatgctggtccgcaaccctctgagcagaaattctacacatgaaatgtactggatttccaacggaaccggcaatatcgtggccagcgttaacatggtgtctcggctcctgcttaacagatttaccatgacacaccgccggccgacgattgagaaggatgtcgacctgggggctggaaccagacacgtgaatgccgaacccgagacacctaacatggatgtgatcggcgagcgcatcaaacggattaaggaggaacacaatagcacctggcactatgacgaagagaacccctacaaaacatgggcgtatcatgggtcctacgaagtcaaggccaccggatctgctagctccatgatcaatggcgttgtgaagctcctgacaaaaccttgggacgtggtccccatggtgacccaaatggccatgacggataccacaccgttcggccagcagagagtttttaaggagaaagtggacacccgcacacctcggagcatgcccgggaccagacgcgtcatgggaattacggctgagtggctgtggcggacactcggcagaaacaagaaacctcgcctgtgcacccgggaagagttcacaaagaaggtgagaaccaatgccgccatgggggcggtttttacggaagagaaccaatgggattccgctaaagccgccgtggaagacgaggatttctggaaacttgtcgaccgcgagagagaactgcacaaactcggaaagtgtggctcttgcgtgtataatatgatggggaaacgggagaagaaactgggcgaatttggaaaggctaagggcagccgcgccatctggtacatgtggcttggggctagatacctggagttcgaggccctcggatttctgaacgaagatcattggttctcccgggaaaattcttatagcggcgttgaaggggagggactgcacaaactcggctacattctgagagacatctccaagatccccgggggcgcgatgtatgccgatgacaccgctggatgggatacacggattaccgaagacgaccttcacaacgaggagaaaatcacacagcagatggatcctgaacatcgccagctggccaatgctatttttaagctcacctaccaaaacaaagtggtcaaggtgcagagacccacaccgaccggcacggtcatggacatcatttctcggaaggatcagcgcgggagcggacaggtgggcacatatgggctgaataccttcaccaacatggaggcccaacttatcagacagatggaaggagagggcgttctgtccaaagcggacctcgaaaaccctcatctgcccgagaagaaaatcacacagtggctggagaccaagggggtggaacggctcaaacgcatggccattagcggcgatgactgcgtcgtgaagcccatcgatgacagatttgctaatgccctgcttgctctgaacgatatgggaaaggtgcggaaagacattcctcagtggcaaccgtctaagggctggcatgattggcagcaggttcccttctgttcccaccacttccatgagctcatcatgaaagacgggcgcaagctggtggtcccttgcagaccccaggatgaacttattggacgggcccgcatcagccaaggcgctgggtggtctctgagagagacagcctgtctcggaaaagcgtacgcccagatgtggtccctgatgtattttcaccggcgcgacctgagactcgctagcaatgccatttgctctgccgtgcctgttcattgggtgcccacgtcccggaccacatggagcatccacgctcatcaccagtggatgaccacagaagacatgctgaccgtctggaacagagtgtggatcgaggataatccttggatggaggacaagacgcccgtcaccacatgggaagatgtgccgtaccttggcaagcgcgaggaccaatggtgtgggtccctgattggcctcaccagccgggccacatgggcgcagaacatccctaccgctattcagcaggttagatctctgatcggaaatgaagagttccttgattacatgcccagcatgaaacgctttcggaaggaggaagagtccgaaggcgccatttggtga

SEQ ID NO: 20646 - RNA, 9873 nt, synthetic construct
  misc_feature 1..9873: note = derived and/or modified CDS sequence (opt5) from DENV-3__KJ189301__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaaatctctcctgtttaagacggcgagcggcaccaatatgtgtacacttatcgctatggatctgggggaaatgtgcgacgataccgtgacatacaaatgtccgcatattaccgaagttgaacccgaagacatcgattgctggtgtaacctcacatccacctgggtgacgtatggaacctgcaatcaggccggcgaacaccggcgggacaagcgctctgtggccctggctcctcatgtcgggatgggactggatacaagaacccagacatggatgagcgccgagggcgcttggagacaggtggaaaaagttgagacctgggccctccgccaccccggcttcacgattctggcgctttttctggcccattacatcgggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccagctggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctacgctgcccgaatatggcaccctggggctcgagtgctcccctcgcacaggactggacttcaatgagatgattcttctgaccatgaaaaacaaggcctggatggtccatagacagtggtttttcgatctccccctgccgtggacaagcggcgccaccacggaaacacctacctggaatcggaaagagcttctggtgacatttaagaacgctcacgcgaaaaagcaagaagtcgtggttctcgggtctcaggagggagccatgcacaccgctctgaccggcgccacagaaatccaaaattccgggggcacgagcattttcgccggacatctgaagtgtcgcctcaaaatggacaagctggagcttaaaggcatgtcttacgctatgtgcaccaacacatttgtgctgaagaaagaggtctccgaaacccagcacgggacaatcctcattaaggtggagtacaagggagaagatgccccctgtaaaatccctttcagcaccgaggacggccatgggaaggcgcacaacggaagactgatcacggctaatcccgttgtgaccaagaaggaggaacccgtcaacattgaggccgaacctccgttcggcgagtccaatatcgtgattgggatcggcgataacgccctgaaaattaattggtataagaagggatctagcatcggcaaaatgtttgaagctaccgccagaggggctagacgcatggccatccttggagacaccgcgtgggatttcggctccgtcgggggagttctcaacagcctgggcaagatggtccatcaaatttttgggtctgcctacacagctctgttctccggcgtgagctgggtgatgaaaatcggaattggcgtcctcctgacctggatcgggcttaattctaagaacacaagcatgtccttttcttgcattgccatcggaattatcacgctgtatctcggcgctgtggttcaggccgacatggggtgtgtgatcaattggaaaggaaaggagctgaagtgcggcagcgggattttcgtcaccaacgaggtgcacacatggaccgaacagtacaaatttcaggcggattcccccaagcggctggccacagctatcgccggcgcttgggagaatggagtttgtggcattagaagcaccacgcgcatggaaaaccttctctggaaacaaatcgccaatgagctgaactatattctgtgggaaaataacgtgaagctcaccgtcgtggttggggacatcatcggagtgctggagcggggcaaaagaacacttacccctcagcccatggagctgaagtactcttggaaaacatgggggaaggccaagattgtcaccgctgaaacacagaactccagcttcatcattgatggacctaatacccccgagtgcccgtctgcgtcccgcgcctggaacgtgtgggaagtggaggactatggctttggcgtcttcacgacaaatatctggctccggctgagagaggcttacacccagctgtgtgaccaccgccttatgagcgccgccgttaaagatgagcgggctgtgcatgccgacatggggtactggattgagtcccaaaagaacggatcttggaaactcgaaaaggcgagcctgatcgaggtgaaaacctgcacatggcctaagtcccacaccctgtggtctaatggcgtcctcgaaagcgatatgatcattcccaagtccctggctgggcctatcagccagcataaccacagacccggatatcacacgcagacagccggcccttggcatcttgggaaactggagctcgactttaattactgcgagggaaccacagtggttattaccgaaaactgtggcacacgcggcccctctctgcggaccacgaccgtgtccgggaagctgatccacgagtggtgctgtagaagctgcacacttccgcctctccggtatatgggagaagatggctgttggtacgggatggagattcgccccatctctgaaaaagaggagaatatggtcaagtccctggtgagcgccggatctggcaaagttgacaacttcaccatgggggtgctgtgcctcgctatcctgtttgaagaggtcatgagaggaaagttcggcaagaaacatatgattgccggcgtgttctttacattcgttcttctgctcagcgggcagatcacctggcgggatatggcgcacacgctgattatgatcggatccaatgctagcgacagaatgggcatgggggtgacatatctggcccttattgccacctttaagatccaacccttcctggctctcggatttttcctgcgcaaactcacatctcgggaaaacctgcttctgggcgtcgggctcgccatggctaccaccctgcagctgcctgaggatattgaacagatggccaatggaatcgcgcttggcctgatggccctcaagctgatcacacaatttgagacgtaccagctctggaccgctctgatttcccttacatgtagcaacaccatcttcacactgaccgtggcctggagaacggctacactcattctggccggcgtgtccctgcttccggtctgccagtctagctccatgcgcaaaaccgactggctgcccatggccgttgctgcgatgggggtgcctcccctccctctgtttatcttctctctcaaggataccctgaagagacggagctggccccttaatgagggagtgatggccgtcggcctggtgtccattctggcttctagcctcctgcgcaacgacgttcctatggccgggccccttgtggccggaggcctgctcatcgcttgttatgtcatcacagggacctccgccgatctgacagtggaaaaagcggctgacattacgtgggaggaagaggccgaacagaccggagttagccataacctcatgatcacagtggacgatgacggcaccatgagaattaaggatgacgagacagagaatatcctgaccgtccttctgaaaacggccctgctcattgtgtctggcatctttccgtactccatccctgctaccctgcttgtctggcacacatggcaaaagcagacccagcggagcggggtgctgtgggatgttccctctcctcccgaaacacagaaagccgagctcgaagagggagtgtaccgcattaagcaacagggcatcttcgggaaaacccaggtcggagtgggcgttcagaaggagggggtgtttcacacaatgtggcatgtcacgagaggagcggtgctgacctataacggcaagcggctcgaaccgaattgggcttccgtgaaaaaggacctgattagctacggcgggggatggcgcctttctacacaatggcagaaaggcgaggaagttcaggtcatcgccgtggagcctgggaagaaccccaaaaatttccaaaccatgcctggaaccttccagacaacgaccggcgaaattggggccatcgctctggattttaagcccggaacatccggcagccccattatcaacagagagggcaaggtggtcgggctgtatggaaatggcgtggttaccaaaaacgggggatacgtgtccggcatcgcccagacaaatgctgagcctgacgggccgacccccgaactcgaggaagagatgttcaagaaacggaacctgacgattatggatcttcaccctggcagcggaaagacacgcaaatatctgcccgccatcgtcagagaagcgattaagcggagactccgcaccctgatcctcgcccctacccgggtggttgctgccgagatggaggaagctctgaagggccttcccattagataccagacaaccgccacaaaatctgagcataccgggcgcgaaatcgtggacctgatgtgccacgccacgtttacaatgcggctgctcagccctgtcagagtgccgaattataacctgatcattatggatgaggctcatttcaccgaccccgcgtccatcgccgctcgcggatacatttctacacgggttggcatgggggaagccgccgctatctttatgaccgccacgcctcccggaaccgcggatgctttccctcaaagcaatgcccccattcaggacgaggagagagacatcccggaacgctcctggaactctggcaatgagtggatcacagattttgccgggaagaccgtgtggttcgtccctagcattaaagctggcaacgacatcgccaactgtcttcggaagaatggcaaaaaggtgattcagctgtccagaaagacatttgataccgaataccagaaaacaaagctcaacgactgggatttcgtggtcaccacggacatctctgagatgggagcgaattttaaagccgatcgggttattgacccccgcagatgcctgaagcccgtgatcctgacagatgggcctgagcgggtgattctcgctggacccatgcctgtcaccgccgctagcgccgctcaacgcagaggccgggtggggagaaacccgcagaaagaaaatgaccagtatatcttcaccggacagccccttaacaatgatgaggaccacgcccactggacagaagcgaagatgctgctggacaacatcaatacccctgagggcattatccccgccctcttcgaacctgagcgcgagaagtccgctgccattgatggggaataccggctgaaaggcgagagcagaaagacatttgttgaacttatgcgccggggagacctgcccgtgtggctcgctcataaagtcgcctctgagggcatcaagtatacggatagaaaatggtgcttcgacgggcaacgcaacaatcagattctggaagagaacatggatgtggagatctggaccaaggaaggagagaaaaagaagctgcggccgagatggctcgacgcccgcacatactccgatcctcttgctctgaaagaatttaaggacttcgcggccggcagaaaaagcatcgctctggatctcgttaccgagattgggcgggtgccctctcacctggcccatcgcacaagaaatgcccttgacaacctggtcatgctccacacctccgaacacggaggccgggcttatcgccatgccgtggaggagctgcctgaaacgatggagaccctgctccttctgggcctgatgatcctcctgacagggggagcgatgctttttctgattagcggcaaggggatcggaaaaacctccattggcctcatctgtgtcatcgcctctagcgggatgctgtggatggctgaaattcccctgcagtggatcgcctccgctattgtgctcgagttctttatgatggttcttctggtgcctgagcccgaaaagcagagaacaccgcaagataatcagctggcctacgtggtcatcggcattctcaccctggcggccatcattgctgccaacgagatgggccttctggaaacgacaaagcgggacctcggcatgagcaaagagcctggggttgtgtctcccacctcctatctggatgtggacctgcaccccgctagcgcctggacactctacgctgtcgccaccaccgtgatcacacctatgcttagacatacgatcgaaaattctaccgcgaacgttagcctggccgctattgccaaccaggctgtggtcctgatgggactcgacaagggctggccgatctccaaaatggatctgggggtgccccttctggccctcggatgctactctcaagtcaatcctctgacactgaccgccgcggtgctccttctgattacacactatgctatcattggccccgggctgcaggccaaggctacccgcgaggcccagaaacggacggccgctggaatcatgaagaaccctacagttgacggcatcatgaccattgatctcgaccccgtgatctacgatagcaagttcgagaaacagctgggccaagtcatgcttctggtgctctgtgccgttcagctgctgctcatgagaacctcctgggcgctttgcgaagccctgacactggctaccgggcctattacaacgctctgggagggatctccgggcaagttttggaataccacaatcgccgtgagcatggctaacattttccgcgggtcctatctggccggagcgggccttgcctttagcatcatgaaatctgtcgggaccggaaagcggggcacaggctcccagggggaaaccctgggagagaaatggaagaagaaactcaatcagctgagcagaaaggagttcgacctgtacaaaaagtccggcatcacggaggtggatcggaccgaggctaaagaagggctcaagcgcggagagattacacatcacgccgtgtctagaggcagcgctaaacttcaatggtttgttgaacggaacatggtcatccccgaggggcgcgtgattgacctgggatgtggcagaggcgggtggtcctattactgcgccggactgaagaaggtgaccgaagtccggggctatacaaaagggggacctggccacgaggagcccgttcctatgtctacctacgggtggaatatcgtgaagctcatgagcggaaaagatgtgttctacctgcccccggaaaagtgtgacacacttctgtgcgatattggcgagtccagcccttctcccaccgtcgaagagtcccgcacgatcagagtgctcaaaatggttgagccctggctgaagaacaatcagttctgtattaaggtgctgaacccttatatgcccacagtcatcgaacatctcgagcggcttcagcgcaaacacggcgggatgctggtgagaaatcctctgagccggaactctacccatgaaatgtactggatctccaatggaaccggcaacattgttgctagcgtgaatatggtctctagactcctgcttaaccgctttacaatgacgcaccggagaccgaccatcgagaaggacgtggatctgggggccggaacacgccacgtgaacgcggaacccgagacccctaatatggacgtcattggcgagcggatcaaaagaattaaggaagaacacaacagcacatggcactatgacgatgaaaatccctacaaaacctgggcctatcatgggtcctacgaggttaaggctacaggatctgccagctccatgatcaacggcgtggtgaagctcctgaccaaaccttgggacgtcgtgcccatggttacgcagatggctatgaccgatacaaccccgttcggccaacagcgcgtgtttaaggaaaaagtcgacacacggacccctagaagcatgcccgggacgcgccgggtgatgggaatcacagccgagtggctgtggagaaccctcggccgcaataagaaacctcggctgtgcacaagagaggagttcaccaagaaggttcgcacgaacgccgcgatgggggctgtgtttaccgaggaaaatcagtgggattccgccaaagccgctgtcgaggacgaagatttctggaaacttgtggacagagagcgggagctgcacaaactcggaaagtgtggctcttgcgtttataacatgatggggaaacgcgaaaagaaactgggcgagtttggaaaggccaagggcagcagagctatttggtacatgtggcttggggcccggtacctggagttcgaggcgctcggatttctgaatgaggatcattggttctccagagaaaactcttatagcggcgtggagggggaaggactgcacaaactcggctacatcctgcgggacatttccaagatccccgggggcgccatgtatgctgatgacacagccggatgggacacccgcattacagaggatgaccttcacaatgaagagaaaatcacccaacagatggatcctgagcatagacagctggctaacgccatctttaagctcacataccagaataaagtcgtgaaggtccaacggcccaccccgacgggcacagtgatggacattatctctcgcaaggatcagagagggagcggacaggttggcacctatgggctgaacaccttcacaaatatggaagcgcagcttattcggcaaatggagggagaaggcgtgctgtccaaagccgacctcgagaaccctcatctgcccgaaaagaaaatcacccagtggctggagacaaagggggtcgagcgcctcaaaagaatggctattagcggcgatgactgcgtggtgaagcccatcgatgaccggtttgccaacgctctgcttgccctgaatgatatgggaaaggttcgcaaagacatccctcagtggcagccgtctaagggctggcatgattggcaacaggtgcccttctgttcccaccacttccatgaactcattatgaaagacgggagaaagctggtcgtgccttgccggccccaggacgagcttatcggacgcgctagaattagccagggcgccgggtggtctctgcgggaaacggcgtgtctcggaaaagcctacgctcaaatgtggtccctgatgtattttcaccgcagagatctgcggctcgccagcaacgccatctgctctgctgttcctgtgcattgggtccccacctccagaacaacctggagcattcacgcccatcaccagtggatgacaaccgaggacatgctgacggtgtggaatcgcgtctggatcgaagataacccttggatggaggacaagacccccgtgacaacctgggaggatgttccgtaccttggcaagcgggaagaccagtggtgtgggtccctgattggcctcacaagcagagcgacctgggctcaaaatatccctacggccatccaacaggtgcgctctctgattggaaacgaggagttccttgattacatgcccagcatgaaacggtttagaaaggaggaggaatccgagggcgccatctggtga

SEQ ID NO: 20647 - RNA, 9873 nt, synthetic construct
  misc_feature 1..9873: note = derived and/or modified CDS sequence (opt5) from DENV-3__KF955456__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgtgctcccggaggaacaggaccagaattatgtctgtaaacacacatacgtggatcggggctgggggaacggatgcggcctgttcgggaagggaagccttgttacctgcgctaagtttcaatgtctggagcccatcgagggcaaagtggtccagtatgaaaatctcaagtacaccgtgattatcacagttcataccggggaccagcaccaggtgggaaacgagacacaaggcgtcacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggttgtgctcgggtctcaggagggagctatgcacacagccctgaccggcgccacagaaattcagaattccgggggcaccagcatcttcgctggacatctgaagtgtcgcctcaaaatggacaagctggagcttaaaggcatgtcttacgccatgtgcaccaacacatttgtcctgaagaaagaggtgtccgaaacgcagcacgggaccattctcatcaaggttgagtacaagggagaagatgcgccctgtaaaatccctttcagcacagaggacggccaagggaaggctcataacggaagactgattaccgccaatcccgtggtcacaaaaaaggaggaacccgtgaacatcgaggccgaacctccgttcggcgagtccaatattgtgatcgggattggcgataacgctctgaaaatcaattggtataagaagggatctagcatcggcaaaatgtttgaagccaccgctcggggggccagacgcatggcgattcttggagacacggcctgggatttcggctccgttgggggagtcctcaacagcctgggcaagatggtgcaccagatctttgggtctgcttacacagccctgttctccggcgtgagctgggtcatgaaaattggaatcggcgtgctcctgacctggattgggcttaattctaagaacaccagcatgtccttttcttgcatcgctattggaatcatcacactgtatctcggcgccgttgtgcaggcggacaccgggtgtgtcattaattggaaaggaaaggagctgaagtgcggcagcgggatcttcgtgacaaacgaggttcatacgtggaccgaacagtacaaatttcaagccgattcccccaagcggctggctacagccattgctggcgcctgggagaatggagtgtgtggcatcagaagcaccacacgcatggaaaaccttctctggaaacaggtcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtgtgggaagtcgaggactatggctttggcgttttcacaaccaatatttggctcaaactgcgcgaagtgtacacgcagctgtgtgaccaccggcttatgagcgccgccgtgaaggatgagagagctgtccacgccgacatggggtactggatcgagtcccagaaaaacggatcttggaagctcgaaaaagcgagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatctctgaaaaggaggagaatatggttaaatccctggtgagcgccggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcgcacacactggtgatgatcggatccaatgctagcgacagaatgggcatgggggtgacctacctggcccttattgccacgtttaaaatccagcccttcctggctctcggatttttcctgcggaagctcacatctagagaaaacctgcttctgggcgtcgggctcgccatggctaccacactgcaactgcctgaggatattgaacagatggccaatggaatcgcgcttggcctgatggccctcaaactgatcacccagtttgagacctatcagctctggacagctctgatttcccttacgtgtagcaacaccatcttcacactgaccgttgcctggcgcacagctaccctcattctggccggcgtgtccctgcttccggtgtgccaatctagctccatgcggaagtctgactggctgcccatgacggtcgccgctatgggggtgcctcccctccctctgtttatcttcagcctcaaggatacactgaaaagacgctcctggccccttaatgagggagttatggcggtgggcctggtctctattctggccagctccctcctgagaaacgacgtgcctatggctgggccccttgttgccggaggcctgctcatcgcctgttacgtgatcaccgggaccagcgctgatctgacagtcgaaaaggccgcggacgtgacctgggaggaagaggctgaacagacaggagtctctcataacctcatgattacggtggacgatgacggcaccatgcggatcaaagatgacgagacagagaatattctgaccgttcttctgaagacagccctgctcatcgtgtccggcatttttccgtacagcatccctgccaccctgcttgtctggcacacgtggcagaaacagacccgcagatctggggtgctgtgggatgttccctcccctcccgaaacacaaaaggctgagctcgaagagggagtgtatcggatcaaacagcagggcattttcgggaagacccaggtcggagtgggcgtgcaaaaggagggggtttttcatacaatgtggcacgtcacccgcggagccgtgctgacatacaacggcaaaagactcgaaccgaattgggcgagcgtgaagaaagacctgatctcttatggcgggggatggcggctttccgctcagtggcagaagggcgaggaagtccaagtgattgccgttgagcctgggaaaaaccccaagaatttccagacgatgcctggaaccttccagacaaccaccggcgaaatcggggccattgctctggattttaagcccggaacaagcggctcccccatcattaaccgcgagggcaaagtggtcgggctgtacggaaatggcgtggttacgaagaacgggggatatgtgagcggcatcgcccagaccaatgctgagcctgacgggccgacacccgaactcgaggaagagatgttcaaaaagagaaacctgaccatcatggatcttcaccctggctctggaaaaacacggaagtacctgcccgccattgtccgcgaagcgatcaagagacggctcagaaccctgattctcgcccctacgcgcgtggttgctgccgagatggaggaagctctgaaaggccttcccatccggtatcaaacaaccgccaccaagagcgagcatacagggagagaaattgtggacctgatgtgccacgccacctttacaatgcgcctgctctcccctgtccgggtgccgaattacaacctgatcatcatggatgaggctcatttcaccgaccccgcgtctattgccgctagaggatacatcagcacgcgcgtgggcatgggggaagccgccgctatttttatgacagccacccctcccggaacagcggatgctttccctcagtccaatgcccccatccaggacgaggagcgggacattccggaaagatcttggaacagcggcaatgagtggatcaccgattttgccgggaaaacggtctggttcgttccttccatcaaggctggcaacgacattgccaactgtcttcgcaaaaatggaaagaaggtgatccagctgtctcggaaaacctttgatacagaatatcaaaagaccaaactcaacgactgggatttcgtggtcacaaccgacattagcgagatgggcgcgaattttaaggccgatagagtgatcgacccccggcgctgcctgaaacccgttattctgacagatgggcctgagagagtgatcctcgctggacccatgcctgtcaccgccgcttccgccgctcagcggcgcggcagagtggggcggaacccgcagaaggaaaatgaccagtacattttcacgggacaaccccttaacaatgatgaggaccacgcccattggacagaagcgaagatgctgctggacaacatcaatacccctgagggcatcattcccgccctcttcgaacctgagagagagaaaagcgctgccatcgatggggaatatcgcctgaagggcgagtctcggaaaacctttgttgaacttatgagacgcggagacctgcccgtgtggctcgctcacaaggtcgcctccgagggcattaaatacacagatcggaagtggtgcttcgacgggcagagaaacaatcagatcctggaagagaacatggatgtggagatttggaccaaagaaggagagaagaagaaactgcgcccgcggtggctcgacgccagaacatatagcgatcctcttgctctgaaggaatttaaagacttcgcggccggccgcaagtctatcgctctggatctcgtcacggagatcgggagagtgccctcccacctggcccatcggacccgcaatgcccttgacaacctggttatgctccacacaagcgaacatggaggcaaagcttacagacacgccgtggaggagctgcctgaaaccatggagacactgctccttctgggcctgatgattctcctgaccgggggagcgatgctttttctgatctccggcaaggggattggaaagacgtctatcggcctcatttgtgtgatcgccagctccgggatgctgtggatggctgaaatccccctgcagtggattgccagcgctatcgtcctcgagttctttatgatggttcttctgattcctgagcccgaaaaacaacggaccccgcaggataatcagctggcctatgtggtgatcggaattctcacactggcggccatcattgctgccaacgagatgggccttctggaaaccacaaagcgcgacctcggcatgtctaaagagcctggggtcgtgtcccccaccagctacctggatgttgacctgcaccccgcttctgcctggacgctctacgctgtggccacaaccgtcatcacacctatgcttagacataccatcgaaaatagcaccgcgaacgtgtccctggccgctattgccaaccaagctgtcgtgctgatgggactcgacaagggctggccgatctctaaaatggatctgggggttccccttctggccctcggatgctatagccaggtgaatcctctgacactgacggccgcggtcctccttctgattacccactacgctatcattggccccgggctgcaggccaaggctacacgggaggcccagaagagaaccgccgctggaatcatgaaaaaccctacagtggacggcatcatgaccattgatctcgaccccgttatctatgattccaagttcgagaaacaactgggccaggtgatgcttctggtcctctgtgccattcagctgctgctcatgcgcacgtcttgggcgctttgcgaagccctgacactggctaccgggcctatcaccacactctgggagggaagcccgggcaagttttggaataccacaattgccgtgtccatggctaacatcttccgggggagctacctggccggagcgggccttgccttttctatcatgaaatccgtggggacgggaaagagaggcaccggcagccagggggaaacactgggagagaagtggaaaaagaaactcaatcaactgtcccgcaaggaattcgacctgtataaaaagtctggcattaccgaggttgatcggacagaggctaaagaagggctcaagagaggagagatcacccatcacgccgtcagccggggctccgctaagcttcagtggtttgtggaacgcaacatggtgattcccgaggggagagtcatcgacctgggatgtggccggggcgggtggtcttactattgcgccggactgaaaaaggttacggaagtgcgcggctacaccaaagggggacctggccatgaggagcccgtgcctatgagcacatacgggtggaatattgtcaagctcatgtccggaaaagatgtgttctatctgcccccggaaaagtgtgacacccttctgtgcgatatcggcgagagctctccttcccccacagttgaagagagcagaaccattcgggtgctcaagatggtcgagccctggctgaaaaacaatcagttctgtatcaaggtgctgaacccttacatgcccacagttatcgaacacctcgagcgccttcagagaaaatatggcgggatgctggtgcggaatcctctgtctcgcaactccacccacgaaatgtactggattagcaatggaacgggcaacatcgtcgcttctgtgaatatggtgagcagactcctgcttaaccggtttacaatgacccatagacgcccgaccattgagaaggacgtcgatctgggggccggaacacggcacgttaacgcggaacccgagacgcctaatatggacgtgatcggcgagagaattaaacgcatcaaggaagagcataactccacctggcactatgacgatgaaaatccctacaagacatgggcctatcacgggtcttacgaggtgaaagctaccggaagcgcctccagcatgatcaacggcgtcgtgaagctcctgacaaaaccttgggacgttgtgcccatggtcacccaaatggctatgacagataccacgccgttcggccagcagcgggtgtttaaggaaaaagttgacaccagaacacctcgctccatgcccgggacccggagagtgatgggaattacagccgagtggctgtggcgcaccctcggccggaataagaagcctagactgtgcacgcgcgaggaattcacaaaaaaggtccggaccaacgccgcgatgggggctgtgtttacagaggaaaatcaatgggattctgccaaagccgctgttgaggacgaagatttctggaagcttgtggacagagagcgcgagctgcataaactcggaaagtgtggcagctgcgtctacaacatgatggggaaaagagaaaagaagctgggcgagtttggaaaagccaagggctcccgggctatctggtatatgtggcttggggcccgctacctggaattcgaggcgctcggatttctgaatgaggatcactggttctctagagaaaacagctattccggcgtggagggggaaggactgcataaactcggctacattctgcgggacatctctaagattcccgggggcgccatgtatgctgatgacaccgccggatgggacacgagaatcaccgaggatgaccttcacaatgaagagaaaatcacacagcagatggatcctgagcatcggcagctggctaacgccatttttaagctcacctaccaaaataaggtcgtgaaagttcagcgccccacaccgaccggcacagtgatggacatcattagcagaaaggatcagcgggggtccggacaggtcggcacctatgggctgaacacgttcacaaatatggaagcgcaacttatccgccagatggagggagaaggcgtgctgaccaaagccgacctcgagaaccctcacctgagcgaaaagaaaattacccagtggctggagacaaagggggtggagagactcaagcggatggctatctctggcgatgactgcgttgtgaaacccatcgatgaccgctttgccaacgctctgcttgccctgaatgatatgggaaaggtcagaaaagacattccccagtggcaaccttccaagggctggcacgattggcagcaggtgccgttctgtagccatcacttccatgaactcatcatgaaagacgggcggaagctggttgtgccctgccgccctcaggacgagcttattggaagagctcggatctctcaaggcgccgggtggtccctgcgcgaaaccgcgtgtctcggaaaggcctacgctcagatgtggagcctgatgtactttcacagacgggatctgcgcctcgcctctaacgccatttgctccgctgtccccgtgcactgggtccctacaagcagaacgacctggtccatccatgcccaccatcagtggatgacaaccgaggacatgctgacagtgtggaatcgggtttggattgaagataacccctggatggaggacaaaacccctgtgacgacctgggagaatgtcccctatcttggcaagagagaagatcaatggtgtgggagcctgatcggcctcacatctcgcgcgacctgggctcagaacatcccgacagccattcagcaggtgcggagcctgatcggaaatgaggaattccttgactacatgccttccatgaaaagatttcgcaaggaggaggaatctgagggcgccatttggtga

SEQ ID NO: 20648 - RNA, 9873 nt, synthetic construct
  misc_feature 1..9873: note = derived and/or modified CDS sequence (opt5) from DENV-3__KF955465__SS-prME
  source 1..9873: mol_type = other RNA
accagcctgtgcatcatgatgattctccccgccgctctggccttccaccttacgtcccgggacggcgaacctcggatgatcgtggggaagaacgaacgcggaaaatctctgctctttaagacggcgagcggcattaatatgtgtaccctgatcgctatggatcttggggaaatgtgcgacgatacagtcacctacaaatgtccgcatattacagaagttgaacccgaagacatcgattgctggtgtaacctgacctccacatgggtgacctatggaacgtgcaatcaggccggcgaacaccggcgggacaagcgctctgtggccctcgctcctcatgtcgggatgggactggataccagaacacagacctggatgagcgccgaaggcgcttggagacaggtggaaaaagttgagacatgggccctgcgccaccccggcttcaccatcctcgcgctgtttcttgcccattacattgggacgtccctgacacagaaggtggtcatcttcattctcctgatgcttgtgaccccttctatgacaatgagatgtgttggagtgggcaaccgggactttgtcgaagggctgagcggagctacctgggtggatgtggtcctcgagcacggcgggtgcgttaccacaatggccaagaataaacccacgctggacatcgagctgcagaagaccgaagctacacaactcgccaccctgcgcaaactttgtattgagggaaagatcacaaacattaccacggattccagatgccctacacagggcgaagcggtgctgccggaggaacaggaccagaattatgtgtgtaaacacacctacgtcgatcggggctgggggaacggatgcggcctcttcgggaagggaagcctggtgacctgcgccaagtttcaatgtcttgagcccatcgagggcaaagttgtgcagtatgaaaatctgaagtacacagtcatcattaccgtgcatacaggggaccagcaccaggttggaaacgagacgcaaggcgtgaccgctgaaatcacacctcaggcctctaccacagaggctattctccccgaatatggcaccctggggctggagtgctcccctcgcacgggactcgacttcaatgagatggtcctgcttaccatgaaaaacaaggcctggatggtgcatagacagtggtttttcgatctgcccctcccgtggacaagcggcgccaccacagaaacccctacgtggaatcggaaagagctgcttgtcacatttaagaacgctcacgcgaaaaagcaagaagtggttgtgctggggtctcaggagggagccatgcacaccgctctcacaggcgccaccgaaatccaaaattccgggggcaccagcattttcgccggacatctgaagtgtcgcctgaaaatggacaagctcgagctgaaaggcatgtcttacgctatgtgcacaaacacgtttgtccttaagaaagaggtgtccgaaacccagcacgggacaatcctgatcaaggttgagtacaagggagaagatgtgccctgtaaaattcctttcagcaccgaggacggccaagggaaggcccataacggaagactcatcacagcgaatcccgtcgtgaccaaaaaggaggaacccgtgaacattgaggctgaacctccgttcggcgagtccaatatcgttattgggatcggcgataacgccctgaaaatcaattggtataagaagggatctagcattggcaaaatgtttgaagccacggctagaggggccagacgcatggctatcctgggagacacagcctgggatttcggctccgtcgggggagtgcttaacagcctcggcaagatggtgcaccagatttttgggtctgcgtacaccgccctgttctccggcgtcagctgggtgatgaaaatcggaattggcgttctgctcacctggatcgggctcaattctaagaacacaagcatgtccttttcttgcattgtgatcggaatcattaccctttatctgggcgctgtcgtgcaggccgacatggggtgtgttatcaattggaaaggaaaggagctcaagtgcggcagcgggattttcgtgacaaacgaggtccatacgtggaccgaacagtacaaatttcaagctgattcccccaagcggctggccacagcgatcgccggcgcttgggagaatggagtgtgtggcattagaagcaccacacgcatggaaaacctgctttggaaacagatcgccaatgagctcaactatatcctgtgggaaaataacattaagctgaccgttgtggtcggggacatcattggagtgctcgagcagggcaaacggacgctgacccctcagcccatggagcttaagtactcttggaaaacatgggggaaggctaagatcgtgaccgccgaaacacaaaactccagcttcattatcgatggacctaatacccccgagtgcccgtctgcctccagagcttggaacgtctgggaagttgaggactatggctttggcgtgttcacaaccaatatctggctgaaactccgcgaagtgtacacgcagctgtgtgaccaccggctgatgagcgcggccgtcaaggatgagagagctgtgcacgccgacatggggtactggattgagtcccagaaaaacggatcttggaaacttgaaaaagccagcctcatcgaggttaagacatgcacctggcctaagtcccataccctgtggtctaatggcgtgctggaaagcgatatgattatccccaaatccctcgctgggcctattagccagcacaactatcgccccggataccatacacaaaccgccggcccttggcacctggggaaacttgagctggactttaattattgcgagggaacgacagtcgtgatcaccgaaaactgtggcacacggggcccctctctcagaaccacaaccgtttccgggaaactgatccacgagtggtgctgtcgcagctgcacgctgccgcctcttcggtacatgggagaagatggctgttggtatgggatggagattagacccatctctgaaaaggaggagaatatggtgaaatccctcgtcagcgcgggatctggcaaggtggacaacttcaccatgggggttctgtgcctggctattctctttgaagaggtgatgcggggaaagttcggcaaaaagcatatgatcgccggcgtcttctttacattcgtgctgcttctgagcgggcagattacctggcgcgatatggcccacacactcatcatgattggatccaatgctagcgacagaatgggcatgggggtgacctacctggccctgatcgcgacgtttaaaatccagcccttccttgctctgggatttttcctccggaagctgacatctagagaaaacctcctgcttggcgtcgggctggccatggccaccacactccaactgcctgaggatattgaacagatggctaatggaatcgccctgggccttatggctctgaaactcattacccagtttgagacctatcagctgtggacagccctcatctccctgacgtgtagcaacaccattttcacacttaccgttgcgtggcgcacagccaccctgatcctcgctggcgtgtccctgctgccggtgtgccaatctagctccatgcggaagacggactggcttcccatgacagtcgccgctatgggggtgcctcccctgcctctctttatcttctctctgaaggataccctcaaaagacgcagctggcccctgaatgagggagttatggccgtgggccttgtctccattctggcctctagcctgctcagaaacgacgtgcctatggctgggcccctggttgcgggaggccttctgatcgcctgttacgtgattaccgggacatccgctgatctcaccgtcgaaaaggccgccgacgtgacatgggaggaagaggctgaacagacgggagtcagccataacctgatgatcaccgtggacgatgacggcacaatgcggattaaagatgacgagaccgagaatatcctcacagttctgcttaagaccgccctgctgatcgtgtctggcatttttccgtactccatccctgcgacgctcctggtctggcacacctggcagaaacagacacaacgcagcggggtgctttgggatgttccctctcctcccgaaacccagaaggctgagctggaagagggagtgtatagaattaaacagcagggcatcttcgggaagacacaagtcggagtgggcgtgcagaaggagggggtttttcataccatgtggcacgtcacacggggagccgtgctcacgtacaacggcaaacgcctggaaccgaattgggcctccgtgaagaaagacctcattagctatggcgggggatggagactgtctgctcagtggcaaaagggcgaggaagtccaggtgatcgccgttgagcctgggaaaaaccccaagaatttccagaccatgcctggaacattccagaccaccacaggcgaaattggggcgatcgctcttgattttaagcccggaacgtccggcagccccatcattaaccgggagggcaaagtggtcgggctgtacggaaatggcgtggttaccaagaacgggggatatgtgtccggcatcgcccaaacaaatgccgagcctgacgggccgacccccgaactggaggaagagatgttcaaaaagcgcaacctcacaattatggatctgcaccctggcagcggaaaaaccagaaagtaccttcccgctatcgtccgggaagccattaagcgcagactgcggacgctcatcctggctcctacaagagtggttgccgcggagatggaggaagccctcaaaggcctgcccatccgctatcagaccaccgctacaaagtctgagcataccgggcgggaaattgtggaccttatgtgccacgccacatttaccatgagactgctgagccctgtccgcgtgccgaattacaacctcatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtctggttcgttcctagcattaaggctggcaacgacatcgccaactgtctgcgcaaaaatggaaagaaggtgattcaactttccagaaaaacatttgataccgaatatcagaagacaaaactgaacgactgggatttcgtggtcaccacagacatctctgagatgggcgccaattttaaggctgatcgggtgattgaccccagacggtgcctcaaacccgttatcctgaccgatgggcctgagcgcgtgatcctggccggacccatgcctgtcacggcggccagcgctgcccagagacggggccgcgtggggagaaacccgcagaaggaaaatgaccaatacattttcacaggacagcccctcaacaatgatgaggaccacgctcattggaccgaagccaagatgcttctggacaacatcaatacccctgagggcattatccccgctctgttcgaacctgagcgggagaaatccgccgcgattgatggggaatatagactcaagggcgagagccgcaaaacatttgttgaactgatgcggagaggagaccttcccgtgtggctggcccacaaggtcgcttctgagggcatcaaatacaccgatcgcaagtggtgcttcgacgggcagcggaacaatcagatcctcgaagagaacatggatgtggagatttggacaaaagaaggagagaagaagaaactgagaccgcgctggctggacgcccggacgtattccgatcctctcgctcttaaggaatttaaagacttcgccgccggcagaaagagcatcgctctggatctggtcaccgagattgggcgcgtgccctctcacctcgcgcatagaacacggaatgccctggacaaccttgttatgctgcacacctccgaacatggaggcaaggcttaccgccacgccgtggaggagctccctgaaacaatggagaccctgctgctccttggcctgatgatcctgctcacagggggagccatgctgtttcttattagcggcaaggggatcggaaagacctccatcggcctgatttgtgtgatcgcttctagcgggatgctctggatggccgaaattcccctgcaatggatcgcgtccgccattgtcctggagttctttatgatggttctccttatccctgagcccgaaaaacagagaacaccgcaggataatcaactggcttatgtggtgattggaatcctgaccctcgccgctatcattgccgcgaacgagatgggcctgcttgaaacaaccaagcgggacctgggcatgagcaaagagcctggggtcgtgtctcccacgtcctacctcgatgttgacctgcaccccgccagcgcttggacactgtacgccgtggctaccacagtcatcacccctatgctccgccataccattgaaaattctacagccaacgtgagccttgctgccatcgcgaaccaggccgtcgtgctgatgggactggacaagggctggccgatttccaaaatggatctcggggttcccctgcttgctctgggatgctattctcaggtgaatcctctcacgctgaccgccgctgtcctgctccttatcacacactacgccatcattggccccgggctgcaggccaaggcgaccagagaggctcaaaagcggacagccgctggaatcatgaaaaaccctaccgtggacggcattatgacgatcgatctggaccccgttatttatgatagcaagttcgagaaacagctcggccaggtgatgctgcttgtcctgtgtgccgtgcagctcctgctgatgagaacatcctgggccctctgcgaagctcttaccctggccaccgggcctatcacaaccctgtgggagggatctccgggcaagttttggaatacaacgatcgcggtgagcatggccaacattttccgcgggtcctacctcgctggagccggcctggcttttagcatcatgaaatctgttgggaccggaaagcggggcacaggctcccaaggggaaacccttggagagaagtggaaaaagaaactgaatcagctcagcagaaaggagttcgacctgtataaaaagtccggcattacagaggtcgatcgcaccgaggccaaagaagggctgaagcggggagagatcacgcatcacgcggtgtctagaggcagcgccaagctccagtggtttgtggaacggaacatggtcattcccgaggggcgcgttatcgaccttggatgtggcagaggcgggtggtcctactattgcgctggactgaaaaaggtgaccgaagtgcggggctacacaaaagggggacctggccatgaggagcccgtccctatgtctacctacgggtggaatattgtgaagctgatgagcggaaaagatgttttctatctgcccccggaaaagtgtgacacactgctttgcgatatcggcgagtccagcccttctcccaccgtggaagagtcccgcacaatcagagtcctgaagatggtggagccctggctcaaaaacaatcagttctgtattaaggttctgaacccttacatgcccaccgtgatcgaacacctggagcggctccaacgcaaacacggcgggatgcttgtcagaaatcctctgagccggaactctacgcatgaaatgtattggatttccaatggaacaggcaacatcgtggccagcgtgaatatggtctctcgcctgctcctgaacagatttaccatgacccaccggagaccgacaattgagaaggacgttgatcttggggctggaacgcgccatgtgaacgccgaacccgagacccctaatatggacgtgatcggcgagcggatcaaaagaattaaggaagaacacaacagcacatggcactacgacgatgaaaatccctataagacctgggcttaccatgggtcctatgaggtcaaagccacaggatctgcgagctccatgatcaacggcgtggttaagctgctcaccaaaccttgggacgtggtccccatggtgacacagatggccatgaccgatacgaccccgttcggccagcaacgcgtttttaaggaaaaagtggacacacggacccctagaagcatgcccgggacacgccgggtcatgggaattaccgctgagtggctgtggagaacgctgggccgcaataagaagcctcggctctgcacaagagaggagttcaccaaaaaggtgcgcacaaacgccgctatgggggccgtttttaccgaggaaaatcagtgggattccgccaaagcggctgtggaggacgaagatttctggatcctggtcgaccgggagagagagcttcacaagctgggaaaatgtggctcttgcgtgtacaacatgatggggaagcgcgagaagaagctcggcgagtttggaaaggccaaaggcagcagagccatttggtacatgtggctgggggctcggtatcttgagttcgaggccctgggatttctcaatgaggatcattggttctcccgcgaaaactcttacagcggcgtcgagggggaaggactgcacaagctgggctatatcctcagagacatctccaaaattcccgggggcgctatgtacgccgatgacacggcgggatgggacacccggatcacagaggatgacctgcataatgaagagaagattacccagcagatggatcctgagcacagacaacttgccaacgctatctttaaactgacatatcagaataaggtggttaaggtgcagcggcccaccccgacaggcaccgtcatggacattatctctcgcaaagatcagagagggagcggacaagtgggcacgtacgggctcaacacattcaccaatatggaagcccagctgatccggcagatggagggagaaggcgtgctttccaaggctgacctggagaaccctcacctccccgagaaaaagattacccagtggctggagacaaaaggggttgagcgcctgaagagaatggccatcagcggcgatgactgcgtggtcaagcccattgatgaccggtttgcgaacgccctcctggctcttaatgatatgggaaaagtgcgcaaggacatccctcaatggcagccgtctaaaggctggcatgattggcagcaggttcccttctgttcccaccatttccacgaactgattatgaaggacgggagaaaactcgtggtcccttgccggccccaagacgagctgatcggacgcgccagaattagccagggcgctgggtggtctcttcgggaaaccgcctgtctgggaaaggcttatgcccagatgtggtccctcatgtactttcaccgcagagatctgcggctggcgagcaacgccatctgctctgctgtgcctgtccattgggtgcccacatcccgcacgacctggagcatccacgcccatcaccaatggatgacaaccgaggacatgctcacagtttggaatagagtgtggattgaagataacccttggatggaggacaagacccccgtcacgacctgggagaatgtgccgtacctgggcaaacgggaagatcagtggtgtgggtcccttatcggcctgacaagcagagccacctgggctcagaacattcctacagccatccagcaagttcgctctctcattggaaatgaggagttcctggactatatgcccagcatgaagcggtttagaaaagaggaggaatccgagggcgcgatctggtga

SEQ ID NO: 20649 - RNA, 9873 nt, synthetic construct
  misc_feature 1..9873: note = derived and/or modified CDS sequence (opt5) from DENV-3__KF955466__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaatatcagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcagaaggaaaatgaccaatacattttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtttggctcgcccacaaggtggcttctgagggcatcaaatacaccgatcgcaagtggtgcttcgacgggcagcggaacaatcagatcctggaagagaacatggatgtcgagatttggacaaaagaaggagagaagaagaaactgagaccgcgctggctcgacgcccggacgtattccgatcctcttgctctgaaggaatttaaagacttcgccgccggcagaaagagcatcgctctggatctcgtgaccgagattgggcgcgtcccctctcacctggcgcatagaacacggaatgcccttgacaacctggtgatgctccacacctccgaacatggaggcaaggcttaccgccacgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaaacagagaacaccgcaggataatcaactggcttatgttgtgattggaatcctcaccctggccgctatcattgccgcgaacgagatgggccttctggaaacaaccaagcgggacctcggcatgagcaaagagcctggggtggtctctcccacgtcctacctggatgtggacctgcaccccgccagcgcttggacactctacgccgttgctaccacagtgatcacccctatgcttcgccataccattgaaaattctacagccaacgtcagcctggctgccatcgcgaaccaggccgtggtcctgatgggactcgacaagggctggccgatttccaaaatggatctgggggtgccccttctggctctcggatgctattctcaggttaatcctctgacgctgaccgccgctgtgctccttctgatcacacactacgccatcattggccccgggctgcaggccaaggcgaccagagaggctcaaaagcggacagccgctggaatcatgaaaaaccctaccgtcgacggcattatgacgatcgatctcgaccccgtgatttatgatagcaagttcgagaaacagctgggccaggttatgcttctggtgctctgtgccgtccagctgctgctcatgagaacatcctgggccctttgcgaagctctgaccctggccaccgggcctatcacaaccctctgggagggatctccgggcaagttttggaatacaacgatcgcggtgagcatggccaacattttccgcgggtcctacctggctggagccggccttgcttttagcatcatgaaatctgtggggaccggaaagcggggcacaggctcccaaggggaaaccctgggagagaagtggaaaaagaaactcaatcagctgagcagaaaggagttcgacctgtataaaaagtccggcattacagaggttgatcgcaccgaggccaaagaagggctcaagcggggagagatcacgcatcacgcggtctctagaggcagcgccaaacttcagtggtttgtggaacggaacatggtgattcccgaggggcgcgtcatcgacctgggatgtggcagaggcgggtggtcctactattgcgctggactgaaaaaggttaccgaagtgcggggctacacaaaagggggacctggccatgaggagcccgtgcctatgtctacctacgggtggaatattgtcaagctcatgagcggaaaagatgtgttctatctgcccccggaaaagtgtgacacacttctgtgcgatatcggcgagtccagcccttctcccaccgttgaagagtcccgcacaatcagagtgctcaagatggtcgagccctggctgaaaaacaatcagttctgtattaaggtgctgaacccttacatgcccaccgttatcgaacacctcgagcggcttcaacgcaaacacggcgggatgctggtgagaaatcctctgagccggaactctacgcatgaaatgtattggatttccaatggaacaggcaacatcgtcgccagcgtgaatatggtgtctcgcctcctgcttaacagatttaccatgacccaccggagaccgacaattgagaaggacgtcgatctgggggctggaacgcgccatgttaacgccgaacccgagacccctaatatggacgtgatcggcgagcggatcaaaagaattaaggaagaacacaacagcacatggcactacgacgatgaaaatccctataagacctgggcttaccatgggtcctatgaggtgaaagccacaggatctgcgagctccatgatcaacggcgtcgtgaagctcctgaccaaaccttgggacgttgtgcccatggtcacacagatggccatgaccgatacgaccccgttcggccagcaacgcgtgtttaaggaaaaagttgacacacggacccctagaagcatgcccgggacacgccgggtgatgggaattaccgctgagtggctgtggagaacgctcggccgcaataagaagcctcggctgtgcacaagagaggagttcaccaaaaaggtccgcacaaacgccgctatgggggccgtgtttaccgaggaaaatcagtgggattccgccaaagcggctgttgaggacgaagatttctggatgcttgtggaccgggagagagagctgcacaagctcggaaaatgtggctcttgcgtctacaacatgatggggaagcgcgagaaaaagctgggcgagtttggaaaggccaaaggcagcagagccatctggtacatgtggcttggggctcggtatctggagttcgaggccctcggatttctgaatgaggatcattggttctcccgcgaaaactcttacagcggcgtggagggggaaggactgcacaagctcggctatattctgagagacatctccaaaatccccgggggcgctatgtacgccgatgacacggcgggatgggacacccggattacagaggatgaccttcataatgaagagaagatcacccagcagatggatcctgagcacagacaactggccaacgctatttttaaactcacatatcagaataaggtcgtgaaggttcagcggcccaccccgacaggcaccgtgatggacatcatttctcgcaaagatcagagagggagcggacaagtcggcacgtacgggctgaacacattcaccaatatggaagcccagcttatccggcagatggagggagaaggcgtgctgtccaaggctgacctcgagaaccctcatctgcccgagaaaaagatcacccagtggctggagacaaaaggggtggagcgcctcaagagaatggccattagcggcgatgactgcgttgtgaagcccatcgatgaccggtttgcgaacgccctgcttgctctgaatgatatgggaaaagtccgcaaggacattcctcaatggcagccgtctaaaggctggcatgattggcaacaggtgcccttctgttcccaccatttccacgaactcatcatgaaggacgggagaaaactggttgtgccttgccggccccaagacgagcttattggacgcgccagaatcagccagggcgctgggtggtctctgcgggaaaccgcctgtctcggaaaggcttatgcccagatgtggtccctgatgtactttcaccgcagagatctgcggctcgcgagcaacgccatttgctctgctgtccctgtgcattgggtccccacatcccgcacgacctggagcatccacgcccatcaccaatggatgacaaccgaggacatgctgacagtgtggaatagagtttggatcgaagataacccttggatggaggacaagacccccgtgacgacctgggagaatgtcccgtaccttggcaaacgggaagatcagtggtgtgggtccctgattggcctcacaagcagagccacctgggctcagaacatccctacagccattcagcaagtgcgctctctgatcggaaatgaggagttccttgactatatgcccagcatgaagcggtttagaaaagaggaggaatccgagggcgcgatttggtga

SEQ ID NO: 20650 - RNA, 9873 nt, synthetic construct
  misc_feature 1..9873: note = derived and/or modified CDS sequence (opt5) from DENV-3__KF955468__SS-prME
  source 1..9873: mol_type = other RNA
accagcctgtgcctcatgatgatcctgcccgccgctcttgccttccacctgacgtcccgggacggcgagcctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattctgacactcaccgtcgcgtggcgcacagccaccctgatcctggctggcgtttcccttctgccggtgtgccaatctagctccatgcggaagacggactggctccccatgacagtggccgctatgggggtccctcccctgcctctcttcatcttttctctgaaggatacccttaaaagacgcagctggcccctgaatgagggagtgatggccgttggcctggtgtccattctcgcctctagcctgcttagaaacgacgtccctatggctgggcccctggtggcgggaggcctcctgatcgcctgttacgttattaccgggacatccgctgatctcaccgtggaaaaggccgccgacgtcacatgggaggaagaggctgaacagacgggagtgagccataacctgatgatcaccgtcgacgatgacggcacaatgcggattaaagatgacgagaccgagaatatccttacagtgctgctgaagaccgccctcctgatcgtttctggcattttcccgtactccatccctgcgacgcttctggtgtggcacacctggcagaaacagacacaacgcagcggggtcctctgggatgtgccctctcctcccgaaacccagaaggctgagctggaagagggagtttatagaattaaacagcagggcatctttgggaagacacaagtgggagtcggcgtgcagaaggagggggtgttccataccatgtggcacgttacacggggagccgtcctcacgtacaacggcaaacgcctggaaccgaattgggcctccgtgaagaaagaccttattagctatggcgggggatggagactgtctgctcagtggcaaaagggcgaggaagtgcaggtcatcgccgtggagcctgggaaaaaccccaagaattttcagaccatgcctggaacattccagaccaccacaggcgaaattggggcgatcgctctggatttcaagcccggaacgtccggcagccccatcattaaccgggagggccgcgttgtggggctctacggaaatggcgtcgtgaccaaaaacgggggatatgtttccggcatcgcccaaacaaatgccgagcctgacgggccgacccccgaactggaggaagagatgtttaagaaaagaaaccttacaattatggatctgcaccctggcagcggaaagacccggaaatacctccccgctatcgtgcgcgaagccattaagagacggctgagaacgctcatcctggctcctacacgcgtcgtggccgcggagatggaggaagcccttaagggcctgcccatccggtatcagaccaccgctacaaaatctgagcataccgggagagaaattgttgacctgatgtgccacgccacattcaccatgcgcctcctgagccctgtgcgggtcccgaattacaaccttatcattatggatgaggctcattttacggaccccgcctccatcgccgctagaggatacatttctacacgcgtgggcatgggggaagcggccgctatcttcatgaccgccacacctcccggaaccgccgatgcttttcctcagagcaatgcccccatccaggacgaggagcgggacattccggaaagatcctggaactctggcaatgagtggatcacggatttcgcggggaagaccgtgtggtttgtccctagcattaaagctggcaacgacatcgccaactgtctgcgcaagaatggcaaaaaggttattcaactctcccggaagacattcgataccgaatatcagaaaacaaagctgaacgactgggattttgtggtgaccacagacatctctgagatgggagccaatttcaaagctgatagagtcattgacccccggcgctgcctgaagcccgtgatcctcaccgatgggcctgagagagttatccttgccggacccatgcctgtgacggcggccagcgctgcccagcggcgcggcagagtcgggcggaacccgcagaaagaaaatgaccaatacatttttacaggacagcccctgaacaatgatgaggaccacgctcattggaccgaagccaagatgctgctcgacaacatcaatacccctgagggcattatccccgctctgttcgaacctgagagagagaagtccgccgcgattgatggggaatatcgccttaaaggcgagagccggaagacattcgtggaactgatgagacgcggagacctccccgtttggctggcccacaaagtggcttctgagggcatcaagtacaccgatcggaaatggtgctttgacgggcagagaaacaatcagatcctggaagagaacatggatgtcgagatttggacaaaggaaggagagaaaaagaagctccgcccgcggtggcttgacgccagaacgtattccgatcctctggctctgaaagagttcaaggactttgccgccggccgcaaaagcatcgctctcgatctggtgaccgagattgggagagtcccctctcaccttgcgcatcggacacgcaatgccctggacaacctcgtgatgctgcacacctccgaacatggaggcaaggcttacagacacgccgttgaggagctgcctgaaacaatggagaccctccttctgctgggcctcatgatcctgcttacagggggagccatgctgttcctcattagcggcaaagggatcggaaagacctccatcggcctgatttgtgtgatcgcttctagcgggatgctgtggatggccgaaattcccctccaatggatcgcgtccgccattgtgcttgagtttttcatgatggtcctgctgatccctgagcccgaaaagcagcggacaccgcaggataatcaactcgcttatgttgtgattggaatcctgacccttgccgctatcattgccgcgaacgagatgggcctgctcgaaacaaccaaacgcgacctgggcatgagcaaggagcctggggtggtctctcccacgtcctacctggatgtggacctccaccccgccagcgcttggacactttacgccgttgctaccacagtgatcacccctatgctgagacataccattgaaaattctacagccaacgtcagcctggctgccatcgcgaaccaggccgtggtcctcatgggactggacaaaggctggccgatttccaagatggatcttggggtgcccctgctcgctctgggatgctattctcaggttaatcctctgacgctcaccgccgctgtgcttctgctgatcacacactacgccatcattggccccgggctccaggccaaagcgacccgggaggctcaaaagagaacagccgctggaatcatgaagaaccctaccgtcgacggcattatgacgatcgatctggaccccgtgatttatgatagcaaatttgagaagcagcttggccaggttatgctgctcgtgctgtgtgccgtccagctgctccttatgcgcacatcctgggccctgtgcgaagctctgaccctcgccaccgggcctatcacaaccctgtgggagggatctccgggcaaattctggaatacaacgatcgcggtgagcatggccaacatttttcgggggtcctaccttgctggagccggcctggctttcagcatcatgaagtctgtggggaccggaaaaagaggcacaggctcccaaggggaaaccctcggagagaagtggaagaaaaagctgaatcagctgagccgcaaagaatttgacctctataagaaatccggcattacagaggttgatcggaccgaggccaaggaagggcttaaaagaggagagatcacgcatcacgcggtctctcggggcagcgccaagctgcagtggttcgtggaacgcaacatggtgattcccgaggggagagtcatcgacctgggatgtggccggggcgggtggtcctactattgcgctggactcaagaaagttaccgaagtgcgcggctacacaaaagggggacctggccatgaggagcccgtgcctatgtctacctacgggtggaatattgtcaaactgatgagcggaaaggatgtgttttatcttcccccggaaaaatgtgacacactgctctgcgatatcggcgagtccagcccttctcccaccgttgaagagtccagaacaatccgggtgctgaagatggtcgagccctggctgaagaacaatcagttctgtattaaagtgctcaacccttacatgcccaccgttatcgaacaccttgagcgcctgcaaagaaagcacggcgggatgctggtgcggaatcctctcagccgcaactctacgcatgaaatgtattggatttccaatggaacaggcaacatcgtcgccagcgtgaatatggtgtctagactgcttctgaaccggttcaccatgacccacagacgcccgacaattgagaaagacgtcgatctcggggctggaacgcggcatgttaacgccgaacccgagacccctaatatggacgtgatcggcgagagaatcaagcgcattaaagaagaacacaacagcacatggcactacgacgatgaaaatccctataagacctgggcttaccatgggtcctatgaggtgaaggccacaggatctgcgagctccatgatcaacggcgtcgtgaaactgctgaccaagccttgggacgttgtgcccatggtcacacagatggccatgaccgatacgaccccgtttggccagcaacgggtgttcaaagaaaaggttgacacaagaacccctcgcagcatgcccgggacacggagagtgatgggaattaccgctgagtggctctggcgcacgctgggccggaataaaaagcctagactttgcacacgcgaggaatttaccaagaaagtccggacaaacgccgctatgggggccgtgttcaccgaggaaaatcagtgggattccgccaaggcggctgttgaggacgaagatttttggacgctggtggacagagagcgcgagctccacaaactgggaaagtgtggctcttgcgtctacaacatgatggggaaaagagaaaagaaacttggcgagttcggaaaggccaagggcagccgggccatctggtacatgtggctgggggctcgctatctcgaatttgaggccctgggattcctgaatgaggatcattggttttccagagaaaactcttacagcggcgtggagggggaaggactccacaaactgggctatattcttcgggacatctccaagatccccgggggcgctatgtacgccgatgacaccgcgggatgggacacaagaattaccgaggatgacctgcataatgaagagaaaatcacacagcagatggatcctgagcaccggcaactcgccaacgctattttcaagctgacctatcagaataaagtcgtgaaggttcagcgccccacaccgaccggcacggtgatggacatcatttctagaaaggatcagcgggggagcggacaagtcggcacatacgggcttaacacctttaccaatatggaagcccagctgatccgccagatggagggagaaggcgtgctctccaaagctgacctggagaaccctcatctgcccgaaaagaaaatcacacagtggctcgagaccaagggggtggagagactgaaacggatggccattagcggcgatgactgcgttgtgaagcccatcgatgaccgcttcgcgaacgcccttctggctctcaatgatatgggaaaggtcagaaaagacattcctcaatggcagccgtctaagggctggcatgattggcaacaggtgcccttttgttcccaccatttccacgaactgatcatgaaagacgggcggaaacttgttgtgccttgccgcccccaagacgagctgattggacgggcccggatcagccagggcgctgggtggtctctccgcgaaacagcctgtctgggaaaggcttatgcccagatgtggtccctgatgtacttccacagacgggatctccgcctggcgagcaacgccatttgctctgctgtccctgtgcattgggtccccacgtccagaaccacatggagcatccacgcccatcaccaatggatgaccacagaggacatgcttaccgtgtggaatcgggtttggatcgaagataacccttggatggaggacaagacgcccgtgaccacatgggagaatgtcccgtacctgggcaagagagaagatcagtggtgtgggtccctcattggcctgaccagccgcgccacatgggctcagaacatccctaccgccattcagcaagtgcggtctcttatcggaaatgaggaatttctggactatatgcccagcatgaaaagattccgcaaggaggaggaatccgagggcgcgatttggtga

SEQ ID NO: 20651 - RNA, 9873 nt, synthetic construct
  misc_feature 1..9873: note = derived and/or modified CDS sequence (opt5) from DENV-3__FJ744726__SS-prME
  source 1..9873: mol_type = other RNA
accagcctgtgcctcatgatgatgctgcccgccacacttgctttccacctgacgtccagagacggagaacctcggatgatcgtggccaagaacgaacgcgggaaatctctcctgtttaagaccgcgagcggaattaatatgtgtacacttatcgctatggatctgggcgagatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacagacctggatgagcgctgagggagcctggagacaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtcacatgcgctaagtttcaatgtctcgagcccattgagggaaaagtggttcagcacgaaaatctgaagtatacagtgatcatcaccgtccatacaggcgaccagcaccaggtggggaacgacacgcaaggagttaccgtggagattacacctcaggcctctaccgtcgaagctatcctgcccgagtacggcacactcggcctggaatgctcccctcgcaccgggcttgatttcaatgagatgattctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagatccaaaattccggcgggaccagcattttcgccggccatctcaagtgtcgcctgaaaatggataaacttgaactgaaaggaatgtcttatgctatgtgcctcaacacctttgtcctgaagaaagaggtgtccgagacacagcacggcacgatcctgatcaaggttgaatacaagggggaggacgccccctgtaaaattcctttcagcaccgaagatggacaaggcaaggcgcataacgggagacttatcacagctaatcccgtggtcaccaaaaaggaggagcccgtgaacattgaagccgagcctccgttcggagaatccaatatcgtgattggcatcggggacaaagccctcaagatcaactggtacaagaaaggctctagcattggaaagatgtttgaggctacagcccggggcgctagacgcatggccatcctgggggataccgcgtgggacttcggatccgttggcggggtcctgaatagcctcggaaaaatggtgcaccagatttttggctctgcctatacggctctgttctccggggtgagctggatcatgaagattggcatcggagtccttctgacatggattggcctcaactctaaaaataccagcatgtccttttcttgcatcgtgatcgggattatcaccctgtacctgggagccgttgtgcaggctgatatgggctgtgtcattaactggaaggggaaggaacttaaatgcggaagcggcatcttcgtgacaaatgaggttcatacctggacagagcagtataagtttcaagccgactcccccaaacggctcgcgacggccattgctggggcctgggaaaacggcgtgtgtggaatcagaagcaccacacgcatggagaatctgctgtggaagcagatcgctaacgaactcaattacattctgtgggagaacaatatcaaacttaccgtcgtggttggcgatattatcggggtgctggaacagggaaagcggacactcacccctcagcccatggagctgaaatattcttggaagacgtggggcaaggccaaaattgtcaccgccgagacacaaaactccagcttcatcatcgacgggcctaacacccccgaatgcccgtctgcttccagagcgtggaatgtgtgggaggtggaagactacggatttggcgtcttcacaaccaacatttggctgaaacttcgcgaggtttatacacagagctgtgatcaccggctcatgtccgccgctatcaaagacgaaagagccgtgcacgccgatatgggctactggattgagtctcagaagaatgggagctggaaactggagaaggcttcctttatcgaagtgaagacctgcacgtggcctaaatctcatacactgtggagcaacggagtcctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgtggttattacggagaattgtggaacacggggcccctccctgagaaccacaaccgtgagcggcaagctgatccatgaatggtgctgtcgctcttgcacacttccgcctctccggtacatgggggaggacggatgttggtatggcatggaaattagacccatcaacgagaaagaagagaatatggtcaagtccctggtgagcgctgggtctggaaagatggataactttaccatgggcattctgtgcctcgccatcctgttcgaggaagttatgcgggggaaattcggaaagaaacacatgattgccggcgtgctttttacgttcgtcctgctcctgagcggccagatcacctggcgcgacatggctcatacactgatcatgattgggtccaatgccagcgatagaatgggaatgggcgtgacctaccttgcgctgatcgctacatttaagattcagcccttcctcgccctggggtttttcctccggaaactgacctctagagagaaccttctgctcggagttggcctggccatggctacgacactgcaacttcctgaagacatcgagcagatggccaatgggattgctctgggactcatgaccctgaagctcatcacacagtttgaaacctatcagctgtggaccgcccttgtgtccctgacatgtagcaacacgatcttcaccctcacagtcgcgtggcgcaccgccacactgattctggctggcgtgtcccttctgccgctctgccaatctagctccatgcggaagaccgattggctgcccatgacggtggccgctatgggcgtccctcccctccctctgtttatcttctctcttaaagacacacccaagagacgcagctggcctctgaatgagggggttatggccgtgggactggtgtccattctcgcctctagcctgcttagaaacgatgtccccatggctggcccgctggtggccgggggactcctgatcgcctgttacgttattaccggcacctccgctgacctcacagtggagaaagccgccgacgtcacctgggaagaggaagctgagcagacaggggtgagccacaacctgatgatcacggttgatgacgatggaaccatgcggatcaaggacgatgaaacagagaatattcttaccgtgctgctgaaaacagccctcctgatcgtctctggcatttttccttattccatccccgcgacccttctggtgtggcatacgtggcagaagcagacccaacgcagcggcgtcctctgggacgtgccttctcccccggagacacagaaagctgaactggaggaaggggtttacagaattaagcagcagggaatcttcggcaagacccaagtgggggtcggagtgcagaaagagggcgtttttcacacaatgtggcacgtgacccgcggggcggtcctcacacataacggaaagcggctggagcctaattgggcctccgtgaaaaaggatcttattagctacggcggcgggtggagactgtctgctcagtggcaaaaaggagaagaggtgcaggttatcgccgtcgaacccggcaagaaccctaagaatttccagacgatgcccgggatcttccagaccacaaccggagagattggcgcgatcgctctggactttaaacccgggacctccggaagccctattatcaaccgggaaggcaaggtggtgggcctctatgggaatggagtcgtgaccaagaacggcgggtacgtttccggaattgcccaaacgaatgccgagccggatggccccacccctgagctggaagaggaaatgttcaagaaacgcaaccttacaatcatggacctgcaccccgggagcggcaagaccagaaagtatctccctgctatcgtgcgggaggccattaaacgcagactgcggacactcatcctggctcccaccagagtcgtggccgcggaaatggaggaggcccttaagggactgcctattcgctaccagacgacagctatcaaatctgaacataccggccgggagattgttgatctgatgtgccacgccacctttacaatgagactcctgagcccggtgcgcgtccccaattataaccttatcatcatggacgaagctcatttcaccgatcctgcctccattgccgctcgggggtacatctctacaagagtgggaatgggcgaggcggccgctatttttatgaccgccacgccccctgggacagccgaggctttcccccagagcaatgccccgatccaggacgaggagaaggacattcctgaacgctcctggaactctggaaatgagtggatcaccgattttgttggcaaaacagtgtggttcgtccccagcattaaggcggggaacgacatcgctaactgtctgcggaagaatggcaaaaaggtgatccaactctccagaaaaacctttgatacggaatatcagaagacccgcctgaacgactgggatttcgtggtcacaaccgacatttctgagatgggagccaattttaaagccgatcgggttatcgaccccagacggtgcctgaagcctgtgattctcacagatggccccgagcgcgtgatccttgctgggcctatgccggtcaccgccgcgagcgccgctcagagacggggacgcgtgggcagaaacccccagaaggaaaatgaccaatacattttcacagggcagcctctgaacaatgatgaggaccacgcccactggaccgaagctaaaatgctgctcgacaacatcaatacgcccgagggaatcattcctgccctgttcgaacccgagcgggagaagtccgctgccatcgatggcgaatacagacttaaaggggagagccgcaagacatttgttgaactgatgcggagaggcgacctcccggtgtggctggcgcataaagtcgcctctgagggaattaagtataccgatcgcaaatggtgcttcgacggcgaacggaacaatcagatcctggaggagaacatggatgtggaaatttggaccaaggagggggaaagaaagaaactccgccctcggtggcttgacgctagaacatactccgatcccctggccctgaaggagtttaaagacttcgctgccggacgcaagagcatcgccctcgatctggttaccgaaatcggcagagtgccttctcaccttgctcatcggacacgcaatgcgctggacaacctcgtcatgctgcacacgtccgagcacgggggccgggcctatcggcatgctgtggaggaactgcccgagaccatggaaacactccttctgctgggcctcatgattctgcttaccggcggggccatgctgtttctcatcagcggaaaaggcattgggaagacatccatcggactgatttgtgtcatcgtgtctagcggcatgctgtggatggccgatgttcctctccagtggattgcttccgccatcgtgcttgagttctttatgatggtgctgctgatccccgagccggaaaagcaacgcacccctcaggacaatcagctcgcgtacgtcgttattgggatcctgacgcttgccgctattgtgaccgccaacgagatgggactgctcgaaacaaccaaaagagatctgggcatgagcaaggagcccggcgtggtctctcccacatcctatctggacgtggacctccaccctgctagcgcctggaccctttacgcggttgccacgacagtgatcaccccgatgctgcggcatacaattgaaaattctaccgctaacgtcagcctggccgctatcgccaaccaagctgtggtcctcatggggctggataaaggatggcccatctccaagatggaccttggcgtgcctctgctcgccctggggtgctattctcaggttaatcccctgaccctcacagcggccgtgcttctgctggtcacgcactacgctattatcggacctggcctccaggccaaagctaccagagaggcccagaagcgcacagccgcggggattatgaagaaccccaccgtggatggaatcatgacaattgacctggatcctgttatctacgacagcaaattcgagaagcaacttggccaggtgatgctgctcgtcctgtgtgctgtgcagctgctccttatgcggacctcctgggccctgtgcgaagctctgacgctcgccacaggcccgatcaccaccctgtgggaggggtctcccggaaaattttggaatacaaccattgccgtgagcatggctaacatcttcagaggctcctatcttgccggggcgggactggcctttagcattatgaagtctgttggcacagggaaacgcggaacgggctcccagggcgaaaccctcggggagaagtggaagaaaaagctgaatcaactgagccggaaagagttcgatctctacaagaaatccggaatcacagaggtcgacagaaccgaggctaaggaaggccttaaacgcggggaaacaacccatcacgccgtgtctcggggaagcgctaagctgcagtggtttgtggaaagaaacatggtcattcctgagggccgggttatcgatctggggtgtggacgcggcggctggtcctattactgcgccgggctcaagaaagtgacggaagtgagaggatataccaagggcgggcccggacacgaggagcctgtccccatgtctacatacggctggaatattgtgaaactgatgagcgggaaggacgttttctatcttccgcctgaaaaatgtgataccctgctctgcgacatcggagagtccagcccctctcccacagtggaagagtcccggaccatccgcgtcctgaagatggtggagccttggctgaagaacaatcagttctgtattaaagttctcaacccctacatgcctacagtgatcgaacatcttgagagactgcagcggaagcacggcggcatgctggtccgcaatccgctcagcagaaactctacccatgaaatgtactggatttccaatgggacgggaaacatcgtgagctctgtgaatatggtcagccggctgcttctgaacagatttacaatgacccaccgccggcccaccattgagaaagatgttgacctcggcgcggggacaagacacgtgaacgccgaacctgagacgcccaatatggacgtgatcggagagcgcatcaagcggattaaagaagaacactcctctacctggcactatgatgacgaaaacccttacaagacatgggcttatcatggcagctacgaggtcaaggccaccgggtccgctagctccatgatcaatggagtggttaaactgctgacaaagccctgggatgtggtcccgatggtgacccaaatggccatgacagacaccacgcctttcggccagcagagagtttttaaagaaaaggtggatacccgcacaccccggcctatgcccggcaccagaaaagtcatggagattacagctgagtggctctggcgcaccctggggcggaacaagagacctcgcctttgcacgcgggaagagttcacaaagaaagtgagaaccaatgccgcgatgggagccgtttttacagaagagaaccaatgggactctgctcgcgccgctgtggaagatgaggagttctggaagctggtcgacagagaacgggagctccacaaactgggcaagtgtgggagctgcgtgtataatatgatgggaaaacgcgaaaagaaacttggcgagtttgggaaggccaagggctccagagccatctggtacatgtggctgggagcgcggtatctcgagttcgaagctctgggctttctgaacgaggatcattggttctctagagaaaatagctactccggggtcgagggagaaggcctccacaaactggggtacattcttcgggacatctctaagatccccggaggcgccatgtatgccgatgacaccgctgggtgggacacgcgcattaccgaggatgacctgcacaacgaggagaagatcacacagcagatggatccggagcatagacagctcgccaatgctatttttaagctgacctaccaaaacaaagtggttaaggtgcagcggcctacacccaagggcaccgtcatggacatcattagccgcaaagatcagagaggatccggccaggtggggacatatggacttaataccttcacgaacatggaagcccaactggtgcggcagatggagggcgaaggggttctcagcaaggtggacctggagaatccccatctgctcgagaaaaagatcacacagtggctggaaaccaaaggagtcgagcgccttagacggatggcgatctctggcgatgactgcgtggttaagcctattgatgaccgctttgccaacgctctgctcgccctgaacgatatggggaaggtgagaaaagacatcccgcagtggcaaccctccaagggctggcatgattggcagcaggtccctttctgtagccaccacttccatgaacttattatgaaagacggacggaagctggtggtcccctgccgccctcaggacgagctcatcggcagagctcggatttctcaaggggccggatggtccctgaaagaaaccgcgtgtctgggcaaggcctacgctcagatgtggagcctcatgtattttcaccgcagagatctgcggcttgcctctaatgctatctgctccgccgtgcccgttcattgggtgcctacaagcagaaccacatggtccattcacgctcatcaccagtggatgacgaccgaggacatgctgacagtctggaaccgcgtgtggatcgaggataatccctggatggaagacaagaccccggttacaacctgggaggatgtgccttacctcgggaaacgggaagaccaatggtgtggaagcctgatcggccttacgtctagagccacctgggcgcagaacattctgacagccatccagcaggtccgcagcctcattggggatgaggagttcctggactatatgccctccatgaagcggtttagaaaagaagaggaatctgagggcgctatctggtga

SEQ ID NO: 20652 - RNA, 9873 nt, synthetic construct
  misc_feature 1..9873: note = derived and/or modified CDS sequence (opt5) from DENV-3__FJ744729__SS-prME
  source 1..9873: mol_type = other RNA
accagcctgtgcctcatgatgatgctgcccgccacacttgctttccacctgacgtccagagacggagagcctcggatgatcgtggccaagaacgaacgcgggaagtctctcctgtttaagaccgcgagcggaattaatatgtgtacacttatcgctatggatctgggcgagatgtgcgacgataccgtcacatacaaatgtccgctcattgccgaagttgagcccgaagacatcgattgctggtgtaacctgacctccacatgggtgacctatgggacgtgcaatcaggccggagagcacagacgggacaagcgctctgtggctctggcccctcacgtcggcatggggctcgataccagaacacagacctggatgagcgctgagggagcctggcggcaggtcgaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtgacctgcgctaagtttcaatgtctcaaacccattgagggaaaggtggttcagcacgagaatctgaaatatacagtgatcatcaccgtccatacaggcgaccagcaccaggtggggaacgacacgcaaggagttaccgtggaaattacacctcaggcctctaccgtcgaggctatcctgcccgaatacggcacactcggcctggagtgctcccctcgcaccgggcttgatttcaatgaaatgattctgctcacgatgaagaacaaagcctggatggtgcatagacagtggtttttcgacctgccccttccgtggaccagcggagccacaaccgagacacctacctggaatcggaaggagctgctcgtcacgtttaaaaacgctcacgcgaagaagcaagaagtggttgtgctgggctctcaggagggggccatgcacacagctctgaccggagccacagaaatccaaaattccggcgggaccagcattttcgccggccatctcaaatgtcgcctgaagatggataaacttgagctgaagggaatgtcttatgctatgtgcctcaacacctttgtcctgaaaaaggaagtgtccgagacacagcacggcacgatcctgatcaaggttgagtacaaaggggaagacgccccctgtaagattcctttcagcaccgaggatggacaaggcaaagcgcataacgggagacttatcacagctaatcccgtggtcaccaagaaagaggaacccgtgaacattgaggccgaacctccgttcggagagtccaatatcgtgattggcatcggggacaaggccctcaagatcaactggtacaaaaagggctctagcattggaaaaatgtttgaagctacagcccggggcgctagacgcatggccatcctgggggataccgcgtgggacttcggatccgttggcggggtcctgaatagcctcggaaagatggtgcaccagatttttggctctgcctatacggctctgttctccggggtgagctggatcatgaaaattggcatcggagtccttctgacatggattggcctcaactctaagaataccagcatgtccttttcttgcatcgtgatcgggattatcaccctgtacctgggagccgttgtgcaggctgatatgggctgtgtcattaactggaaggggaaagagcttaagtgcggaagcggcatcttcgtgacaaatgaagttcatacctggacagagcagtataaatttcaagccgactcccccaagcggctcgcgacggccattgctggggcctgggagaacggcgtgtgtggaatcagaagcaccacacgcatggaaaatctgctgtggaaacagatcgctaacgagctcaattacattctgtgggaaaacaatatcaaacttaccgtcgtggttggcgatattatcggggtgctggagcagggaaaacggacactcacccctcagcccatggaactgaagtattcttggaagacgtggggcaaagccaagattgtcaccgccgagacacaaaactccagcttcatcatcgacgggcctaacacccccgagtgcccgtctgcttccagagcgtggaatgtgtgggaagtggaggactacggatttggcgtcttcacaaccaacatttggctgaaacttcgcgaagtttatacacagagctgtgatcaccggctcatgtccgccgctatcaaggacgagagagccgtgcacgccgatatgggctactggattgaatctcagaaaaatgggagctggaagctggagaaggcttcctttatcgaggtgaaaacctgcacgtggcctaagtctcatacactgtggagcaacggagtcctcgaatccgacatgattatccccaaaagcctggccggccctatctctcagcacaatcatcgccccgggtaccacacccaaaccgcgggaccttggcaccttggcaagctggagctcgatttcaactattgcgaagggacaaccgtggttattacggagaattgtggaacacggggcccctccctgagaaccacaaccgtgagcggcaaactgatccatgagtggtgctgtcgctcttgcacacttccgcctctccggtacatgggggaagacggatgttggtatggcatggagattagacccatcaacgaaaaggaggaaaatatggtcaagtccctggtgagcgctgggtctggaaaaatggataactttaccatgggcattctgtgcctcgccatcctgttcgaggaggttatgcgggggaagttcggcaagaagcacatgattgccggcgtgctttttacgttcgtcctgctcctgagcggccagatcacctggcgcgacatggctcatacactgatcatgattgggtccaatgccagcgatagaatgggaatgggcgtgacctaccttgcgctgatcgctacatttaaaattcagcccttcctcgccctggggtttttcctccggaagctgacctctagagaaaaccttctgctcggagttggcctggccatggctacgacactgcaacttcctgaggacatcgaacagatggccaatgggattgctctgggactcatgaccctgaagctcatcacacagtttgagacctatcagctgtggaccgcccttgtgtccctgacatgtagcaacacgatcttcaccctcacagtcgcgtggcgcaccgccacactgattctggctggcgtgtcccttctgccgctctgccaatctagctccatgcggaaaaccgattggctgcccatgacggtggccgctatgggcgtccctcccctccctctgtttatcttctctcttaaggacacacccaaaagacgcagctggcctctgaatgaaggggttatggccgtgggactggtgtccattctcgcctctagcctgcttagaaacgatgtccccatggctggcccgctggtggccgggggactcctgatcgcctgttacgttattaccggcacctccgctgacctcacagtggagaaggccgccgacgtcacctgggaggaagaggctgaacagacaggggtgagccacaacctgatgatcacggttgatgacgatggaaccatgcggatcaaagacgatgagacagaaaatattcttaccgtgctgctgaagacagccctcctgatcgtctctggcatttttccttattccatccccgcgacccttctggtgtggcatacgtggcagaaacagacccaacgcagcggcgtcctctgggacgtgccttctcccccggagacacagaaggctgagctggaagagggggtttacagaattaagcagcagggaatcttcggcaaaacccaagtgggggtcggagtgcagaaggaaggcgtttttcacacaatgtggcacgtgacccgcggggcggtcctcacacataacggaaaacggctggagcctaattgggcctccgtgaagaaagatcttattagctacggcggcgggtggagactgtctgctcagtggcaaaagggagaggaagtgcaggttatcgccgtcgagcccggcaagaaccctaaaaatttccagacgatgcccgggatcttccagaccacaaccggagaaattggcgcgatcgctctggactttaagcccgggacctccggaagccctattatcaaccgggagggcaaagtggtgggcctctatgggaatggagtcgtgacaaagaacggcgggtacgtttccggaattgcccaaacgaatgccgaaccggatggccccacccctgagctggaggaagagatgttcaaaaagcgcaaccttacaatcatggacctgcaccccgggagcggcaagaccagaaaatatctccctgctatcgtgcgggaagccattaagcgcagactgcggacactcatcctggctcccaccagagtcgtggccgcggagatggaagaggcccttaaaggactgcctattcgctaccagacgacagctatcaagtctgagcataccggccgggaaattgttgatctgatgtgccacgccacctttacaatgagactcctgagcccggtgcgcgtccccaattataaccttatcatcatggacgaggctcatttcaccgatcctgcctccattgccgctcgggggtacatctctacaagagtgggaatgggcgaagcggccgctatttttatgaccgccacgccccctgggacagccgaggctttcccccagagcaatgccccgatccaggacgaagaacgcgacattcctgagcggtcctggaactctggaaatgaatggatcaccgattttgttggcaaaacagtgtggttcgtccccagcattaaggcggggaacgacatcgctaactgtctgagaaagaatggcaaaaaggtgatccaactctcccgcaaaacctttgatacggagtatcagaagacccggctgaacgactgggatttcgtggtcacaaccgacatttctgaaatgggagccaattttaaagccgatagagttatcgacccccggcgctgcctgaagcctgtgattctcacagatggccccgagagagtgatccttgctgggcctatgccggtcaccgccgcgagcgccgctcagcggcgcggaagagtgggccggaacccccagaaggagaatgaccaatacattttcacagggcagcctctgaacaatgatgaagaccacgcccactggaccgaggctaaaatgctgctcgacaacatcaatacgcccgaaggaatcattcctgccctgttcgagcccgaaagagagaagtccgctgccatcgatggcgagtaccgccttaaaggggaaagccggaagacatttgttgagctgatgagacgcggcgacctcccggtgtggctggcgcataaagtcgcctctgaaggaattaagtataccgatcggaaatggtgcttcgacggcgagagaaacaatcagatcctggaagagaacatggatgtggagatttggaccaaggaaggggagcgcaagaaactccggcctagatggcttgacgctcgcacatactccgatcccctggccctgaaggaatttaaagacttcgctgccggaagaaagagcatcgccctcgatctggttaccgagatcggccgggtgccttctcaccttgctcatcgcacaagaaatgcgctggacaacctcgtcatgctgcacacgtccgaacacgggggacgggcctatcgccatgctgtggaggagctgcccgaaaccatggagacactccttctgctgggcctcatgattctgcttaccggcggggccatgctgtttctcatcagcggaaaaggcattgggaagacatccatcggactgatttgtgtcatcgtgtctagcggcatgctgtggatggccgatgttcctctccagtggattgcttccgccatcgtgcttgagttctttatgatggtgctgctgatccccgagccggagaagcaaagaacccctcaggacaatcagctcgcgtacgtcgttattgggatcctgacgcttgccgctattgtgaccgccaacgaaatgggactgctcgagacaaccaaacgggatctgggcatgagcaaggaacccggcgtggtctctcccacatcctatctggacgtggacctccaccctgctagcgcctggaccctttacgcggttgccacgacagtgatcaccccgatgctgagacatacaattgaaaattctaccgctaacgtcagcctggccgctatcgccaaccaagctgtggtcctcatggggctggataaaggatggcccatctccaagatggaccttggcgtgcctctgctcgccctggggtgctattctcaggttaatcccctgaccctcacagcggccgtgcttctgctggtcacgcactacgctattatcggacctggcctccaggccaaagctacccgcgaagcccagaagcggacagccgcggggattatgaagaaccccaccgtggatggaatcatgacaattgacctggatcctgttatctacgacagcaaattcgagaagcaacttggccaggtgatgctgctcgtcctgtgtgctgtgcagctgctccttatgagaacctcctgggccctgtgcgaggctctgacgctcgccacaggcccgatcaccaccctgtgggaagggtctcccggaaaattttggaatacaaccattgccgtgagcatggctaacatcttccgcggctcctatcttgccggggcgggactggcctttagcattatgcggtctgttggcacagggaagagaggaacgggctcccagggcgagaccctcggggaaaaatggaagaagaaactgaatcaactgagccggaaggagttcgatctctacaaaaagtccggaatcacagaagtcgaccgcaccgaggctaaagagggccttaagagaggggaaacaacccatcacgccgtgtctcggggaagcgctaaactgcagtggtttgtggagcgcaacatggtcattcctgaaggcagagttatcgatctggggtgtggacggggcggctggtcctattactgcgccgggctcaagaaggtgacggaggtgcgcggatataccaaaggcgggcccggacacgaggaacctgtccccatgtctacatacggctggaatattgtgaagctgatgagcgggaaagacgttttctatcttccgcctgagaagtgtgataccctgctctgcgacatcggagaatccagcccctctcccacagtggaggaatccagaaccatccgggtcctgaaaatggtggagccttggctgaagaacaatcagttctgtattaaggttctcaacccctacatgcctacagtgatcgagcatcttgaacgcctgcagagaaaacacggcggcatgctggtccggaatccgctcagcagaaactctacccatgagatgtactggatttccaatgggacgggaaacatcgtgagctctgtgaatatggtcagccgcctgcttctgaaccggtttacaatgacccacagacgccccaccattgaaaaggatgttgacctcggcgcggggacacggcacgtgaacgccgagcctgaaacgcccaatatggacgtgatcggagagagaatcaaacgcattaaggaggaacattcctctacctggcactatgatgacgagaacccttacaaaacatgggcttatcatggcagctacgaagtcaaggccaccgggtccgctagctccatgatcaatggagtggttaagctgctgacaaaaccctgggatgtggtcccgatggtgacccaaatggccatgacagacaccacgcctttcggccagcagcgggtttttaaggagaaagtggataccagaacaccccgccctatgcccggcacccggaaggtcatggaaattacagctgagtggctctggagaaccctggggcgcaacaaacggcctagactttgcacgcgcgaggagttcacaaagaaggtgagaaccaatgccgcgatgggagccgtttttacagaggaaaaccaatgggactctgctcgggccgctgtggaggatgaagagttctggaaactggtcgaccgcgagagagaactccacaagctgggcaaatgtgggagctgcgtgtataatatgatgggaaagcgggagaagaaacttggcgaatttgggaaagccaaaggctccagagccatctggtacatgtggctgggagcgcggtatctcgagttcgaggctctgggctttctgaacgaagatcattggttctctcgcgagaatagctactccggggtcgaaggagagggcctccacaagctggggtacattcttagagacatctctaaaatccccggaggcgccatgtatgccgatgacaccgctgggtgggacacgcggattaccgaagatgacctgcacaacgaggagaagatcacacagcagatggatccggaacatcgccagctcgccaatgctatttttaaactgacctaccaaaacaaggtggttaaagtgcagagacctacacccaagggcaccgtcatggacatcattagccggaaggatcagcgcggatccggccaggtggggacatatggacttaataccttcacgaacatggaggcccaactggtgagacagatggaaggcgagggggttctcagcaaagtggacctggaaaatccccatctgctcgagaagaaaatcacacagtggctggagaccaagggagtcgaacggcttcgcagaatggcgatctctggcgatgactgcgtggttaaacctattgatgaccggtttgccaacgctctgctcgccctgaacgatatggggaaggtgcgcaaggacatcccgcagtggcaaccctccaaaggctggcatgattggcagcaggtccctttctgtagccaccacttccatgagcttattatgaaggacggaagaaaactggtggtcccctgccggcctcaggacgaactcatcggccgcgctagaatttctcaaggggccggatggtccctgaaggagaccgcgtgtctgggcaaagcctacgctcagatgtggagcctcatgtattttcaccggagagatctgcgccttgcctctaatgctatctgctccgccgtgcccgttcattgggtgcctacaagccggaccacatggtccattcacgctcatcaccagtggatgacgaccgaagacatgctgacagtctggaacagagtgtggatcgaggataatccctggatggaggacaagaccccggttacaacctgggaagatgtgccttacctcgggaagcgcgaggaccaatggtgtggaagcctgatcggccttacgtctcgggccacctgggcgcagaacattctgacagccatccagcaggtcagaagcctcattggggatgaagagttcctggactatatgccctccatgaaacgctttcggaaggaggaagagtctgaaggcgctatctggtga

SEQ ID NO: 20653 - RNA, 9873 nt, synthetic construct
  misc_feature 1..9873: note = derived and/or modified CDS sequence (opt5) from DENV-3__FJ687448__SS-prME
  source 1..9873: mol_type = other RNA
accagcctgtgcctcatgatgatgctgcccgccacacttgctttccacctgacgtcccgggacggcgaacctcggatgatcgtggccaagaacgaacgcgggaagtctctcctgtttaagaccgcgagcggaattaatatgtgtacacttatcgctatggatctgggcgaaatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacagacctggatgagcgctgagggagcctggagacaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtcacatgcgctaagtttcaatgtctcgagcccattgagggaaaagtggttcagcacgaaaatctgaagtatacagtgatcatcaccgtccatacaggcgaccagcaccaggtggggaacgacacgcaaggagttaccgtggagattacacctcaggcctctaccgtcgaagctatcctgcccgagtacggcacactcggcctggaatgctcccctcgcaccgggcttgatttcaatgagatgattctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagatccaaaattccggcgggaccagcattttcgccggccatctcaagtgtcgcctgaaaatggataaacttgaactgaaaggaatgtcttatgctatgtgcctcaacacctttgtcctgaagaaagaggtgtccgagacacagcacggcacgatcctgatcaaggttgaatacaagggggaggacgccccctgtaaaattcctttcagcaccgaagatggacaaggcaaggcgcataacgggagacttatcacagctaatcccgtggtcaccaaaaaggaggagcccgtgaacattgaagccgagcctccgttcggagaatccaatatcgtgattggcatcggggacaaagccctcaagatcaactggtacaagaaaggctctagcattggaaagatgtttgaggctacagcccggggcgctagacgcatggccatcctgggggataccgcgtgggacttcggatccgttggcggggtcctgaatagcctcggaaaaatggtgcaccagatttttggctctgcctatacggctctgttctccggggtgagctggatcatgaagattggcatcggagtccttctgacatggattggcctcaactctaaaaataccagcatgtccttttcttgcatcgtgatcgggattatcaccctgtacctgggagccgttgtgcaggctgatatgggctgtgtcattaactggaaggggaaggaacttaaatgcggaagcggcatcttcgtgacaaatgaggttcatacctggacagagcagtataagtttcaagccgactcccccaaacggctcgcgacggccattgctggggcctgggaaaacggcgtgtgtggaatcagaagcaccacacgcatggagaatctgctgtggaagcagatcgctaacgaactcaattacattctgtgggagaacaatatcaaacttaccgtcgtggttggcgatattatcggggtgctggaacagggaaagcggacactcacccctcagcccatggagctgaaatattcttggaagacgtggggcaaggccaaaattgtcaccgccgagacacaaaactccagcttcatcatcgacgggcctaacacccccgaatgcccgtctgcttccagagcgtggaatgtgtgggaggtggaagactacggatttggcgtcttcacaaccaacatttggctgaaacttcgcgaggtttatacacagagctgtgatcaccggctcatgtccgccgctatcaaagacgaaagagccgtgcacgccgatatgggctactggattgagtctcagaagaatgggagctggaaactggagaaggcttcctttatcgaagtgaagacctgcacgtggcctaaatctcatacactgtggagcaacggagtcctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgtggttattacggagaattgtggaacacggggcccctccctgagaaccacaaccgtgagcggcaagctgatccatgaatggtgctgtcgctcttgcacacttccgcctctccggtacatgggggaggacggatgttggtatggcatggaaattagacccatcaacgagaaagaagagaatatggtcaagtccctggtgagcgctgggtctggaaagatggataactttaccatgggcattctgtgcctcgccatcctgttcgaggaagttatgcgggggaaattcggaaagaaacacatgattgccggcgtgctttttacgttcgtcctgctcctgagcggccagatcacctggcgcgacatggctcatacactgatcatgattgggtccaatgccagcgatagaatgggaatgggcgtgacctaccttgcgctgatcgctacatttaagattcagcccttcctcgccctggggtttttcctccggaaactgacctctagagagaaccttctgctcggagttggcctggccatggctacgacactgcaacttcctgaagacatcgagcagatggccaatgggattgctctgggactcatgaccctgaagctcatcacacagtttgaaacctatcagctgtggaccgcccttgtgtccctgacatgtagcaacacgatcttcaccctcacagtcgcgtggcgcaccgccacactgattctggctggcgtgtcccttctgccgctctgccaatctagctccatgcggaagaccgattggctgcccatgacggtggccgctatgggcgtccctcccctccctctgtttatcttctctcttaaagacacacccaagagacgcagctggcctctgaatgagggggttatggccgtgggactggtgtccattctcgcctctagcctgcttagaaacgatgtccccatggctggcccgctggtggccgggggactcctgatcgcctgttacgttattaccggcacctccgctgacctcacagtggagaaagccgccgacgtcacctgggaagaggaagctgagcagacaggggtgagccacaacctgatgatcacggttgatgacgatggaaccatgcggatcaaggacgatgaaacagagaatattcttaccgtgctgctgaaaacagccctcctgatcgtctctggcatttttccttattccatccccgcgacccttctggtgtggcatacgtggcagaagcagacccaacgcagcggcgtcctctgggacgtgccttctcccccggagacacagaaagctgaactggaggaaggggtttacagaattaagcagcagggaatcttcggcaagacccaagtgggggtcggagtgcagaaagagggcgtttttcacacaatgtggcacgtgacccgcggggcggtcctcacacataacggaaagcggctggagcctaattgggcctccgtgaaaaaggatcttattagctacggcggcgggtggagactgtctgctcagtggcaaaaaggagaagaggtgcaggttatcgccgtcgaacccggcaagaaccctaagaatttccagacgatgcccgggatcttccagaccacaaccggagagattggcgcgatcgctctggactttaaacccgggacctccggaagccctattatcaaccgggaaggcaaggtggtgggcctctatgggaatggagtcgtgaccaagaacggcgggtacgtttccggaattgcccaaacgaatgccgagccggatggccccacccctgagctggaagaggaaatgttcaagaaacgcaaccttacaatcatggacctgcaccccgggagcggcaagaccagaaagtatctccctgctatcgtgcgggaggccattaaacgcagactgcggacactcatcctggctcccaccagagtcgtggccgcggaaatggaggaggcccttaagggactgcctattcgctaccagacgacagctatcaaatctgaacataccggccgggagattgttgatctgatgtgccacgccacctttacaatgagactcctgagcccggtgcgcgtccccaattataaccttatcatcatggacgaagctcatttcaccgatcctgcctccattgccgctcgggggtacatctctacaagagtgggaatgggcgaggcggccgctatttttatgaccgccacgccccctgggacagccgaggctttcccccagagcaatgccccgatccaggacgaggagcgcgacattcctgaacggtcctggaactctggaaatgagtggatcaccgattttgttggcaagacagtgtggttcgtccccagcattaaagcggggaacgacatcgctaactgtctgagaaagaatggcaagaaagtgatccaactctcccgcaagacctttgatacggaatatcagaaaacccggctgaacgactgggatttcgtggtcacaaccgacatttctgagatgggagccaattttaaggccgatagagttatcgacccccggcgctgcctgaaacctgtgattctcacagatggccccgagagagtgatccttgctgggcctatgccggtcaccgccgcgagcgccgctcagcggcgcggaagagtgggccggaacccccagaaggaaaatgaccaatacattttcacagggcagcctctgaacaatgatgaggaccacgcccactggaccgaagctaagatgctgctcgacaacatcaatacgcccgagggaatcattcctgccctgttcgaacccgagagagagaaatccgctgccatcgatggcgaataccgccttaagggggagagccggaaaacatttgttgaactgatgagacgcggcgacctcccggtgtggctggcgcataaggtcgcctctgagggaattaaatataccgatcggaagtggtgcttcgacggcgaaagaaacaatcagatcctggaggagaacatggatgtggaaatttggaccaaagagggggaacgcaagaagctccggcctagatggcttgacgctcgcacatactccgatcccctggccctgaaagagtttaaggacttcgctgccggaagaaaaagcatcgccctcgatctggttaccgaaatcggccgggtgccttctcaccttgctcatcgcacaagaaatgcgctggacaacctcgtcatgctgcacacgtccgagcacgggggacgggcctatcgccatgctgtggaggaactgcccgagaccatggaaacactccttctgctgggcctcatgattctgcttaccggcggggccatgctgtttctcatcagcggaaagggcattgggaaaacatccatcggactgatttgtgtcatcgtgtctagcggcatgctgtggatggccgatgttcctctccagtggattgcttccgccatcgtgcttgagttctttatgatggtgctgctgatccccgagccggaaaagcaaagaacccctcaggacaatcagctcgcgtacgtcgttattgggatcctgacgcttgccgctattgtgaccgccaacgagatgggactgctcgaaacaaccaagcgggatctgggcatgagcaaagagcccggcgtggtctctcccacatcctatctggacgtggacctccaccctgctagcgcctggaccctttacgcggttgccacgacagtgatcaccccgatgctgagacatacaattgaaaattctaccgctaacgtcagcctggccgctatcgccaaccaagctgtggtcctcatggggctggataagggatggcccatctccaaaatggaccttggcgtgcctctgctcgccctggggtgctattctcaggttaatcccctgaccctcacagcggccgtgcttctgctggtcacgcactacgctattatcggacctggcctccaggccaaggctacccgcgaggcccagaaacggacagccgcggggattatgaagaaccccaccgtggatggaatcatgacaattgacctggatcctgttatctacgacagcaagttcgagaaacaacttggccaggtgatgctgctcgtcctgtgtgctgtgcagctgctccttatgagaacctcctgggccctgtgcgaagctctgacgctcgccacaggcccgatcaccaccctgtgggaggggtctcccggaaagttttggaatacaaccattgccgtgagcatggctaacatcttccgcggctcctatcttgccggggcgggactggcctttagcattatgaaatctgttggcacagggaagcggggaacgggctcccagggcgaaaccctcggggagaaatggaagaagaaactgaatcaactgagcagaaaggagttcgatctctacaaaaagtccggaatcacagaggtcgaccggaccgaggctaaagaaggccttaagcgcggggagacaacccatcacgccgtgtctagaggaagcgctaaactgcagtggtttgtggaacggaacatggtcattcctgagggccgcgttatcgatctggggtgtggaagaggcggctggtcctattactgcgccgggctcaagaaggtgacggaagtgcggggatataccaaaggcgggcccggacacgaggagcctgtccccatgtctacatacggctggaatattgtgaagctgatgagcgggaaagacgttttctatcttccgcctgaaaagtgtgataccctgctctgcgacatcggagagtccagcccctctcccacagtggaagagtcccgcaccatcagagtcctgaaaatggtggagccttggctgaagaacaatcagttctgtattaaggttctcaacccctacatgcctacagtgatcgaacatcttgagcggctgcagcgcaaacacggcggcatgctggtcagaaatccgctcagccggaactctacccatgaaatgtactggatttccaatgggacgggaaacatcgtgagctctgtgaatatggtcagcagactgcttctgaaccgctttacaatgacccaccggagacccaccattgagaaggatgttgacctcggcgcggggacacgccacgtgaacgccgaacctgagacgcccaatatggacgtgatcggagagcggatcaaaagaattaaggaagaacactcctctacctggcactatgatgacgaaaacccttacaaaacatgggcttatcatggcagctacgaggtcaaggccaccgggtccgctagctccatgatcaatggagtggttaagctgctgacaaaaccctgggatgtggtcccgatggtgacccaaatggccatgacagacaccacgcctttcggccagcagcgcgtttttaaggaaaaagtggatacccggacacccagacctatgcccggcacccgcaaggtcatggagattacagctgagtggctctggcggaccctggggagaaacaaacgccctcggctttgcacgagagaagagttcacaaagaaggtgcgcaccaatgccgcgatgggagccgtttttacagaagagaaccaatgggactctgctagagccgctgtggaagatgaggagttctggaaactggtcgaccgggaacgcgagctccacaagctgggcaaatgtgggagctgcgtgtataatatgatgggaaagagagagaagaaacttggcgagtttgggaaagccaagggctcccgggccatctggtacatgtggctgggagcgagatatctcgagttcgaagctctgggctttctgaacgaggatcattggttctctcgggaaaatagctactccggggtcgagggagaaggcctccacaagctggggtacattcttcgcgacatctctaaaatccccggaggcgccatgtatgccgatgacaccgctgggtgggacacgagaattaccgaggatgacctgcacaacgaggaaaagatcacacagcagatggatccggagcatcggcagctcgccaatgctatttttaaactgacctaccaaaacaaggtggttaaagtgcagcgccctacacccaagggcaccgtcatggacatcattagcagaaaggatcagcggggatccggccaggtggggacatatggacttaataccttcacgaacatggaagcccaactggtgcgccagatggagggcgaaggggttctcagcaaagtggacctggagaatccccatctgctcgagaagaaaatcacacagtggctggaaaccaagggagtcgagagacttcggcgcatggcgatctctggcgatgactgcgtggttaaacctattgatgacagatttgccaacgctctgctcgccctgaacgatatggggaaggtgcggaaggacatcccgcagtggcaaccctccaaaggctggcatgattggcagcaggtccctttctgtagccaccacttccatgaacttattatgaaggacggacgcaaactggtggtcccctgcagacctcaggacgagctcatcggccgggctcgcatttctcaaggggccggatggtccctgaaggaaaccgcgtgtctgggcaaagcctacgctcagatgtggagcctcatgtattttcacagacgggatctgagacttgcctctaatgctatctgctccgccgtgcccgttcattgggtgcctacaagccgcaccacatggtccattcacgctcatcaccagtggatgacgaccgaggacatgctgacagtctggaaccgggtgtggatcgaggataatccctggatggaagacaagaccccggttacaacctgggaggatgtgccttacctcgggaagagagaagaccaatggtgtggaagcctgatcggccttacgtctcgcgccacctgggcgcagaacattctgacagccatccagcaggtccggagcctcattggggatgaggagttcctggactatatgccctccatgaaaagatttcgcaaggaagaggaatctgagggcgctatctggtga

SEQ ID NO: 20654 - RNA, 9873 nt, synthetic construct
  misc_feature 1..9873: note = derived and/or modified CDS sequence (opt5) from DENV-3__FJ744732__SS-prME
  source 1..9873: mol_type = other RNA
accagcctgtgcctcatgatgatgctgcccgccacacttgctttccacctgacgtcccgggacggcgaacctcggatgatcgtggccaagaacgaacgcgggaaatctctcctgtttaagaccgcgagcggaattaatatgtgtacacttatcgctatggatctgggcgaaatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacagacctggatgagcgctgagggagcctggagacaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacagcttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtcacatgcgctaagtttcagtgtctcgagcccattgagggaaaagtggttcagcacgaaaatctgaagtatacagtgatcatcaccgtccatacaggcgaccagcaccaggtggggaacgacacgcaaggagttaccgtggagattacacctcaggcctctaccgtcgaagctatcctgcccgagtacggcacactcggcctggaatgctcccctcgcaccgggcttgatttcaatgagatgattctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagatccaaaattccggcgggaccagcattttcgccggccatctcaagtgtcgcctgaaaatggataaacttgaactgaaaggaatgtcttatgctatgtgcctcaacacctttgtcctgaagaaagaggtgtccgagacacagcacggcacgatcctgatcaaggttgaatacaagggggaggacgccccctgtaaaattcctttcagcaccgaagatggacaaggcaaggcgcataacgggagacttatcacagctaatcccgtggtcaccaaaaaggaggagcccgtgaacattgaagccgagcctccgttcggagaatccaatatcgtgattggcatcggggacaaagccctcaagatcaactggtacaagaaaggctctagcattggaaagatgtttgaggctacagcccggggcgctagacgcatggccatcctgggggataccgcgtgggacttcggatccgttggcggggtcctgaatagcctcggaaaaatggtgcaccagatttttggctctgcctatacggctctgttctccggggtgagctggatcatgaagattggcatcggagtccttctgacatggattggcctcaactctaaaaataccagcatgtccttttcttgcatcgtgatcgggattatcaccctgtacctgggagccgttgtgcaggctgatatgggctgtgtcattaactggaaggggaaggaacttaaatgcggaagcggcatcttcgtgacaaatgaggttcatacctggacagagcagtataagtttcaagccgactcccccaaacggctcgcgacggccattgctggggcctgggaaaacggcgtgtgtggaatcagaagcaccacacgcatggagaatctgctgtggaagcagatcgctaacgaactcaattacattctgtgggagaacaatatcaaacttaccgtcgtggttggcgatattatcggggtgctggaacagggaaagcggacactcacccctcagcccatggagctgaaatattcttggaagacgtggggcaaggccaaaattgtcaccgccgagacacaaaactccagcttcatcatcgacgggcctaacacccccgaatgcccgtctgcttccagagcgtggaatgtgtgggaggtggaagactacggatttggcgtcttcacaaccaacatttggctgaaacttcgcgaggtttatacacagagctgtgatcaccggctcatgtccgccgctatcaaagacgaaagagccgtgcacgccgatatgggctactggattgagtctcagaagaatgggagctggaaactggagaaggcttcctttatcgaagtgaagacctgcacgtggcctaaatctcatacactgtggagcaacggagtcctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgtggttattacggagaattgtggaacacggggcccctccctgagaaccacaaccgtgagcggcaagctgatccatgaatggtgctgtcgctcttgcacacttccgcctctccggtacatgggggaggacggatgttggtatggcatggaaattagacccatcaacgagaaagaagagaatatggtcaagtccctggtgagcgctgggtctggaaagatggataactttaccatgggcattctgtgcctcgccatcctgttcgaggaagttatgcgggggaaattcggaaagaaacacatgattgccggcgtgctttttacgttcgtcctgctcctgagcggccagatcacctggcgcgacatggctcatacactgatcatgattgggtccaatgccagcgatagaatgggaatgggcgtgacctaccttgcgctgatcgctacatttaagattcagcccttcctcgccctggggtttttcctccggaaactgacctctagagagaaccttctgctcggagttggcctggccatggctacgacactgcaacttcctgaagacatcgagcagatggccaatgggattgctctgggactcatgaccctgaagctcatcacacagtttgaaacctatcagctgtggaccgcccttgtgtccctgacatgtagcaacacgatcttcaccctcacagtcgcgtggcgcaccgccacactgattctggctggcgtgtcccttctgccgctctgccaatctagctccatgcggaagaccgattggctgcccatgacggtggccgctatgggcgtccctcccctccctctgtttatcttctctcttaaagacacacccaagagacgcagctggcctctgaatgagggggttatggccgtgggactggtgtccattctcgcctctagcctgcttagaaacgatgtccccatggctggcccgctggtggccgggggactcctgatcgcctgttacgttattaccggcacctccgctgacctcacagtggagaaagccgccgacgtcacctgggaagaggaagctgagcagacaggggtgagccacaacctgatgatcacggttgatgacgatggaaccatgcggatcaaggacgatgaaacagagaatattcttaccgtgctgctgaaaacagccctcctgatcgtctctggcatttttccttattccatccccgcgacccttctggtgtggcatacgtggcagaagcagacccaacgcagcggcgtcctctgggacgtgccttctcccccggagacacagaaagctgaactggaggaaggggtttacagaattaagcagcagggaatcttcggcaagacccaagtgggggtcggagtgcagaaagagggcgtttttcacacaatgtggcacgtgacccgcggggcggtcctcacacataacggaaagcggctggagcctaattgggcctccgtgaaaaaggatcttattagctacggcggcgggtggagactgtctgctcagtggcaaaaaggagaagaggtgcaggttatcgccgtcgaacccggcaagaaccctaagaatttccagacgatgcccgggatcttccagaccacaaccggagagattggcgcgatcgctctggactttaaacccgggacctccggaagccctattatcaaccgggaaggcaaggtggtgggcctctatgggaatggagtcgtgaccaagaacggcgggtacgtttccggaattgcccaaacgaatgccgagccggatggccccacccctgagctggaagaggaaatgttcaagaaacgcaaccttacaatcatggacctgcaccccgggagcggcaagaccagaaagtatctccctgctatcgtgcgggaggccattaaacgcagactgcggacactcatcctggctcccaccagagtcgtggccgcggaaatggaggaggcccttaagggactgcctattcgctaccagacgacagctatcaaatctgaacataccggccgggagattgttgatctgatgtgccacgccacctttacaatgagactcctgagcccggtgcgcgtccccaattataaccttatcatcatggacgaagctcatttcaccgatcctgcctccattgccgctcgggggtacatctctacaagagtgggaatgggcgaggcggccgctatttttatgaccgccacgccccctgggacagccgaggctttcccccagagcaatgccccgatccaggacgaggagcgcgacattcctgaacggtcctggaactctggaaatgagtggatcaccgattttgcgggcaagacagtttggttcgtgcccagcattaaagctgggaacgacatcgccaactgtctgagaaagaatggcaagaaagtcatccaactctcccgcaagacctttgatacggaatatcagaaaacccggctgaacgactgggatttcgtggtgacaaccgacatttctgagatgggagccaattttaaggctgatagagtcatcgacccccggcgctgcctgaaacctgttattctcacagatggccccgagagagtgatccttgccgggcctatgccggtgaccgcggccagcgctgcccagcggcgcggaagagtcggccggaacccccagaaggaaaatgaccaatacattttcacagggcagcctctgaacaatgatgaggaccacgctcactggaccgaagccaagatgctgctcgacaacatcaatacgcccgagggaatcattcctgctctgttcgaacccgagagagagaaatccgccgcgatcgatggcgaataccgccttaagggggagagccggaaaacatttgtggaactgatgagacgcggcgacctcccggtttggctggcccataaggtggcttctgagggaattaaatataccgatcggaagtggtgcttcgacggcgaaagaaacaatcagatcctggaggagaacatggatgtcgaaatttggaccaaagagggggaacgcaagaagctccggcctagatggcttgacgcccgcacatactccgatcccctggctctgaaagagtttaaggacttcgccgccggaagaaaaagcatcgctctcgatctggtgaccgaaatcggccgggttccttctcaccttgcgcatcgcacaagaaatgccctggacaacctcgtgatgctgcacacgtccgagcacgggggacgggcttatcgccatgccgtcgaggaactgcccgagaccatggaaacactccttctgctgggcctcatgattctgcttaccggcggggccatgctgtttctcatcagcggaaagggcattgggaaaacatccatcggactgatttgtgtgatcgtctctagcggcatgctgtggatggctgatgtgcctctccagtggattgcctccgcgatcgttcttgagttctttatgatggtgctgctgatccccgagccggaaaagcaaagaacccctcaggacaatcagctcgcctacgtggtcattgggatcctgacgcttgctgccattgttaccgctaacgagatgggactgctcgaaacaaccaagcgggatctgggcatgagcaaagagcccggcgtggtgtctcccacatcctatctggacgtcgacctccaccctgccagcgcgtggaccctttacgccgtggctacgacagttatcaccccgatgctgagacatacaattgaaaattctaccgccaacgtgagcctggctgccatcgctaaccaagccgtcgtgctcatggggctggataagggatggcccatctccaaaatggaccttggcgtccctctgctcgcgctggggtgctattctcaggtgaatcccctgaccctcacagccgctgttcttctgctggtgacgcactacgccattatcggacctggcctccaggctaaggccacccgcgaggcccagaaacggacagcggctgggattatgaagaaccccaccgtcgatggaatcatgacaattgacctggatcctgtgatctacgacagcaagttcgagaaacaacttggccaggttatgctgctcgtgctgtgtgccgtccagctgctccttatgagaacctcctgggctctgtgcgaagccctgacgctcgccacaggcccgatcaccaccctgtgggaggggtctcccggaaagttttggaatacaaccattgctgtgagcatggccaacatcttccgcggctcctatcttgcgggggccggactggcttttagcattatgaaatctgtgggcacagggaagcggggaacgggctcccagggcgaaaccctcggggagaaatggaagaagaaactgaatcaactgagcagaaaggagttcgatctctacaaaaagtccggaatcacagaggttgaccggaccgaggccaaagaaggccttaagcgcggggagacaacccatcacgctgtctctagaggaagcgccaaactgcagtggtttgtggaacggaacatggtgattcctgagggccgcgtcatcgatctggggtgtggaagaggcggctggtcctattactgcgcggggctcaagaaggttacggaagtgcggggatataccaaaggcgggcccggacacgaggagcctgtgcccatgtctacatacggctggaatattgtcaagctgatgagcgggaaagacgtgttctatcttccgcctgaaaagtgtgataccctgctctgcgacatcggagagtccagcccctctcccacagttgaagagtcccgcaccatcagagtgctgaaaatggtcgagccttggctgaagaacaatcagttctgtattaaggtgctcaacccctacatgcctacagttatcgaacatcttgagcggctgcagcgcaaacacggcggcatgctggtgagaaatccgctcagccggaactctacccatgaaatgtactggatttccaatgggacgggaaacatcgtcagctctgtgaatatggtgagcagactgcttctgaaccgctttacaatgacccaccggagacccaccattgagaaggatgtcgacctcggcgccgggacacgccacgttaacgctgaacctgagacgcccaatatggacgtgatcggagagcggatcaaaagaattaaggaagaacactcctctacctggcactatgatgacgaaaacccttacaaaacatgggcctatcatggcagctacgaggtgaaggctaccgggtccgccagctccatgatcaatggagtcgtgaagctgctgacaaaaccctgggatgttgtgccgatggtcacccaaatggctatgacagacaccacgcctttcggccagcagcgcgtgtttaaggaaaaagttgatacccggacacccagacctatgcccggcacccgcaaggtgatggagattacagccgagtggctctggcggaccctggggagaaacaaacgccctcggctttgcacgagagaagagttcacaaagaaggtccgcaccaatgcggccatgggagctgtgtttacagaagagaaccaatgggactctgccagagctgccgttgaagatgaggagttctggaaactggtggaccgggaacgcgagctccacaagctgggcaaatgtgggagctgcgtctataatatgatgggaaagagagagaagaaacttggcgagtttgggaaagccaagggctcccgggcgatctggtacatgtggctgggagctagatatctcgagttcgaagccctgggctttctgaacgaggatcattggttctctcgggaaaatagctactccggggtggagggagaaggcctccacaagctggggtacattcttcgcgacatctctaaaatccccggaggcgccatgtatgctgatgacaccgccgggtgggacacgagaattaccgaggatgacctgcacaacgaggaaaagatcacacagcagatggatccggagcatcggcagctcgctaatgccatttttaaactgacctaccaaaacaaggtcgtgaaagttcagcgccctacacccaagggcaccgtgatggacatcattagcagaaaggatcagcggggatccggccaggtcgggacatatggacttaataccttcacgaacatggaagcgcaactggtgcgccagatggagggcgaaggggtgctcagcaaagttgacctggagaatccccatctgctcgagaagaaaatcacacagtggctggaaaccaagggagtggagagacttcggcgcatggccatctctggcgatgactgcgtcgtgaaacctattgatgacagatttgctaacgccctgctcgctctgaacgatatggggaaggttcggaaggacatcccgcagtggcaaccctccaaaggctggcatgattggcaacaggtgcctttctgtagccaccacttccatgaacttattatgaaggacggacgcaaactggtcgtgccctgcagacctcaggacgagctcatcggccgggcccgcatttctcaaggggcgggatggtccctgaaggaaaccgcctgtctgggcaaggcttacgcccagatgtggagcctcatgtattttcacagacgggatctgagacttgcttctaatgccatctgctccgctgtccccgtgcattgggttcctacaagccgcaccacatggtccattcacgcccatcaccagtggatgacgaccgaggacatgctgacagtgtggaaccgggtctggatcgaggataatccctggatggaagacaagaccccggtgacaacctgggaggatgttccttacctcgggaagagagaagaccaatggtgtggaagcctgatcggccttacgtctcgcgcgacctgggcccagaacattctgacagctatccaacaggtgcggagcctcattggggatgaggagttcctggactatatgccctccatgaaaagatttcgcaaggaagaggaatctgagggcgccatctggtga

SEQ ID NO: 20655 - RNA, 9873 nt, synthetic construct
  misc_feature 1..9873: note = derived and/or modified CDS sequence (opt5) from DENV-3__FJ810414__SS-prME
  source 1..9873: mol_type = other RNA
accagcctgtgcctcatgatgatgctgcccgccacacttgctttccacctgacgtccagagacggcgagcctcggatgatcgtggccaagaacgaacgcgggaaatctctcctgtttaagaccgcgagcggaattaatatgtgtacacttatcgctatggatctgggcgagatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacaaacctggatgagcgctgagggagcctggcggcaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtcacctgcgctaagtttcaatgtctcgagcccattgagggaaaagtggttcagcacgaaaatctgaagtatacagtgatcatcaccgtccatacaggcgaccagcaccaggtggggaacgacacgcaaggagttaccgtggagattacacctcaggcctctaccgtcgaagctatcctgcccgagtacggcacactcggcctggaatgctcccctcgcaccgggcttgatttcaatgagatgattctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagatccagaattccggcgggaccagcattttcgccggccatctcaagtgtcgcctgaaaatggataagcttgaactgaaaggaatgtcttatgctatgtgcctcaacacctttgtcctgaagaaagaggtgtccgagacacagcacggcacgatcctgatcaaggttgaatacaagggggaggacgccccctgtaaaattcctttcagcaccgaagatggacaaggcaaggcgcataacgggagacttatcacagctaatcccgtggtcaccaaaaaggaggagcccgtgaacattgaagccgagcctccgttcggagaatccaatatcgtgattggcatcggggacaaagccctcaagatcaactggtacaagaaaggctctagcattggaaagatgtttgaggctacagcccggggcgctagacgcatggccatcctgggggataccgcgtgggacttcggatccgttggcggggtcctgaatagcctcggaaaaatggtgcaccagatttttggctctgcctatacggctctgttctccggggtgagctggatcatgaagattggcatcggagtccttctgacatggattggcctcaactctaaaaataccagcatgtccttttcttgcatcgtgatcgggattatcaccctgtacctgggagccgttgtgcaggctgatatgggctgtgtcattaactggaaggggaaggaacttaaatgcggaagcggcatcttcgtgacaaatgaggttcatacctggacagagcagtataagtttcaagccgactcccccaaacggctcgcgacggccattgctggggcctgggaaaacggcgtgtgtggaatcagaagcaccacacgcatggagaatctgctgtggaagcagatcgctaacgaactcaattacattctgtgggagaacaatatcaaacttaccgtcgtggttggcgatattatcggggtgctggaacagggaaagcggacactcacccctcagcccatggagctgaaatattcttggaagacgtggggcaaggccaaaattgtcaccgccgagacacaaaactccagcttcatcatcgacgggcctaacacccccgaatgcccgtctgcttccagagcgtggaatgtgtgggaggtggaagactacggatttggcgtcttcacaaccaacatttggctgaagcttcgcgaggtttatacacagagctgtgatcaccggctcatgtccgccgctatcaaagacgaaagagccgtgcacgccgatatgggctactggattgagtctcagaagaatgggagctggaaactggagaaggcttcctttatcgaagtgaagacctgcacgtggcctaaatctcatacactgtggagcaacggagtcctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgtggttattacggagaattgtggaacacggggcccctccctgagaaccacaaccgtgagcggcaagctgatccatgaatggtgctgtcgctcttgcacacttccgcctctccggtacatgggggaggacggatgttggtatggcatggaaattagacccatcaacgagaaagaagagaatatggctaagtccctggtcagcgccgggtctggaaagatggataactttaccatgggcattctgtgcctcgccatcctgttcgaggaagtgatgcgggggaaattcggaaagaaacacatgattgctggcgttctttttacgttcgtgctgctcctgagcggccagatcacctggcgcgacatggcccatacactgatcatgattgggtccaatgcgagcgatagaatgggaatgggcgtcacctaccttgctctgatcgccacatttaagattcagcccttcctcgccctggggtttttcctccggaaactgacctctagagagaaccttctgctcggagtgggcctggctatggccacgacactgcaacttcctgaagacatcgagcagatggctaatgggattgccctgggactcatgaccctgaagctcatcacacagtttgaaacctatcagctgtggaccgcgcttgtttccctgacatgtagcaacacgatcttcaccctcacagtggcctggcgcaccgctacactgattctggccggcgtctcccttctgccgctctgccaatctagctccatgcggaagaccgattggctgcccatgacggtggctgccatgggcgtgcctcccctccctctgtttatcttctctcttaaagacacacccaagagacgcagctggcctctgaatgagggggtcatggccgttggactggtgtccattctcgcttctagcctgcttagaaacgatgtgcccatggcgggcccgctggtcgccgggggactcctgatcgcttgttacgtgattaccggcacctccgccgacctcacagttgagaaagccgctgacgtgacctgggaagaggaagccgagcagacaggggtcagccacaacctgatgatcacggtggatgacgatggaaccatgcggatcaaggacgatgaaacagagaatattcttaccgttctgctgaaaacagcgctcctgatcgtgtctggcatttttccttattccatccccgctacccttctggtctggcatacgtggcagaagcagacccaacgcagcggcgtgctctgggacgtcccttctcccccggagacacagaaagccgaactggaggaaggggtgtacagaattaagcagcagggaatcttcggcaagacccaagttggggtgggagtccagaaagagggcgtgtttcacacaatgtggcacgttacccggggggccgtgctcacacataacggaaagcgcctggagcctaattgggcttccgtcaaaaaggatcttattagctacggcggcgggtggagactgtctgcccagtggcaaaaaggagaagaggtgcaggtgatcgcggttgaacccggcaagaaccctaagaatttccagacgatgcccgggatcttccagaccacaaccggagagattggcgctatcgccctggactttaaacccgggacctccggaagccctattatcaaccgggaaggcaaggtcgtgggcctctatgggaatggagtggtcacaaaaaacggcgggtacgtgtccggaattgcccaaacgaatgctgagccggatggccccacccctgagctggaagaggaaatgttcaagaaacgcaaccttacaatcatggacctgcaccccgggagcggcaagaccagaaagtatctccctgccatcgttcgggaggctattaaacgcagactgcggacactcatcctggcccccaccagagtggtcgcggccgaaatggaggaggctcttaagggactgcctattcgctaccagacgacagccatcaaatctgaacataccggccgggagattgtggatctgatgtgccacgctacctttacaatgagactcctgagcccggttcgcgtgcccaattataaccttatcatcatggacgaagcccatttcaccgatcctgcctccattgctgcgcgggggtacatctctacaagagtcggaatgggcgaggccgctgccatttttatgaccgccacgccccctgggacagctgaagccttcccccagagcaatgcgccgatccaggacgaggagcgcgacattcctgaacggtcctggaactctggaaatgagtggatcaccgattttgtgggcaagacagtttggttcgtgcccagcattaaagctgggaacgacatcgccaactgtctgagaaagaatggcaagaaagtcatccaactctcccgcaagacctttgatacggaatatcagaaaacccggctgaacgactgggatttcgtggtgacaaccgacatttctgagatgggagccaattttaaggctgatagagtcatcgacccccggcgctgcctgaaacctgttattctcacagatggccccgagagagtgatccttgccgggcctatgccggtgaccgcggccagcgctgcccagcggcgcggaagagtcggccggaacccccagaaggaaaatgaccaatacattttcacagggcagcctctgaacaatgatgaggaccacgctcactggaccgaagccaagatgctgctcgacaacatcaatacgcccgagggaatcattcctgctctgttcgaacccgagagagagaaatccgccgcgatcgatggcgaataccgccttaagggggagagccggaaaacatttgtggaactgatgagacgcggcgacctcccggtttggctggcccataaggtggcttctgagggaattaaatataccgatcggaagtggtgcttcgacggcgaaagaaacaatcagatcctggaggagaacatggatgtcgaaatttggaccaaagagggggaacgcaagaagctccggcctagatggcttgacgcccgcacatactccgatcccctggctctgaaagagtttaaggacttcgccgccggaagaaaaagcatcgctctcgatctggtgaccgaaatcggccgggttccttctcaccttgcgcatcgcacaagaaatgccctggacaacctcgtgatgctgcacacgtccgagcacgggggacgggcttatcgccatgccgtcgaggaactgcccgagaccatggaaacactccttctgctgggcctcatgattctgcttaccggcggggccatgctgtttctcatcagcggaaagggcattgggaaaacatccatcggactgatttgtgtgatcgtctctagcggcatgctgtggatggctgatgtgcctctccagtggattgcctccgcgatcgttcttgagttctttatgatggtgctgctgatccccgagccggaaaagcaaagaacccctcaggacaatcagctcgcctacgtggtcattgggatcctgacgcttgctgccattgttaccgctaacgagatgggactgctcgaaacaaccaagcgggatctgggcatgagcaaagagcccggcgtggtgtctcccacatcctatctggacgtcgacctccaccctgccagcgcgtggaccctttacgccgtggctacgacagttatcaccccgatgctgagacatacaattgaaaattctaccgccaacgtgagcctggctgccatcgctaaccaagccgtcgtgctcatggggctggataagggatggcccatctccaaaatggaccttggcgtccctctgctcgcgctggggtgctattctcaggtgaatcccctgaccctcacagccgctgttcttctgctggtgacgcactacgccattatcggacctggcctccaggctaaggccacccgcgaggcccagaaacggacagcggctgggattatgaagaaccccaccgtcgatggaatcatgacaattgacctggatcctgtgatctacgacagcaagttcgagaaacaacttggccaggttatgctgctcgtgctgtgtgccgtccagctgctccttatgagaacctcctgggctctgtgcgaagccctgacgctcgccacaggcccgatcaccaccctgtgggaggggtctcccggaaagttttggaatacaaccattgctgtgagcatggccaacatcttccgcggctcctatcttgcgggggccggactggcttttagcattatgaaatctgtgggcacagggaagcggggaacgggctcccagggcgaaaccctcggggagaaatggaagaagaaactgaatcaactgagcagaaaggaattcgatctctacaaaaagtccggaatcacagaggttgaccggaccgaggccaaagaaggccttaagcgcggggagacaacccatcacgctgtctctagaggaagcgccaaactgcagtggtttgtggaacggaacatggtgattcctgagggccgcgtcatcgatctggggtgtggaagaggcggctggtcctattactgcgcggggctcaagaaggttacggaagtgcggggatataccaaaggcgggcccggacacgaggagcctgtgcccatgtctacatacggctggaatattgtcaagctgatgagcgggaaagacgtgttctatcttccgcctgaaaagtgtgataccctgctctgcgacatcggagagtccagcccctctcccacagttgaagagtcccgcaccatcagagtgctgaaaatggtcgagccttggctgaagaacaatcagttctgtattaaggtgctcaacccctacatgcctacagttatcgaacatcttgagcggctgcagcgcaaacacggcggcatgctggtgagaaatccgctcagccggaactctacccatgaaatgtactggatttccaatgggacgggaaacatcgtcagctctgtgaatatggtgagcagactgcttctgaaccgctttacaatgacccaccggagacccaccattgagaaggatgtcgacctcggcgccgggacacgccacgttaacgctgaacctgagacgcccaatatggacgtgatcggagagcggatcaaaagaattaaggaagagcattcctctacctggcactatgatgacgaaaacccttacaaaacatgggcctatcatggcagctacgaggtgaaggctaccgggtccgccagctccatgatcaatggagtcgtgaagctgctgacaaaaccctgggatgttgtgccgatggtcacccaaatggctatgacagacaccacgcctttcggccagcagcgcgtgtttaaggaaaaagttgatacccggacacccagacctatgcccggcacccgcaaggtgatggagattacagccgagtggctctggcggaccctggggagaaacaaacgccctcggctttgcacgagagaagagttcacaaagaaggtccgcaccaatgcggccatgggagctgtgtttacagaagagaaccaatgggactctgccagagctgccgttgaagatgaggagttctggaaactggtggaccgggaacgcgagctccacaagctgggcaaatgtgggagctgcgtctataatatgatgggaaagagagaaaaaaagcttggcgagtttgggaaagccaagggctcccgggcgatctggtacatgtggctgggagctagatatctcgagttcgaagccctgggctttctgaacgaggatcattggttctctcgggaaaatagctactccggggtggagggagaaggcctccacaagctggggtacattcttcgcgacatctctaaaatccccggaggcgccatgtatgctgatgacaccgccgggtgggacacgagaattaccgaggatgacctgcacaacgaggaaaagatcacacagcagatggatccggagcatcggcagctcgctaatgccatttttaaactgacctaccaaaacaaggtcgtgaaagttcagcgccctacacccaagggcaccgtgatggacatcattagcagaaaggatcagcggggatccggccaggtcgggacatatggacttaataccttcacgaacatggaagcgcaactggtgcgccagatggagggcgaaggggtgctcagcaaagttgacctggagaatccccacctgctcgagaagaaaatcacacagtggctggaaaccaagggagtggagagacttcggcgcatggccatctctggcgatgactgcgtcgtgaaacctattgatgacagatttgctaacgccctgctcgctctgaacgatatggggaaggttcggaaggacatcccgcagtggcaaccctccaaaggctggcatgattggcagcaggtgcctttctgtagccaccacttccatgaacttattatgaaggacggacgcaaactggtcgtgccctgcagacctcaggacgagctcatcggccgggcccgcatttctcaaggggcgggatggtccctgaaggaaaccgcctgtctgggcaaagcttacgcccagatgtggagcctcatgtattttcacagacgggatctgagacttgcttctaatgccatctgctccgctgtccccgtgcattgggttcctacaagccgcaccacatggtccattcacgcccatcaccagtggatgacgaccgaggacatgctgacagtgtggaaccgggtctggatcgaggataatccctggatggaagacaagaccccggtgacaacctgggaggatgttccttacctcgggaagagagaagaccaatggtgtggaagcctgatcggccttacgtctcgcgcgacctgggcccagaacattctgacagctatccagcaggtgcggagcctcattggggatgaggagttcctggactatatgccctccatgaaaagatttcgcaaggaagaggaatctgagggcgccatctggtga

SEQ ID NO: 20656 - RNA, 9873 nt, synthetic construct
  misc_feature 1..9873: note = derived and/or modified CDS sequence (opt5) from DENV-3__FJ744734__SS-prME
  source 1..9873: mol_type = other RNA
accagcctgtgcctcatgatgatgctgcccgccacacttgctttccacctgacgtccagagacggcgaacctcggatgatcgtggccaagaacgaacgcgggaagtctctcctgtttaagaccgcgagcggaattaatatgtgtacccttatcgctatggatctgggcgaaatgtgcgacgataccgtcacatacaagtgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacagacctggatgagcgctgagggagcctggcggcaggtcgaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtgacctgcgctaagtttcaatgtctcgagcccattgagggaaaagtggttcagcacgaaaatctgaagtatacagtgatcatcaccgtccatacaggcgaccagcaccaggtggggaacgacacgcaaggagttaccgtggagattacacctcaggcctctaccgtcgaagctatcctgcccgagtacggcacactcggcctggaatgctcccctcgcaccgggcttgatttcaatgagatgattctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagatccaaaattccggcgggaccagcattttcgccggccatctcaagtgtcgcctgaaaatggataaacttgaactgaaaggaatgtcttatgctatgtgcctcaacacctttgtcctgaagaaagaggtgtccgagacacagcacggcacgatcctgatcaaggttgaatacaagggggaggacgccccctgtaaaattcctttcagcaccgaagatggacaaggcaaggcgcataacgggagacttatcacagctaatcccgtggtcaccaaaaaggaggagcccgtgaacattgaagccgagcctccgttcggagaatccaatatcgtgattggcatcggggacaaagccctcaagatcaactggtacaagaaaggctctagcattggaaagatgtttgaggctacagcccggggcgctagacgcatggccatcctgggggataccgcgtgggacttcggatccgttggcggggtcctgaatagcctcggaaaaatggtgcaccagatttttggctctgcctatacggctctgttctccggggtgagctggatcatgaagattggcatcggagtccttctgacatggattggcctcaactctaaaaataccagcatgtccttttcttgcatcgtgatcgggattatcaccctgtacctgggagccgttgtgcaggctgatatgggctgtgtcattaactggaaggggaaggaacttaaatgcggaagcggcatcttcgtgacaaatgaggttcatacctggacagagcagtataagtttcaagccgactcccccaaacggctcgcgacggccattgctggggcctgggaaaacggcgtgtgtggaatcagaagcaccacacgcatggagaatctgctgtggaagcagatcgctaacgaactcaattacattctgtgggagaacaatatcaaacttaccgtcgtggttggcgatattatcggggtgctggaacagggaaagcggacactcacccctcagcccatggagctgaaatattcttggaagacgtggggcaaggccaaaattgtcaccgccgagacacaaaactccagcttcatcatcgacgggcctaacacccccgaatgcccgtctgcttccagagcgtggaatgtgtgggaggtggaagactacggatttggcgtcttcacaaccaacatttggctgaaacttcgcgaggtttatacacagagctgtgatcaccggctcatgtccgccgctatcaaagacgaaagagccgtgcacgccgatatgggctactggattgagtctcagaagaatgggagctggaaactggagaaggcttcctttatcgaagtgaagacctgcacgtggcctaaatctcatacactgtggagcaacggagtcctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgtggttattacggagaattgtggaacacggggcccctccctgagaaccacaaccgtgagcggcaagctgatccatgaatggtgctgtcgctcttgcacacttccgcctctccggtacatgggggaggacggatgttggtatggcatggaaattagacccatcaacgagaaagaagagaatatggtcaagtccctggtgagcgctgggtctggaaagatggataactttaccatgggcattctgtgcctcgccatcctgttcgaggaagttatgcgggggaaattcggaaagaaacacatgattgccggcgtgctttttacgttcgtcctgctcctgagcggccagatcacctggcgcgacatggctcatacactgatcatgattgggtccaatgccagcgatagaatgggaatgggcgtgacctaccttgcgctgatcgctacatttaagattcagcccttcctcgccctggggtttttcctccggaaactgacctctagagagaaccttctgctcggagttggcctggccatggctacgacactgcaacttcctgaagacatcgagcagatggccaatgggattgctctgggactcatgaccctgaagctcatcacacagtttgaaacctatcagctgtggaccgcccttgtgtccctgacatgtagcaacacgatcttcaccctcacagtcgcgtggcgcaccgccacactgattctggctggcgtgtcccttctgccgctctgccaatctagctccatgcggaagaccgattggctgcccatgacggtggccgctatgggcgtccctcccctccctctgtttatcttctctcttaaagacacacccaagagacgcagctggcctctgaatgagggggttatggccgtgggactggtgtccattctcgcctctagcctgcttagaaacgatgtccccatggctggcccgctggtggccgggggactcctgatcgcctgttacgttattaccggcacctccgctgacctcacagtggagaaagccgccgacgtcacctgggaagaggaagctgagcagacaggggtgagccacaacctgatgatcacggttgatgacgatggaaccatgcggatcaaggacgatgaaacagagaatattcttaccgtgctgctgaaaacagccctcctgatcgtctctggcatttttccttattccatccccgcgacccttctggtgtggcatacgtggcagaagcagacccaacgcagcggcgtcctctgggacgtgccttctcccccggagacacagaaagctgaactggaggaaggggtttacagaattaagcagcagggaatcttcggcaagacccaagtgggggtcggagtgcagaaagagggcgtttttcacacaatgtggcacgtgacccgcggggcggtcctcacacataacggaaagcggctggagcctaattgggcctccgtgaaaaaggatcttattagctacggcggcgggtggagactgtctgctcagtggcaaaaaggagaagaggtgcaggttatcgccgtcgaacccggcaagaaccctaagaatttccagacgatgcccgggatcttccagaccacaatgggagagattggcgcgatcgctctggactttaaacccgggacctccggaagccctattatcaaccgggaaggcaaggtggtgggcctctatgggaatggagtcgtgaccaaaaacggcgggtacgtttccggaattgcccaaacaaatgccgagccggatggccccacgcctgagctggaagaggaaatgttcaagaaacgcaaccttaccatcatggacctgcaccccgggagcggcaagacaagaaagtatctccctgctatcgtgcgggaggccattaaacgcagactgcggaccctcatcctggctcccacaagagtcgtggccgcggaaatggaggaggcccttaagggactgcctattcgctaccagaccacggctatcaaatctgaacatacaggccgggagattgttgatctgatgtgccacgccacctttaccatgagactcctgagcccggtgcgcgtccccaattataaccttatcatcatggacgaagctcatttcacagatcctgcctccattgccgctcgggggtacatctctaccagagtgggaatgggcgaggcggccgctatttttatgacagccacaccccctgggacggccgaggctttcccccagagcaatgccccgatccaggacgaggagcgcgacattcctgaacggtcctggaactctggaaatgagtggatcacagattttgttggcaagaccgtgtggttcgtccccagcattaaagcggggaacgacatcgctaactgtctgagaaagaatggcaagaaagtgatccaactctcccgcaagacatttgataccgaatatcagaaaacgcggctgaacgactgggatttcgtggtcaccacagacatttctgagatgggagccaattttaaggccgatagagttatcgacccccggcgctgcctgaaacctgtgattctcaccgatggccccgagagagtgatccttgctgggcctatgccggtcacagccgcgagcgccgctcagcggcgcggaagagtgggccggaacccccagaaggaaaatgaccaatacattttcaccgggcagcctctgaacaatgatgaggaccacgcccactggacagaagctaagatgctgctcgacaacatcaatacccccgagggaatcattcctgccctgttcgaacccgagagagagaaatccgctgccatcgatggcgaataccgccttaagggggagagccggaaaacgtttgttgaactgatgagacgcggcgacctcccggtgtggctggcgcataaggtcgcctctgagggaattaaatatacagatcggaagtggtgcttcgacggcgaaagaaacaatcagatcctggaggagaacatggatgtggaaatttggaccaaagagggggaacgcaagaagctccggcctagatggcttgacgctcgcacctactccgatcccctggccctgaaagagtttaaggacttcgctgccggaagaaaaagcatcgccctcgatctggttacagaaatcggccgggtgccttctcaccttgctcatcgcaccagaaatgcgctggacaacctcgtcatgctgcacacatccgagcacgggggacgggcctatcgccatgctgtggaggaactgcccgagacgatggaaaccctccttctgctgggcctcatgattctgcttacaggcggggccatgctgtttctcatcagcggaaagggcattgggaaaacctccatcggactgatttgtgtcatcgtgtctagcggcatgctgtggatggccgatgttcctctccagtggattgcttccgccatcgtgcttgagttctttatgatggtgctgctgatccccgagccggaaaagcaaagaacacctcaggacaatcagctcgcgtacgtcgttattgggatcctgacccttgccgctattgtgacggccaacgagatgggactgctcgaaaccacaaagcgggatctgggcatgagcaaagagcccggcgtggtctctcccacctcctatctggacgtggacctccaccctgctagcgcctggacactttacgcggttgccaccacggtgatcacaccgatgctgagacataccattgaaaattctacagctaacgtcagcctggccgctatcgccaaccaagctgtggtcctcatggggctggataagggatggcccatctccaaaatggaccttggcgtgcctctgctcgccctggggtgctattctcaggttaatcccctgaccctcaccgcggccgtgcttctgctggtcacacactacgctattatcggacctggcctccaggccaaggctacgcgcgaggcccagaaacggaccgccgcggggattatgaagaaccccacagtggatggaatcatgaccattgacctggatcctgttatctacgacagcaagttcgagaaacaacttggccaggtgatgctgctcgtcctgtgtgctgtgcagctgctccttatgagaacatcctgggccctgtgcgaagctctgaccctcgccacgggcccgatcacaaccctgtgggaggggtctcccggaaagttttggaataccacaattgccgtgagcatggctaacatcttccgcggctcctatcttgccggggcgggactggcctttagcattatgaaatctgttggcaccgggaagcggggaacaggctcccagggcgaaacgctcggggagaaatggaagaagaaactgaatcaactgagcagaaaggagttcgatctctacaaaaagtccggaatcaccgaggtcgaccggacagaggctaaagaaggccttaagcgcggggagaccacacatcacgccgtgtctagaggaagcgctaaactgcagtggtttgtggaacggaacatggtcattcctgagggccgcgttatcgatctggggtgtggaagaggcggctggtcctattactgcgccgggctcaagaaggtgaccgaagtgcggggatatacgaaaggcgggcccggacacgaggagcctgtccccatgtctacctacggctggaatattgtgaagctgatgagcgggaaagacgttttctatcttccgcctgaaaagtgtgatacactgctctgcgacatcggagagtccagcccctctcccaccgtggaagagtcccgcacaatcagagtcctgaaaatggtggagccttggctgaagaacaatcagttctgtattaaggttctcaacccctacatgcctaccgtgatcgaacatcttgagcggctgcagcgcaaacacggcggcatgctggtcagaaatccgctcagccggaactctacacatgaaatgtactggatttccaatgggaccggaaacatcgtgagctctgtgaatatggtcagcagactgcttctgaaccgctttacgatgacacaccggagacccaccattgagaaggatgttgacctcggcgcggggacccgccacgtgaacgccgaacctgagacacccaatatggacgtgatcggagagcggatcaaaagaattaaggaagaacactcctctacgtggcactatgatgacgaaaacccttacaaaacctgggcttatcatggcagctacgaggtcaaggccacagggtccgctagctccatgatcaatggagtggttaagctgctgaccaaaccctgggatgtggtcccgatggtgacacaaatggccatgaccgacacaacccctttcggccagcagcgcgtttttaaggaaaaagtggatacgcggacccccagacctatgcccggcacacgcaaggtcatggagattaccgctgagtggctctggcggacactggggagaaacaaacgccctcggctttgcaccagagaagagttcacgaagaaggtgcgcacaaatgccgcgatgggagccgtttttaccgaagagaaccaatgggactctgctagagccgctgtggaagatgaggagttctggaaactggtcgaccgggaacgcgagctccacaagctgggcaaatgtgggagctgcgtgtataatatgatgggaaagagagagaagaaacttggcgagtttgggaaagccaagggctcccgggccatctggtacatgtggctgggagcgagatatctcgagttcgaagctctgggctttctgaacgaggatcattggttctctcgggaaaatagctactccggggtcgagggagaaggcctccacaagctggggtacattcttcgcgacatctctaaaatccccggaggcgccatgtatgccgatgacacagctgggtgggacaccagaattacggaggatgacctgcacaacgaggaaaagatcacccagcagatggatccggagcatcggcagctcgccaatgctatttttaaactgacataccaaaacaaggtggttaaagtgcagcgccctacccccaagggcacagtcatggacatcattagcagaaaggatcagcggggatccggccaggtggggacctatggacttaatacattcaccaacatggaagcccaactggtgcgccagatggagggcgaaggggttctcagcaaagtggacctggagaatccccatctgctcgagaagaaaatcacgcagtggctggaaacaaagggagtcgagagacttcggcgcatggcgatctctggcgatgactgcgtggttaaacctattgatgacagatttgccaacgctctgctcgccctgaacgatatggggaaggtgcggaaggacatcccgcagtggcaaccctccaaaggctggcatgattggcagcaggtccctttctgtagccaccacttccatgaacttattatgaaggacggacgcaaactggtggtcccctgcagacctcaggacgagctcatcggccgggctcgcatttctcaaggggccggatggtccctgaaggaaaccgcgtgtctgggcaaagcctacgctcagatgtggagcctcatgtattttcacagacgggatctgagacttgcctctaatgctatctgctccgccgtgcccgttcattgggtgcctaccagccgcacaacctggtccattcacgctcatcaccagtggatgacaacggaggacatgctgaccgtctggaaccgggtgtggatcgaggataatccctggatggaagacaagacaccggttaccacatgggaggatgtgccttacctcgggaagagagaagaccaatggtgtggaagcctgatcggccttacctctcgcgccacgtgggcgcagaacattctgaccgccatccagcaggtccggagcctcattggggatgaggagttcctggactatatgccctccatgaaaagatttcgcaaggaagaggaatctgagggcgctatctggtga

SEQ ID NO: 20657 - RNA, 9873 nt, synthetic construct
  misc_feature 1..9873: note = derived and/or modified CDS sequence (opt5) from DENV-3__FJ744737__SS-prME
  source 1..9873: mol_type = other RNA
accagcctgtgcctcatgatgatgctgcccgccacacttgctttccacctgacgtccagagacggcgagcctcggatgatcgtggccaagaacgaacgcgggaaatctctcctgtttaagaccgcgagcggaattaatatgtgtacacttatcgctatggatctgggcgagatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacaaacctggatgagcgctgagggagcctggcggcaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatggctaagaataaacccacgctcgacatcgagctgcagaagaccgaagccacacaacttgcgaccctgcgcaaactctgtattgaggggaagatcacaaacattaccacggattccagatgccctacacagggagaagccatcctgccggaggaacaggaccagaattatgtgtgtaaacacacctacgtggatcggggctggggcaacgggtgcggacttttcggcaaggggagcctggtcacctgcgctaagtttcaatgtctcgagcccattgagggaaaagtggttcagcacgaaaatctgaagtatacagtgatcatcaccgtccatacaggcgaccagcaccaggtggggaacgacacgcaaggagttaccgccgagattacacctcaggcttctaccgtggaagccatcctgcccgagtacggcacactcggcctggaatgctcccctcgcaccgggcttgatttcaatgagatgattctgctcacgatgaaaaacaaggcctggatggtccatagacagtggtttttcgacctgccccttccgtggaccagcggagctacaaccgagacacctacctggaatcggaaagaactgctcgtgacgtttaagaacgcgcacgccaaaaagcaagaggtcgtggttctgggctctcaggaaggggctatgcacacagccctgaccggagccacagagatccagaattccggcgggaccagcattttcgctggccatctcaagtgtcgcctgaaaatggataagcttgaactgaaaggaatgtcttatgccatgtgcctcaacacctttgtgctgaagaaagaggtctccgagacacagcacggcacgatcctgatcaaggtggaatacaagggggaggacgcgccctgtaaaattcctttcagcaccgaagatggacaaggcaaggctcataacgggagacttatcacagccaatcccgttgtgaccaaaaaggaggagcccgtcaacattgaagccgagcctccgttcggagaatccaatatcgtgattggcatcggggacaaagctctcaagatcaactggtacaagaaaggctctagcattggaaagatgtttgaggccacagctcggggcgccagacgcatggcgatcctgggggataccgcctgggacttcggatccgtgggcggggttctgaatagcctcggaaaaatggtccaccagatttttggctctgcttatacggccctgttctccggggtgagctggatcatgaagattggcatcggagtgcttctgacatggattggcctcaactctaaaaataccagcatgtccttttcttgcatcgtcatcgggattatcaccctgtacctgggagctgtggttcaggccgatatgggctgtgtgattaactggaaggggaaggaacttaaatgcggaagcggcatcttcgtcacaaatgaggtgcatacctggacagagcagtataagtttcaagcggactcccccaaacggctcgccacggctattgccggggcttgggaaaacggcgtttgtggaatcagaagcaccacacgcatggagaatctgctgtggaagcagatcgccaacgaactcaattacattctgtgggagaacaatatcaaacttaccgtggtcgtgggcgatattatcggggttctggaacagggaaagcggacactcacccctcagcccatggagctgaaatattcttggaagacgtggggcaaggccaaaattgtgaccgctgagacacaaaactccagcttcatcatcgacgggcctaacacccccgaatgcccgtctgcgtccagagcctggaatgtctgggaggtggaagactacggatttggcgtgttcacaaccaacatttggctgaagcttcgcgaggtctatacacagagctgtgatcaccggctcatgtccgctgccatcaaagacgaaagagccgttcacgctgatatgggctactggattgagtctcagaagaatgggagctggaaactggagaaggcctcctttatcgaagtgaagacctgcacgtggcctaaatctcatacactgtggagcaacggagtgctcgagtccgacatgattatccccaagagcctggcgggccctatctctcagcacaatcatcgccccgggtaccacacccaaaccgctggaccttggcaccttggcaaactggaactcgatttcaactattgcgaggggacaaccgtcgtgattacggagaattgtggaacacggggcccctccctgagaaccacaaccgttagcggcaagctgatccatgaatggtgctgtcgctcttgcacacttccgcctctccggtacatgggggaggacggatgttggtatggcatggaaattagacccatcaacgagaaagaagagaatatggtgaagtccctggtcagcgccgggtctggaaagatggataactttaccatgggcattctgtgcctcgccatcctgttcgaggaagtgatgcgggggaaattcggaaagaaacacatgattgctggcgttctttttacgttcgtgctgctcctgagcggccagatcacctggcgcgacatggcccatacactgatcatgattgggtccaatgcgagcgatagaatgggaatgggcgtcacctaccttgctctgatcgccacatttaagattcagcccttcctcgccctggggtttttcctccggaaactgacctctagagagaaccttctgctcggagtgggcctggctatggccacgacactgcaacttcctgaagacatcgagcagatggctaatgggattgccctgggactcatgaccctgaagctcatcacacagtttgaaacctatcagctgtggaccgcgcttgtttccctgacatgtagcaacacgatcttcaccctcacagtggcctggcgcaccgctacactgattctggccggcgtctcccttctgccgctctgccaatctagctccatgcggaagaccgattggctgcccatgacggtggctgccatgggcgtgcctcccctccctctgtttatcttctctcttaaagacacacccaagagacgcagctggcctctgaatgagggggtcatggccgttggactggtgtccattctcgcttctagcctgcttagaaacgatgtgcccatggcgggcccgctggtcgccgggggactcctgatcgcttgttacgtgattaccggcacctccgccgacctcacagttgagaaagccgctgacgtgacctgggaagaggaagccgagcagacaggggtcagccacaacctgatgatcacggtggatgacgatggaaccatgcggatcaaggacgatgaaacagagaatattcttaccgttctgctgaaaacagcgctcctgatcgtgtctggcatttttccttattccatccccgctacccttctggtctggcatacgtggcagaagcagacccaacgcagcggcgtgctctgggacgtcccttctcccccggagacacagaaagccgaactggaggaaggggtgtacagaattaagcagcagggaatcttcggcaagacccaagttggggtgggagtccagaaagagggcgtgtttcacacaatgtggcacgttacccggggggccgtgctcacacataacggaaagcgcctggagcctaattgggcttccgtcaaaaaggatcttattagctacggcggcgggtggagactgtctgcccagtggcaaaaaggagaagaggtgcaggtgatcgcggttgaacccggcaagaaccctaagaatttccagacgatgcccgggatcttccagaccacaaccggagagattggcgctatcgccctggactttaaacccgggacctccggaagccctattatcaaccgggaaggcaaggtcgtgggcctctatgggaatggagtggtcacaaaaaacggcgggtacgtgtccggaattgcccaaacgaatgctgagccggatggccccacccctgagctggaagaggaaatgttcaagaaacgcaaccttacaatcatggacctgcaccccgggagcggcaagaccagaaagtatctccctgccatcgttcgggaggctattaaacgcagactgcggacactcatcctggcccccaccagagtggtcgcggccgaaatggaggaggctcttaagggactgcctattcgctaccagacgacagccatcaaatctgaacataccggccgggagattgtggatctgatgtgccacgctacctttacaatgagactcctgagcccggttcgcgtgcccaattataaccttatcatcatggacgaagcccatttcaccgatcctgcctccattgctgcgcgggggtacatctctacaagagtcggaatgggcgaggccgctgccatttttatgaccgccacgccccctgggacagctgaagccttcccccagagcaatgcgccgatccaggacgaggagcgcgacattcctgaacggtcctggaactctggaaatgagtggatcaccgattttgtgggcaagacagtttggttcgtgcccagcattaaagctgggaacgacatcgccaactgtctgagaaagaatggcaagaaagtcatccaactctcccgcaagacctttgatacggaatatcagaaaacccggctgaacgactgggatttcgtggtgacaaccgacatttctgagatgggagccaattttaaggctgatagagtcatcgacccccggcgctgcctgaaacctgttattctcacagatggccccgagagagtgatccttgccgggcctatgccggtgaccgcggccagcgctgcccagcggcgcggaagagtcggccggaacccccagaaggaaaatgaccaatacattttcacagggcagcctctgaacaatgatgaggaccacgctcactggaccgaagccaagatgctgctcgacaacatcaatacgcccgagggaatcattcctgctctgttcgaacccgagagagagaaatccgccgcgatcgatggcgaataccgccttaagggggagagccggaaaacatttgtggaactgatgagacgcggcgacctcccggtttggctggcccataaggtggcttctgagggaattaaatataccgatcggaagtggtgcttcgacggcgaaagaaacaatcagatcctggaggagaacatggatgtcgaaatttggaccaaagagggggaacgcaagaagctccggcctagatggcttgacgcccgcacatactccgatcccctggctctgaaagagtttaaggacttcgccgccggaagaaaaagcatcgctctcgatctggtgaccgaaatcggccgggttccttctcaccttgcgcatcgcacaagaaatgccctggacaacctcgtgatgctgcacacgtccgagcacgggggacgggcttatcgccatgccgtcgaggaactgcccgagaccatggaaacactccttctgctgggcctcatgattctgcttaccggcggggccatgctgtttctcatcagcggaaagggcattgggaaaacatccatcggactgatttgtgtgatcgtctctagcggcatgctgtggatggctgatgtgcctctccagtggattgcctccgcgatcgttcttgagttctttatgatggtgctgctgatccccgagccggaaaagcaaagaacccctcaggacaatcagctcgcctacgtggtcattgggatcctgacgcttgctgccattgttaccgctaacgagatgggactgctcgaaacaaccaagcgggatctgggcatgagcaaagagcccggcgtggtgtctcccacatcctatctggacgtcgacctccaccctgccagcgcgtggaccctttacgccgtggctacgacagttatcaccccgatgctgagacatacaattgaaaattctaccgccaacgtgagcctggctgccatcgctaaccaagccgtcgtgctcatggggctggataagggatggcccatctccaaaatggaccttggcgtccctctgctcgcgctggggtgctattctcaggtgaatcccctgaccctcacagccgctgttcttctgctggtgacgcactacgccattatcggacctggcctccaggctaaggccacccgcgaggcccagaaacggacagcggctgggattatgaagaaccccaccgtcgatggaatcatgacaattgacctggatcctgtgatctacgacagcaagttcgagaaacaacttggccaggttatgctgctcgtgctgtgtgccgtccagctgctccttatgagaacctcctgggctctgtgcgaagccctgacgctcgccacaggcccgatcaccaccctgtgggaggggtctcccggaaagttttggaatacaaccattgctgtgagcatggccaacatcttccgcggctcctatcttgcgggggccggactggcttttagcattatgaaatctgtgggcacagggaagcggggaacgggctcccagggcgaaaccctcggggagaaatggaagaagaaactgaatcaactgagcagaaaggaattcgatctctacaaaaagtccggaatcacagaggttgaccggaccgaggccaaagaaggccttaagcgcggggagacaacccatcacgctgtctctagaggaagcgccaaactgcagtggtttgtggaacggaacatggtgattcctgagggccgcgtcatcgatctggggtgtggaagaggcggctggtcctattactgcgcggggctcaagaaggttacggaagtgcggggatataccaaaggcgggcccggacacgaggagcctgtgcccatgtctacatacggctggaatattgtcaagctgatgagcgggaaagacgtgttctatcttccgcctgaaaagtgtgataccctgctctgcgacatcggagagtccagcccctctcccacagttgaagagtcccgcaccatcagagtgctgaaaatggtcgagccttggctgaagaacaatcagttctgtattaaggtgctcaacccctacatgcctacagttatcgaacatcttgagcggctgcagcgcaaacacggcggcatgctggtgagaaatccgctcagccggaactctacccatgaaatgtactggatttccaatgggacgggaaacatcgtcagctctgtgaatatggtgagcagactgcttctgaaccgctttacaatgacccaccggagacccaccattgagaaggatgtcgacctcggcgccgggacacgccacgttaacgctgaacctgagacgcccaatatggacgtgatcggagagcggatcaaaagaattaaggaagagcattcctctacctggcactatgatgacgaaaacccttacaaaacatgggcctatcatggcagctacgaggtgaaggctaccgggtccgccagctccatgatcaatggagtcgtgaagctgctgacaaaaccctgggatgttgtgccgatggtcacccaaatggctatgacagacaccacgcctttcggccagcagcgcgtgtttaaggaaaaagttgatacccggacacccagacctatgcccggcacccgcaaggtgatggagattacagccgagtggctctggcggaccctggggagaaacaaacgccctcggctttgcacgagagaagagttcacaaagaaggtccgcaccaatgcggccatgggagctgtgtttacagaagagaaccaatgggactctgccagagctgccgttgaagatgaggagttctggaaactggtggaccgggaacgcgagctccacaagctgggcaaatgtgggagctgcgtctataatatgatgggaaagagagaaaaaaagcttggcgagtttgggaaagccaagggctcccgggcgatctggtacatgtggctgggagctagatatctcgagttcgaagccctgggctttctgaacgaggatcattggttctctcgggaaaatagctactccggggtggagggagaaggcctccacaagctggggtacattcttcgcgacatctctaaaatccccggaggcgccatgtatgctgatgacaccgccgggtgggacacgagaattaccgaggatgacctgcacaacgaggaaaagatcacacagcagatggatccggagcatcggcagctcgctaatgccatttttaaactgacctaccaaaacaaggtcgtgaaagttcagcgccctacacccaagggcaccgtgatggacatcattagcagaaaggatcagcggggatccggccaggtcgggacatatggacttaataccttcacgaacatggaagcgcaactggtgcgccagatggagggcgaaggggtgctcagcaaagttgacctggagaatccccacctgctcgagaagaaaatcacacagtggctggaaaccaagggagtggagagacttcggcgcatggccatctctggcgatgactgcgtcgtgaaacctattgatgacagatttgctaacgccctgctcgctctgaacgatatggggaaggttcggaaggacatcccgcagtggcaaccctccaaaggctggcatgattggcagcaggtgcctttctgtagccaccacttccatgaacttattatgaaggacggacgcaaactggtcgtgccctgcagacctcaggacgagctcatcggccgggcccgcatttctcaaggggcgggatggtccctgaaggaaaccgcctgtctgggcaaagcttacgcccagatgtggagcctcatgtattttcacagacgggatctgagacttgcttctaatgccatctgctccgctgtccccgtgcattgggttcctacaagccgcaccacatggtccattcacgcccatcaccagtggatgacgaccgaggacatgctgacagtgtggaaccgggtctggatcgaggataatccctggatggaagacaagaccccggtgacaacctgggaggatgttccttacctcgggaagagagaagaccaatggtgtggaagcctgatcggccttacgtctcgcgcgacctgggcccagaacattctgacagctatccagcaggtgcggagcctcattggggatgaggagttcctggactatatgccctccatgaaaagatttcgcaaggaagaggaatctgagggcgccatctggtga

SEQ ID NO: 20658 - RNA, 9873 nt, synthetic construct
  misc_feature 1..9873: note = derived and/or modified CDS sequence (opt5) from DENV-3__FJ744739__SS-prME
  source 1..9873: mol_type = other RNA
accagcctgtgcctcatgatgatgctgcccgccacacttgctttccacctgacgtccagagacggcgagcctcggatgatcgtggccaagaacgaacgcgggaaatctctcctgtttaagaccgtcagcggaattaatatgtgtacacttatcgcgatggatctgggcgagatgtgcgacgataccgttacatacaaatgtccgctcattgctgaagtggagcccgaagacatcgattgctggtgtaacctgacctccacatgggtgacctatgggacgtgcaatcaggccggagagcatagacgggacaagcgctctgtcgccctggctcctcacgtgggcatggggctcgataccagaacacaaacctggatgagcgccgagggagcttggcggcaggttgaaaaagtggagacatgggccctgcgccatcccggcttcaccattcttgcgctgtttctcgcccactacatcggcacgtccctgacacagaaggtcgtgatcttcattcttctgatgctcgttaccccttctatgacaatgagatgtgtgggggtcggaaaccgggactttgtggaaggcctgagcggggctacctgggtggatgtcgttctggagcatggaggctgcgtgaccacaatggccaagaataaacccacgctcgacatcgagctgcagaagaccgaagctacacaacttgccaccctgcgcaaactctgtattgaggggaagatcacaaacattaccacggattccagatgccctacacagggagaagcgatcctgccggaggaacaggaccagaattatgtgtgtaaacacacctacgtcgatcggggctggggcaacgggtgcggacttttcggcaaggggagcctggtgacctgcgccaagtttcaatgtctcgagcccattgagggaaaagttgtgcagcacgaaaatctgaagtatacagtcatcatcaccgtgcatacaggcgaccagcaccaggttgggaacgacacgcaaggagtgaccgtcgagattacacctcaggcttctaccgtggaagccatcctgcccgagtacggcacactcggcctggaatgctcccctcgcaccgggcttgatttcaatgagatgattctgctcacgatgaaaaacaaggcttggatggtccatagacagtggtttttcgacctgccccttccgtggaccagcggagccacaaccgagacacctacctggaatcggaaagaactgctcgtgacgtttaagaacgcccacgctaaaaagcaagaggttgtggtcctgggctctcaggaaggggcgatgcacacagccctgaccggagctacagagatccagaattccggcgggaccagcattttcgccggccatctcaagtgtcgcctgaaaatggataagcttgaactgaaaggaatgtcttatgccatgtgcctcaacacctttgtgctgaagaaagaggtttccgagacacagcacggcacgatcctgatcaaggtggaatacaagggggaggacgctccctgtaaaattcctttcagcaccgaagatggacaaggcaaggcccataacgggagacttatcacagcgaatcccgtcgtgaccaaaaaggaggagcccgtgaacattgaagctgagcctccgttcggagaatccaatatcgttattggcatcggggacaaagccctcaagatcaactggtacaagaaaggctctagcattggaaagatgtttgaggccacagctcggggcgccagacgcatggctatcctgggggataccgcctgggacttcggatccgtcggcggggtgctgaatagcctcggaaaaatggtgcaccagatttttggctctgcgtatacggccctgttctccggggtcagctggatcatgaagattggcatcggagtgcttctgacatggattggcctcaactctaaaaataccagcatgtccttttcttgcatcgttatcgggattatcaccctgtacctgggagctgtggtccaggccgatatgggctgtgtgattaactggaaggggaaggaacttaaatgcggaagcggcatcttcgttacaaatgaggtgcatacctggacagagcagtataagtttcaagctgactcccccaaacggctcgccacggcgattgccggggcttgggaaaacggcgtctgtggaatcagaagcaccacacgcatggagaatctgctgtggaagcagatcgccaacgaactcaattacattctgtgggagaacaatatcaaacttaccgtggttgtgggcgatattatcggggtcctggaacagggaaagcggacactcacccctcagcccatggagctgaaatattcttggaagacgtggggcaaggctaaaattgtgaccgccgagacacaaaactccagcttcatcatcgacgggcctaacacccccgaatgcccgtctgcctccagagcttggaatgtgtgggaggtcgaagactacggatttggcgttttcacaaccaacatttggctgaagcttcgcgaggtgtatacacagagctgtgatcaccggctcatgtccgcggccatcaaagacgaaagagctgtgcacgccgatatgggctactggattgagtctcagaagaatgggagctggaaactggagaaggcctcctttatcgaagtcaagacctgcacgtggcctaaatctcatacactgtggagcaacggagtgctcgagtccgacatgattatccccaagagcctggctggccctatctctcagcacaatcatcgccccgggtaccacacccaaaccgccggaccttggcaccttggcaaactggaactcgatttcaactattgcgaggggacaaccgttgtgattacggagaattgtggaacacggggcccctccctgagaaccacaaccgtcagcggcaagctgatccatgaatggtgctgtcgctcttgcacacttccgcctctccggtacatgggggaggacggatgttggtatggcatggaaattagacccatcaacgagaaagaagagaatatggtgaagtccctggttagcgcggggtctggaaagatggataactttaccatgggcattctgtgcctcgctatcctgttcgaggaagtgatgcgggggaaattcggaaagaaacacatgattgccggcgtcctttttacgttcgtgctgctcctgagcggccagatcacctggcgcgacatggcccatacactgatcatgattgggtccaatgctagcgatagaatgggaatgggcgttacctaccttgccctgatcgcgacatttaagattcagcccttcctcgctctggggtttttcctccggaaactgacctctagagagaaccttctgctcggagtgggcctggccatggccacgacactgcaacttcctgaagacatcgagcagatggctaatgggattgccctgggactcatgaccctgaagctcatcacacagtttgaaacctatcagctgtggaccgctcttgtctccctgacatgtagcaacacgatcttcaccctcacagtggcctggcgcaccgcgacactgattctggccggcgtgtcccttctgccgctctgccaatctagctccatgcggaagaccgattggctgcccatgacggtcgctgccatgggcgttcctcccctccctctgtttatcttctctcttaaagacacacccaagagacgcagctggcctctgaatgagggggtgatggctgtgggactggtctccattctcgcctctagcctgcttagaaacgatgtgcccatggccggcccgctggttgctgggggactcctgatcgcgtgttacgtgattaccggcacctccgccgacctcacagtcgagaaagctgccgacgtgacctgggaagaggaagccgagcagacaggggttagccacaacctgatgatcacggtggatgacgatggaaccatgcggatcaaggacgatgaaacagagaatattcttaccgtcctgctgaaaacagctctcctgatcgtgtctggcatttttccttattccatccccgccacccttctggtctggcatacgtggcagaagcagacccaacgcagcggcgtgctctgggacgttccttctcccccggagacacagaaagcggaactggaggaaggggtgtacagaattaagcagcagggaatcttcggcaagacccaagtcggggtgggagttcagaaagagggcgtgtttcacacaatgtggcacgtcacccggggggctgtgctcacacataacggaaagcgcctggagcctaattgggcctccgtgaaaaaggatcttattagctacggcggcgggtggagactgtctgcccagtggcaaaaaggagaagaggttcaggtcatcgctgtggaacccggcaagaaccctaagaatttccagacgatgcccgggatcttccagaccacaaccggagagattggcgccatcgcgctggactttaaacccgggacctccggaagccctattatcaaccgggaaggcaaggtggtcggcctctatgggaatggagtggttacaaaaaacggcgggtacgtgtccggaattgctcaaacgaatgccgagccggatggccccacccctgagctggaagaggaaatgttcaagaaacgcaaccttacaatcatggacctgcaccccgggagcggcaagaccagaaagtatctccctgccatcgtccgggaggctattaaacgcagactgcggacactcatcctggcccccaccagagtggttgctgccgaaatggaggaggcgcttaagggactgcctattcgctaccagacgacagccatcaaatctgaacataccggccgggagattgtggatctgatgtgccacgctacctttacaatgagactcctgagcccggtccgcgtgcccaattataaccttatcatcatggacgaagcccatttcaccgatcctgcttccattgccgcccgggggtacatctctacaagagttggaatgggcgaggctgcggccatttttatgaccgctacgccccctgggacagccgaagccttcccccagagcaatgctccgatccaggacgaggagcgcgacattcctgaacggtcctggaactctggaaatgagtggatcaccgattttgtgggcaagacagtctggttcgtgcccagcattaaagccgggaacgacatcgcgaactgtctgagaaagaatggcaagaaagtgatccaactctcccgcaagacctttgatacggaatatcagaaaacccggctgaacgactgggatttcgtcgttacaaccgacatttctgagatgggagctaattttaaggccgatagagtgatcgacccccggcgctgcctgaaacctgtgattctcacagatggccccgagagagtcatccttgccgggcctatgccggtgaccgctgccagcgcggcccagcggcgcggaagagttggccggaacccccagaaggaaaatgaccaatacattttcacagggcagcctctgaacaatgatgaggaccacgctcactggaccgaagccaagatgctgctcgacaacatcaatacgcccgagggaatcattcctgctctgttcgaacccgagagagagaaatccgccgctatcgatggcgaataccgccttaagggggagagccggaaaacatttgtggaactgatgagacgcggcgacctcccggtctggctggcccataaggtggcgtctgagggaattaaatataccgatcggaagtggtgcttcgacggcgaaagaaacaatcagatcctggaggagaacatggatgttgaaatttggaccaaagagggggaacgcaagaagctccggcctagatggcttgacgcccgcacatactccgatcccctggctctgaaagagtttaaggacttcgccgctggaagaaaaagcatcgccctcgatctggtgaccgaaatcggccgggtcccttctcaccttgcccatcgcacaagaaatgctctggacaacctcgtgatgctgcacacgtccgagcacgggggacgggcgtatcgccatgccgtcgaggaactgcccgagaccatggaaacactccttctgctgggcctcatgattctgcttaccggcggggctatgctgtttctcatcagcggaaagggcattgggaaaacatccatcggactgatttgtgtgatcgtttctagcggcatgctgtggatggccgatgtgcctctccagtggattgcctccgctatcgtgcttgagttctttatgatggtcctgctgatccccgagccggaaaagcaaagaacccctcaggacaatcagctcgcctacgttgtgattgggatcctgacgcttgcggccattgtgaccgctaacgagatgggactgctcgaaacaaccaagcgggatctgggcatgagcaaagagcccggcgtcgtgtctcccacatcctatctggacgttgacctccaccctgccagcgcttggaccctttacgccgtggcgacgacagtcatcaccccgatgctgagacatacaattgaaaattctaccgccaacgtgagcctggctgccatcgctaaccaagccgtcgtgctcatggggctggataagggatggcccatctccaaaatggaccttggcgttcctctgctcgctctggggtgctattctcaggtgaatcccctgaccctcacagccgcggtccttctgctggtgacgcactacgccattatcggacctggcctccaggctaaggccacccgcgaggctcagaaacggacagccgccgggattatgaagaaccccaccgttgatggaatcatgacaattgacctggatcctgtgatctacgacagcaagttcgagaaacaacttggccaggtcatgctgctcgtgctgtgtgcggtgcagctgctccttatgagaacctcctgggctctgtgcgaagccctgacgctcgctacaggcccgatcaccaccctgtgggaggggtctcccggaaagttttggaatacaaccattgccgttagcatggccaacatcttccgcggctcctatcttgctggggccggactggcgtttagcattatgaaatctgtcggcacagggaagcggggaacgggctcccagggcgaaaccctcggggagaaatggaagaagaaactgaatcaactgagcagaaaggaattcgatctctacaaaaagtccggaatcacagaggtggaccggaccgaggccaaagaaggccttaagcgcggggagacaacccatcacgctgtgtctagaggaagcgccaaactgcagtggtttgtcgaacggaacatggttattcctgagggccgcgtgatcgatctggggtgtggaagaggcggctggtcctattactgcgctgggctcaagaaggtgacggaagtccggggatataccaaaggcgggcccggacacgaggagcctgtgcccatgtctacatacggctggaatattgttaagctgatgagcgggaaagacgtgttctatcttccgcctgaaaagtgtgataccctgctctgcgacatcggagagtccagcccctctcccacagtcgaagagtcccgcaccatcagagtgctgaaaatggttgagccttggctgaagaacaatcagttctgtattaaggtgctcaacccctacatgcctacagtcatcgaacatcttgagcggctgcagcgcaaacacggcggcatgctggtgagaaatccgctcagccggaactctacccatgaaatgtactggatttccaatgggacgggaaacatcgtgagctctgtcaatatggttagcagactgcttctgaaccgctttacaatgacccaccggagacccaccattgagaaggatgtggacctcggcgccgggacacgccacgtgaacgcggaacctgagacgcccaatatggacgtcatcggagagcggatcaaaagaattaaggaagagcattcctctacctggcactatgatgacgaaaacccttacaaaacatgggcctatcatggcagctacgaggtgaaggctaccgggtccgccagctccatgatcaatggagttgtgaagctgctgacaaaaccctgggatgtcgtgccgatggttacccaaatggctatgacagacaccacgcctttcggccagcagcgcgtgtttaaggaaaaagtcgatacccggacacccagacctatgcccggcacccgcaaggtgatggagattacagccgagtggctctggcggaccctggggagaaacaaacgccctcggctttgcacgagagaagagttcacaaagaaggttcgcaccaatgctgccatgggagcggtgtttacagaagagaaccaatgggactctgccagagctgccgtcgaagatgaggagttctggaaactggtggaccgggaacgcgagctccacaagctgggcaaatgtgggagctgcgtctataatatgatgggaaagagagaaaaaaagcttggcgagtttgggaaagctaagggctcccgggccatctggtacatgtggctgggagccagatatctcgagttcgaagcgctgggctttctgaacgaggatcattggttctctcgggaaaatagctactccggggtggagggagaaggcctccacaagctggggtacattcttcgcgacatctctaaaatccccggaggcgctatgtatgccgatgacaccgccgggtgggacacgagaattaccgaggatgacctgcacaacgaggaaaagatcacacagcagatggatccggagcatcggcagctcgctaatgccatttttaaactgacctaccaaaacaaggttgtgaaagtccagcgccctacacccaagggcaccgtgatggacatcattagcagaaaggatcagcggggatccggccaggtggggacatatggacttaataccttcacgaacatggaagctcaactggttcgccagatggagggcgaaggggtgctcagcaaagtcgacctggagaatccccacctgctcgagaagaaaatcacacagtggctggaaaccaagggagtggagagacttcggcgcatggccatctctggcgatgactgcgttgtgaaacctattgatgacagatttgcgaacgccctgctcgctctgaacgatatggggaaggtccggaaggacatcccgcagtggcaaccctccaaaggctggcatgattggcagcaggtgcctttctgtagccaccacttccatgaacttattatgaaggacggacgcaaactggtcgtgccctgcagacctcaggacgagctcatcggccgggcccgcatttctcaaggggctggatggtccctgaaggaaaccgcctgtctgggcaaagcgtacgcccagatgtggagcctcatgtattttcacagacgggatctgagacttgcttctaatgccatctgctccgctgttcccgtgcattgggtccctacaagccgcaccacatggtccattcacgcccatcaccagtggatgacgaccgaggacatgctgacagtgtggaaccgggtttggatcgaggataatccctggatggaagacaagaccccggtgacaacctgggaggatgtcccttacctcgggaagagagaagaccaatggtgtggaagcttcatcggcctgacgtctcgcgctacctgggcccagaacattcttacagcgatccagcaggtgcggagcctgattggggatgaggagtttctcgactatatgccctccatgaaaagattccgcaaggaagaggaatctgagggcgccatctggtga

SEQ ID NO: 20659 - RNA, 9873 nt, synthetic construct
  misc_feature 1..9873: note = derived and/or modified CDS sequence (opt5) from DENV-3__FJ744740__SS-prME
  source 1..9873: mol_type = other RNA
accagcctgtgcctcatgatgatgctgcccgccacacttgctttccacctgacgtcccgggacggcgaacctcggatgatcgtggccaagaacgaacgcgggaagtctctcctgtttaagaccgcgagcggaattaatatgtgtacacttatcgctatggatctgggcgaaatgtgcgacgataccgtcacatacaaatgtccgctcattgccgaagttgagcccgaagacatcgattgctggtgtaacctgacctccacatgggtgacctatgggacgtgcaatcaggccggagagcatagacgggacaagcgctctgtggctctggcccctcacgtcggcatggggctcgataccagaacacagacctggatgagcgctgagggagcctggagacaggtggaaaaagttgagacatgggcgctgcgccatcccggcttcaccattcttgccctgtttctcgctcactacatcggcacgtccctgacacagaaggtggtcatcttcattcttctgatgctcgtgaccccttctatgacaatgagatgtgttggggtgggaaaccgggactttgtcgaaggcctgagcggggccacctgggtggatgtggtcctggagcatggaggctgcgttaccacaatcgctaagaataaacccacgctcgacattgagctgcagaagaccgaagccacacagcttgcgaccctgcgcaaactctgtatcgaggggaagattacaaacatcaccacggattccagatgccctacacagggagaagccattctgccggaggaacaggaccagaattatgtgtgtaaacacacctacgtggatcggggctggggcaacgggtgcggacttttcggcaaggggagcctggtcacatgcgctaagtttcaatgtctcgagcccatcgagggaaaagtggttcagcacgaaaatctgaagtatacagtgatcattaccgtccatacaggcgaccagcaccaggtggggaacgacacgcaaggagttaccgtggagatcacacctcaggcctctaccgtcgaagctattctgcccgagtacggcacactcggcctggaatgctcccctcgcaccgggcttgatttcaatgagatgatcctgctcacgatgaaaaacaaggcctggatggtgcatagacagtggtttttcgacctgccccttccgtggaccagcggagccacaaccgagacacctacctggaatcggaaagaactgctcgtcacgtttaagaacgctcacgcgaaaaagcaagaggtggttgtgctgggctctcaggaaggggccatgcacacagctctgaccggagccacagagattcaaaattccggcgggaccagcatcttcgccggccatctcaagtgtcgcctgaaaatggataaacttgaactgaaaggaatgtcttatgctatgtgcctcaacacctttgtcctgaagaaagaggtgtccgagacacagcacggcacgatcctgattaaggttgaatacaagggggaggacgccccctgtaaaatccctttcagcaccgaagatggacaaggcaaggcgcataacgggagacttattacagctaatcccgtggtcaccaaaaaggaggagcccgtgaacatcgaagccgagcctccgttcggagaatccaatattgtgatcggcgttggggacaaagccctcaagatcaactggtacaagaaaggctctagcattggaaagatgtttgaggctacagcccggggcgctagacgcatggccatcctgggggataccgcgtgggacttcggatccgtcggcggggtgctgaatagcctcggaaaaatggtgcaccagatttttggctctgcctatacggctctgttctccggggtcagctggatcatgaagattggcatcggagtgcttctgacatggattggcctcaactctaaaaataccagcatgtccttttcttgcatcgttatcgggattatcaccctgtacctgggagccgtggtccaggctgatatgggctgtgtgattaactggaaggggaaggaacttaaatgcggaagcggcatcttcgttacaaatgaggtgcatacctggacagagcagtataagtttcaagccgactcccccaaacggctcgcgacggccattgctggggcctgggaaaacggcgtctgtggaatcagaagcaccacacgcatggagaatctgctgtggaagcagatcgctaacgaactcaattacattctgtgggagaacaatatcaaacttaccgtggttgtgggcgatattatcggggtcctggaacagggaaagcggacactcacccctcagcccatggagctgaaatattcttggaagacgtggggcaaggccaaaattgtgaccgccgagacacaaaactccagcttcatcatcgacgggcctaacacccccgaatgcccgtctgcttccagagcgtggaatgtgtgggaggtcgaagactacggatttggcgttttcacaaccaacatttggctgaaacttcgcgaggtgtatacacagagctgtgatcaccggctcatgtccgccgctatcaaagacgaaagagccgtgcacgccgatatgggctactggattgagtctcagaagaatgggagctggaaactggagaaggcttcctttatcgaagtcaagacctgcacgtggcctaaatctcatacactgtggagcaacggagtgctcgagtccgacatgattatccccaagagcctggccggccctatctctcagcacaatcatcgccccgggtaccacacccaaaccgcgggaccttggcaccttggcaaactggaactcgatttcaactattgcgaggggacaaccgttgtgattacggagaattgtggaacacggggcccctccctgagaaccacaaccgtcagcggcaagctgatccatgaatggtgctgtcgctcttgcacacttccgcctctccggtacatgggggaggacggatgttggtatggcatggaaattagacccatcaacgagaaagaagagaatatggtgaagtccctggttagcgctgggtctggaaaggtggataactttaccatgggcattctgtgcctcgccatcctgttcgaggaagtcatgcgggggaaattcggaaagaaacacatgattgccggcgtgctttttacgttcgttctgctcctgagcggccagatcacctggcgcgacatggctcatacactgatcatgattgggtccaatgccagcgatagaatgggaatgggcgtgacctaccttgcgctgatcgctacatttaagattcagcccttcctcgccctggggtttttcctccggaaactgacctctagagagaaccttctgctcggagtcggcctggccatggctacgacactgcaacttcctgaagacatcgagcagatggccaatgggattgctctgggactcatgaccctgaagctcatcacacagtttgaaacctatcagctgtggaccgcccttgtgtccctgacatgtagcaacacgatcttcaccctcacagtggcgtggcgcaccgccacactgattctggctggcgtctcccttctgccgctctgccaatctagctccatgcggaagaccgattggctgcccatgacggttgccgctatgggcgtgcctcccctccctctgtttatcttctctcttaaagacacacccaagagacgcagctggcctctgaatgagggggtgatggccgtcggactggtgtccattctcgcctctagcctgcttagaaacgatgttcccatggctggcccgctggtggccgggggactcctgatcgcctgttacgtcattaccggcacctccgctgacctcacagtggagaaagccgccgacgttacctgggaagaggaagctgagcagacaggggtgagccacaacctgatgatcacggtcgatgacgatggaaccatgcggatcaaggacgatgaaacagagaatattcttaccgtgctgctgaaaacagccctcctgatcgtctctggcatttttccttattccatccccgcgacccttctggtgtggcatacgtggcagaagcagacccaacgcagcggcgttctctgggacgtgccttctcccccggagacacagaaagctgaactggaggaaggggtctacagaattaagcagcagggaatcttcggcaagacccaagtgggggttggagtgcagaaagagggcgtctttcacacaatgtggcacgtgacccgcggggcggtgctcacacataacggaaagcggctggagcctaattgggcctccgttaaaaaggatcttattagctacggcggcgggtggagactgtctgctcagtggcaaaaaggagaagaggtccaggtgatcgccgtggaacccggcaagaaccctaagaatttccagacgatgcccgggatcttccagaccacaaccggagagattggcgcgatcgctctggactttaaacccgggacctccggaagccctattatcaaccgggaaggcaaggtcgtgggcctctatgggaatggagttgtgaccaagaacggcgggtacgtctccggaattgcccaaacgaatgccgagccggatggccccacccctgagctggaagaggaaatgttcaagaaacgcaaccttacaatcatggacctgcaccccgggagcggcaagaccagaaagtatctccctgctatcgtgcgggaggccattaaacgcagactgcggacactcatcctggctcccaccagagttgtggccgcggaaatggaggaggcccttaagggactgcctattcgctaccagacgacagctatcaaatctgaacataccggccgggagattgtcgatctgatgtgccacgccacctttacaatgagactcctgagcccggtgcgcgttcccaattataaccttatcatcatggacgaagctcatttcaccgatcctgcctccattgccgctcgggggtacatctctacaagagtgggaatgggcgaggcggccgctatttttatgaccgccacgccccctgggacagccgaggctttcccccagagcaatgccccgatccaggacgaggagcgcgacattcctgaacggtcctggaactctggaaatgagtggatcaccgattttgtcggcaagacagtgtggttcgtgcccagcattaaagcggggaacgacatcgctaactgtctgagaaagaatggcaagaaagtcatccaactctcccgcaagacctttgatacggaatatcagaaaacccggctgaacgactgggatttcgttgtgacaaccgacatttctgagatgggagccaattttaaggccgatagagtgatcgacccccggcgctgcctgaaacctgtcattctcacagatggccccgagagagtgatccttgctgggcctatgccggttaccgccgcgagcgccgctcagcggcgcggaagagtgggccggaacccccagaaggaaaatgaccaatacattttcacagggcagcctctgaacaatgatgaggaccacgcccactggaccgaagctaagatgctgctcgacaacatcaatacgcccgagggaatcattcctgccctgttcgaacccgagagagagaaatccgctgccatcgatggcgaataccgccttaagggggagagccggaaaacatttgtcgaactgatgagacgcggcgacctcccggtgtggctggcgcataaggttgcctctgagggaattaaatataccgatcggaagtggtgcttcgacggcgaaagaaacaatcagatcctggaggagaacatggatgtggaaatttggaccaaagagggggaacgcaagaagctccggcctagatggcttgacgctcgcacatactccgatcccctggccctgaaagagtttaaggacttcgctgccggaagaaaaagcatcgccctcgatctggtcaccgaaatcggccgggtgccttctcaccttgctcatcgcacaagaaatgcgctggacaacctcgtcatgctgcacacgtccgagcacgggggacgggcctatcgccatgctgtggaggaactgcccgagaccatggaaacactccttctgctgggcctcatgattctgcttaccggcggggccatgctgtttctcatcagcggaaagggcattgggaaaacatccatcggactgatttgtgttatcgtgtctagcggcatgctgtggatggccgatgtgcctctccagtggattgcttccgccatcgtccttgagttctttatgatggttctgctgatccccgagccggaaaagcaaagaacccctcaggacaatcagctcgcgtacgtggtgattgggatcctgacgcttgccgctattgtcaccgccaacgagatgggactgctcgaaacaaccaagcgggatctgggcatgagcaaagagcccggcgtggtttctcccacatcctatctggacgtggacctccaccctgctagcgcctggaccctttacgcggtcgccacgacagtgatcaccccgatgctgagacatacaattgaaaattctaccgctaacgtcagcctggccgctatcgccaaccaagctgtggttctcatggggctggataagggatggcccatctccaaaatggaccttggcgtgcctctgctcgccctggggtgctattctcaggtcaatcccctgaccctcacagcggccgtgcttctgctggttacgcactacgctattatcggacctggcctccaggccaaggctacccgcgaggcccagaaacggacagccgcggggattatgaagaaccccaccgtggatggaatcatgacaattgacctggatcctgtcatctacgacagcaagttcgagaaacaacttggccaggtgatgctgctcgtgctgtgtgctgttcagctgctccttatgagaacctcctgggccctgtgcgaagctctgacgctcgccacaggcccgatcaccaccctgtgggaggggtctcccggaaagttttggaatacaaccattgccgtcagcatggctaacatcttccgcggctcctatcttgccggggcgggactggcctttagcattatgaaatctgtgggcacagggaagcggggaacgggctcccagggcgaaaccctcggggagaaatggaagaagaaactgaatcaactgagcagaaaggagttcgatctctacaaaaagtccggaatcacagaggtggaccggaccgaggctaaagaaggccttaagcgcggggagacaacccatcacgccgtctctagaggaagcgctaaactgcagtggtttgttgaacggaacatggtgattcctgagggccgcgtgatcgatctggggtgtggaagaggcggctggtcctattactgcgccgggctcaagaaggtcacggaagtgcggggatataccaaaggcgggcccggacacgaggagcctgttcccatgtctacatacggctggaatattgtgaagctgatgagcgggaaagacgtcttctatcttccgcctgaaaagtgtgataccctgctctgcgacatcggagagtccagcccctctcccacagtggaagagtcccgcaccatcagagttctgaaaatggtggagccttggctgaagaacaatcagttctgtattaaggtcctcaacccctacatgcctacagtgatcgaacatcttgagcggctgcagcgcaaacacggcggcatgctggtgagaaatccgctcagccggaactctacccatgaaatgtactggatttccaatgggacgggaaacatcgtcagctctgttaatatggtgagcagactgcttctgaaccgctttacaatgacccaccggagacccaccattgagaaggatgtggacctcggcgcggggacacgccacgtcaacgccgaacctgagacgcccaatatggacgtgatcggagagcggatcaaaagaattaaggaagaacactcctctacctggcactatgatgacgaaaacccttacaaaacatgggcttatcatggcagctacgaggttaaggccaccgggtccgctagctccatgatcaatggagtggtcaagctgctgacaaaaccctgggatgtggttccgatggtgacccaaatggccatgacagacaccacgcctttcggccagcagcgcgtctttaaggaaaaagtggatacccggacacccagacctatgcccggcacccgcaaggttatggagattacagctgagtggctctggcggaccctggggagaaacaaacgccctcggctttgcacgagagaagagttcacaaagaaggtgcgcaccaatgccgcgatgggagccgtctttacagaagagaaccaatgggactctgctagagccgctgtggaagatgaggagttctggaaactggtcgaccgggaacgcgagctccacaagctgggcaaatgtgggagctgcgtgtataatatgatgggaaagagagagaagaaacttggcgagtttgggaaagccaagggctcccgggccatctggtacatgtggctgggagcgagatatctcgagttcgaagctctgggctttctgaacgaggatcattggttctctcgggaaaatagctactccggggttgagggagaaggcctccacaagctggggtacattcttcgcgacatctctaaaatccccggaggcgccatgtatgccgatgacaccgctgggtgggacacgagaattaccgaggatgacctgcacaacgaggaaaagatcacacagcagatggatccggagcatcggcagctcgccaatgctatttttaaactgacctaccaaaacaaggtggtcaaagtgcagcgccctacacccaagggcaccgtgatggacatcattagcagaaaggatcagcggggatccggccaggttgggacatatggacttaataccttcacgaacatggaagcccaactggtgcgccagatggagggcgaaggggtcctcagcaaagtggacctggagaatccccatctgctcgagaagaaaatcacacagtggctggaaaccaagggagttgagagacttcggcgcatggcgatctctggcgatgactgcgtggtcaaacctattgatgacagatttgccaacgctctgctcgccctgaacgatatggggaaggtgcggaaggacatcccgcagtggcaaccctccaaaggctggcatgattggcagcaggtccctttctgtagccaccacttccatgaacttattatgaaggacggacgcaaactggtggttccctgcagacctcaggacgagctcatcggccgggctcgcatttctcaaggggccggatggtccctgaaggaaaccgcgtgtctgggcaaagcctacgctcagatgtggagcctcatgtattttcacagacgggatctgagacttgcctctaatgctatctgctccgccgtgcccgtccattgggtgcctacaagccgcaccacatggtccattcacgctcatcaccagtggatgacgaccgaggacatgctgacagtttggaaccgggtgtggatcgaggataatccctggatggaagacaagaccccggtcacaacctgggaggatgtgccttacctcgggaagagagaagaccaatggtgtggaagcctgatcggccttacgtctcgcgccacctgggcgcagaacattctgacagccatccaacaggtgcggagcctcattggggatgaggagttcctggactatatgccctccatgaaaagatttcgcaaggaagaggaatctgagggcgctatctggtga

SEQ ID NO: 20660 - RNA, 9873 nt, synthetic construct
  misc_feature 1..9873: note = derived and/or modified CDS sequence (opt5) from DENV-3__GQ868593__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgcatattgctgaagttgagcccgaagacatcgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccattctggcgctttttctggcccattacatcgggacgtccctcacacagaaggtggtcatcttcattctgcttatcctggtgaccccttctatggctatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccattctcccggaggaacaggaccagaattatgtgtgtaaacacacatacgtggatcggggctgggggaacggatgcggcctgttcgggaagggaagccttgtcacctgcgctaagtttcaatgtctggagtctatcgagggcaaagtggttcagcatgaaaatctcaagtataccgtgatcattacagtccacaccggggaccagcatcaggtgggaaacgagacacaaggcgttacggccgaaatcaccccccaggcttccacagtggaggccattctgcctgaatacggcaccctggggctcgagtgcagcccccgcacaggactggacttcaatgagatgatccttctgaccatgaaaaacaaggcctggatggtccacagacagtggtttttcgatctccctctgccctggacgtctggcgctaccacagaaaccccgacatggaatcggaaagagcttctggtgacctttaagaacgcgcacgccaaaaagcaagaagtcgtggttctcgggtcccaggagggagctatgcatacggccctgacaggcgccaccgaaattcagaatagcgggggcacatctatcttcgctggacacctgaagtgtcgcctcaaaatggacaagctggagcttaaaggcatgtcctatgccatgtgcctgaacacctttgtgctcaagaaagaggtcagcgaaacccagcatgggacaatcctgattaaggtggagtacaagggagaagatgcgccttgtaaaatccccttctccacggaggacggccaagggaaggctcacaacggaagactgattaccgccaatcctgttgtgacaaaaaaggaggaacccgtcaacatcgaggccgaaccccctttcggcgagtctaatattgtgatcgggatcggcgataaagctcttaagattaactggtacaagaaaggaagctccatcggcaagatgtttgaagccaccgctcggggggccagacgcatggcgattctcggagacacagcctgggatttcggcagcgtggggggagttctgaattctctgggcaaaatggtccatcagatctttgggtccgcttataccgccctcttcagcggcgtgtcttggattatgaagatcggaattggcgtgctgcttacgtggatcgggctgaacagcaaaaatacatccatgtcttttagctgcatcgctattggaatcattaccctctacctgggcgccgtcgtgcaggcggacatggggtgtgttatcaactggaagggaaaggagctgaaatgcggctccgggattttcgtgaccaatgaggtccacacatggaccgaacagtataagtttcaagccgatagcccgaaacggcttgctacagccatcgctggcgcctgggagaacggagtgtgtggcatcagatctacgacccgcatggaaaatctcctgtggaagcagattgccaacgagctgaattacatcctctgggaaaacaatattaaactgacagttgtggtcggggacatcattggagtgcttgagcagggcaagcggaccctgacaccccagcctatggagctcaaatattcctggaagacctgggggaaggctaaaatcgttacggcggaaacccaaaacagctctttcatcattgatggacccaacacacctgagtgcccctccgccagcagagcttggaatgtgtgggaagtcgaggactacggctttggcgtgttcaccacaaacatctggctgaagctgcgcgaagtgtatacccagctttgtgaccaccggctcatgtccgccgccgtcaaagatgagagagctgttcatgccgacatggggtactggattgagtctcagaagaatggaagctggaaactggaaaaggcgtccctgatcgaggtgaagacatgcacctggccgaaatctcacacgctctggagcaacggcgtgctggaatccgatatgattatccctaagagccttgctgggcccatctctcagcataatcaccgccctggataccacacacaaaccgccggcccctggcatctggggaaactcgagctggactttaactattgcgagggaaccacagtcgtgattaccgaaaattgtggcacgcggggcccttccctgagaacaaccacagttagcgggaagcttatccacgagtggtgctgtcgctcttgcaccctccccccgctgcggtacatgggagaagatggctgttggtatgggatggagattagacctatcaacgaaaaagaggagaatatggtgaagtccctggccagcgctggatctggcaaggtcgacaacttcacaatgggggtgctctgcctggccattctttttgaagaggttatgcggggaaaattcggcaagaaacatatgatcgcgggcgtgctgctcaccttcgtcctgctgcttagcgggcagattacgtggcgcgatatggctcacaccctgatcatgatcggatccaatgccagcgacagaatgggcatgggggtgacatacctcgccctgattgctacctttaagatccagcccttcctcgccctgggatttttccttcggaaactgacatctagagaaaacctcctgctgggcgttgggcttgctatggccaccacgctgcaactccccgaggatattgaacagatggcgaatggaatcgccctgggcctcatggctctgaagcttattacacagtttgagacctatcagctgtggacagccctcgtgtccctgacctgtagcaacaccatcttcacactgacggtcgcttggcgcaccgccacacttatcctggccggcgtgtccctcctgcctgtgtgccaatctagctccatgcggaagaccgactggctcccgatggctgtcgcggccatgggggttccccctctgcccctttttattttctctctgaaagatacactgaagagacgcagctggcctctcaatgagggagtgatggctgtgggcctggtctccatccttgcctctagcctgctcagaaacgacgtgcccatggccgggcctctggttgctggaggcctcctgattgcctgttacgtgatcaccgggacgtccgcggatcttacagtcgaaaaagctgccgacgtgacctgggaggaagaggccgaacagaccggagttagccataacctgatgattacagtggacgatgacggcaccatgcggatcaaggatgacgagacagagaatatcctgacggtcctcctgaaaaccgctcttctgattgtgtctggcatctttccctattccattccggccacactcctggtctggcacacctggcagaagcagacacaacgcagcggggtgctctgggatgttccttctccccctgaaacccagaaagcggagctggaagagggagtgtacagaatcaagcagcagggcattttcgggaagacgcaagtcggagtgggcgttcagaaagagggggtgtttcacaccatgtggcatgtcacacggggagctgtgcttacccacaacggcaagcgcctggaacccaattgggcctccgtgaaaaaggacctgatcagctacggcgggggatggagactctctgcccagtggcaaaaaggcgaggaagttcaggtcattgctgtggagccggggaagaaccctaagaatttccagacaatgcccggaatctttcagaccacaacgggcgaaatcggggccattgctctggatttcaaacctggaacctccggcagccccatcattaaccgggagggcaaggtggtcgggctttatggaaatggcgtggttacaaaaaacgggggatacgtgtccggcatcgcccaaaccaatgcggagcccgacgggcctaccccggaactggaggaagagatgttcaagaaacgcaacctcacaattatggatctgcatcccggcagcggaaagacgagaaagtatctccctgccatcgtccgggaagctatcaaacgcagactgcggacccttattctggcccccacaagagtggttgctgccgagatggaggaagccctgaagggcctccctatccgctaccagaccacagctaccaaatctgagcacacggggcgggaaattgtggacctgatgtgccatgcgacatttaccatgagacttctgagccccgtccgcgtgcctaattataacctcatcattatggatgaggcccacttcaccgacccggcttccatcgccgcccggggatacatctctacaagagttggcatgggggaagctgccgcgatttttatgaccgctacaccccctggaaccgccgatgccttcccccagagcaatgctcctatccaggacgaggagcgcgacattcccgaacggtcctggaactctggcaatgagtggatcacggattttgtggggaagacagtctggttcgtgccgagcattaaagccggcaacgacatcgcgaactgtctgagaaagaatggaaagaaagtgattcaactgtcccgcaagacctttgatacagaatatcagaaaaccaagctcaacgactgggatttcgtcgttacgaccgacatctctgagatgggcgccaattttaaagctgatcgggtgatcgaccctagacggtgccttaagcccgtgattctgacagatgggcccgagcgcgtcatcctggccggacctatgcccgtgaccgctgccagcgctgcccagagacggggccgcgttgggagaaaccctcagaaggaaaatgaccaatacattttcacaggacagccgctcaacaatgatgaggaccacgcgcattggaccgaagccaaaatgctgcttgacaacatcaatacacccgagggcattatccctgctctgtttgaacccgagcgggagaagtccgccgctatcgatggggaatacagactcaaaggcgagagccgcaagaccttcgtggaactgatgcggagaggagacctgcctgtctggctcgcccacaaagtggcctctgagggcattaagtatacggatcgcaaatggtgcttcgacggggaacggaacaatcagatccttgaggagaacatggatgttgaaatttggacaaaggagggagaaaagaaaaagctgagaccccgctggctggacgctcggacctactccgatccgctcgcgctgaaagagtttaaggacttcgccgctggcagaaaaagcatcgcccttgatctggtgaccgaaattgggcgcgtcccttctcatctcgcccacagaacacggaatgctctggacaacctggtgatgctccacacctccgagcatggaggccgcgcctatagacacgcggtcgaggaacttcccgagacaatggaaacgctgctgctcctgggccttatgatcctgctcaccgggggagccatgctgtttctgatcagcggcaaggggattggaaagacatccatcggcctcatttgtgtgatcgcttctagcgggatgctttggatggccgatgttcctctgcagtggattgcttccgccatcgtgctggagttctttatgatggtgctcctgattcccgagcctgaaaaacaacggaccccccaggacaatcagcttgcgtacgtcgttatcggaatcctgacactcgccgctattgtggccgctaacgagatgggcctgctggaaaccacgaagcgcgatctcggcatgagcaaagagccgggggtggtctctcctacctcctatcttgacgtggacctgcatcccgccagcgcttggacactgtacgccgttgcgaccacagtgatcacccccatgctcagacacacgattgaaaattctacagccaacgtcagcctggctgccatcgctaaccaagccgtggtccttatgggactggataagggctggcctatttccaaaatggacctcggggtgccgctgctggccctcggatgctattctcaggttaatccccttaccctgacagcggctgtgctgctcctggccacccattacgctatcatcggccctgggcttcaggccaaggccacccgggaggctcagaagagaacagccgcgggaattatgaaaaaccccacggtcgatggcatcatgaccattgacctggatcctgtgatctacgacagcaagttcgagaaacaactcggccaggttatgctgctggtgctctgtgccgtccagcttctgctgatgcgcacatcctgggctctctgcgaagccctgacccttgctacagggcccattaccacgctgtgggagggatctcctggcaagttttggaatacaaccatcgccgtgagcatggcgaacatcttccgggggtcctatctcgccggagctggcctggcctttagcattatgaaatctgtggggaccggaaagagaggcacaggctcccagggggaaaccctgggagagaagtggaaaaagaaactcaatcaacttagccgcaaggaattcgatctgtacaaaaagtccggcatcacagaggttgaccggacggaggctaaagaagggctgaagagaggagagattacccggcacgccgtctctcgcggcagcgctaagctccagtggtttgtggaaagaaacatggtgatcccggaggggcgggtcattgatctgggatgtggccgcggcgggtggtcctattactgcgccggacttaaaaaggttacagaagtgagaggctataccaaagggggacccggccacgaggagcctgtgcccatgtctacatacgggtggaatatcgtcaagctgatgagcggaaaagacgtgttctatctccctcccgaaaagtgtgataccctgctgtgcgacattggcgagtccagcccgtctcctacggttgaagagtcccggaccatccgcgtgctcaagatggtcgagccctggcttaaaaacaatcagttttgtatcaaggtgctgaacccctacatgcctacagttattgaacatctggagagactccagcggaaacacggcgggatgctggtgcgcaatccccttagcagaaactctacccatgaaatgtactggatctccaatggaacaggcaacattgtcagctctgtgaatatggtgagccggctgctcctgaacagattcaccatgacacaccgccggcctaccatcgagaaggatgtcgacctgggggcgggaacgagacacgttaacgccgaaccggagacacccaatatggacgtgattggcgagcgcatcaaacggatcaaggaagagcataactccacctggcactatgatgacgaaaatccttacaagacctgggcttatcatgggtcttacgaggtgaaagccacaggaagcgcttccagcatgattaacggcgtcgtgaagctcctgacgaaaccctgggatgttgtgcctatggtcatccaaatggccatgaccgacacaacccccttcggccagcagagagtgtttaaggaaaaagttgatacacgcaccccgcggcctatgcccgggacaagaaaggtgatggagattaccgccgagtggctttggcgcacgctgggacggaataagagacctcgcctctgcacccgggaagagttcacaaaaaaggtcagaaccaacgcggctatgggcgccgtgtttacagaagagaatcaatgggactccgcccgcgctgccgttgaagatgaggagttctggaaactggtggacagagaacgggagcttcacaagctggggaaatgtggatcttgcgtctataacatgatgggcaagcgcgaaaaaaagctcggggagtttggcaaggctaaaggaagcagagccatctggtacatgtggctgggcgcgcggtatctggagttcgaagccctcgggtttctgaatgaggatcattggttctccagagaaaactcttacagcggagtggagggcgaagggcttcacaagctgggatacattctccgggacatctccaaaatccccggcggggctatgtatgccgatgacaccgctggctgggacacgcgcattacagaggatgacctgcacaatgaggaaaagatcacccagcagatggatcctgagcatagacagcttgccaacgcgatttttaaactgacataccaaaataaggtcgtgaaggttcagcggcccaccccgaaaggaacggtgatggacatcatttctcgcaaggatcagagaggcagcgggcaggtcggaacctatggcctcaacacattcaccaatatggaagcccaactggtgcggcagatggagggggaaggagtgctgtccaaagctgacctcgagaaccctcacctgcttgagaagaaaatcacacagtggctggaaaccaagggcgttgagcgcctcaagagaatggccatcagcggggatgactgcgtggtcaaacccattgatgaccggtttgctaacgccctgcttgctctgaatgatatgggcaaggtgcgcaaagacatcccccagtggcaaccttctaagggatggcatgattggcagcaggttccgttctgttcccaccactttcatgaactcattatgaaagacggcagaaagctggtggtcccctgccggcctcaggacgagctgatcgggcgcgccagaattagccaaggagcgggctggtctctcaaggaaacagcctgtctggggaaagcttacgcccagatgtggtcccttatgtatttccaccggcgcgatctgagactcgccagcaacgctatctgctctgccgtgcccgtccattgggtgcctacctcccggacgacatggagcattcacgcgcatcaccagtggatgaccaccgaggacatgctgacagtttggaatagagtgtggatcgaggataacccctggatggaagacaagacccctgtcacaacgtgggaggatgtgccctaccttggaaaacgcgaagaccaatggtgtggctccctgatcgggctcaccagccgggctacatgggcccagaatattctgaccgccatccagcaggttagatctctgattggcaacgaggagttcctcgattatatgccgagcatgaagcgctttaaaaaggaagaggaatccgagggagctatctggtga

SEQ ID NO: 20661 - RNA, 9873 nt, synthetic construct
  misc_feature 1..9873: note = derived and/or modified CDS sequence (opt5) from DENV-3__FJ898459__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtggggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaagtccagcccttcctggccctcggatttttcctgcggaagctcacatctagagaaaacctgcttctgggcgtggggctcgctatggccaccacactgcaactgcctgaggatatcgaacagatggctaatggaattgcccttggcctgatggcgctcaaactgatcacccagtttgagacctaccagctctggacagccctgatttcccttacgtgtagcaacaccatgttcacactgaccgtggcttggcgcacagccaccctcatcctggctggcgtctccctgcttccggtttgccaatctagctccatgcggaagacggactggctgcccatggccgtggccgctatgggggtgcctcccctccctctgtttattttctctctcaaggatacactgaaaagacgcagctggccccttaatgagggagtcatggcggtgggcctggtttccatcctggcctctagcctcctgagaaacgacgtgcctatggctgggccccttgtcgccggaggcctgctcatcgcctgttatgtgattaccgggacctccgctgatctgacagttgaaaaggccgcggacatcacctgggaggaagaggctgaacagacaggagtgagccacaacctcatgattacggtcgacgatgacggcaccatgcggatcaaagatgacgagacagagaatattctgaccgtgcttctgaagacagccctgctcatcgtctctggcgtgtttccgtactccatccctgccaccctgcttgtttggcatacgtggcagaaacagacccaacgcagcggggtgctgtgggatgtcccctctcctcccgaaacacagaaggctgagctcgaagagggagtgtacagaattaaacagcagggcatcttcgggaagacccaagttggagtgggcgtccagaaggagggggtgtttcacacaatgtggcacgtgacccggggagccgttctgacatataacggcaaacgcctcgaaccgaattgggcgtccgtcaagaaagacctgattagctacggcgggggatggagactttctgctcagtggcaaaagggcgaggaagtccaggtgatcgccgtcgagcctgggaaaaaccccaagaatttccagacgatgcctggaaccttccagacaaccaccggcgaaattggggccatcgctctggattttaagcccggaacatccggcagccccattatcaaccgggagggcaaagtggttgggctgtatggaaatggcgtggtcacgaagaacgggggatacgtgtccggcatcgcccaaaccaatgctgagcctgacgggccgacacccgaactcgaggaagagatgttcaaaaagcgcaacctgaccattatggatcttcatcctggcagcggaaaaacaagaaagtatctgcccgccatcgttcgggaagcgattaagcgcagactccggaccctgatcctcgcccctacgagagtggtcgctgccgagatggaggaagctctgaaaggccttcccattcgctaccagacaaccgccaccaagtctgagcacacagggcgggaaatcgtggacctgatgtgccatgccacctttacaatgagactgctcagccctgttcgcgtgccgaattataacctgatcattatggatgaggctcacttcaccgaccccgcgtccatcgccgctcggggatacatttctacgagagtcggcatgggggaagccgccgctatctttatgacagccacccctcccggaacagcggatgctttccctcagagcaatgcccccattcaggacgaggagcgcgacatcccggaacggtcctggaactctggcaatgagtggatcaccgattttgccgggaaaacggtgtggttcgtgcctagcattaaggctggcaacgacatcgccaactgtcttcgcaaaaatggaaagaaggtcattcaactgtccagaaaaacctttgatacagaataccagaagaccaaactcaacgactgggatttcgttgtgacaaccgacatctctgagatgggcgcgaattttaaggccgatcgggtgattgaccccagacggtgcctgaaacccgtcatcctgacagatgggcctgagcgcgtgattctcgctggacccatgcctgttaccgccgctagcgccgctcagagacggggccgcgtggggagaaacccgcagaaggaaaatgaccaatatatcttcacgggacagccccttaacaatgatgaggaccatgcccactggacagaagcgaagatgctgctggacaacatcaatacccctgagggcattatccccgccctcttcgaacctgagcgggagaaatccgctgccattgatggggaatacagactgaagggcgagagccgcaaaacctttgtcgaacttatgcggagaggagacctgcccgtgtggctcgctcacaaggttgcctctgagggcatcaaatatacagatcgcaagtggtgcttcgacgggcagcggaacaatcagattctggaagagaacatggatgtggagatctggaccaaagaaggagagaagaagaaactgagaccgcgctggctcgacgcccggacatactccgatcctcttgctctgaaggaatttaaagacttcgcggccggcagaaagagcatcgctctggatctcgtcacggagattgggcgcgtgccctctcatctggcccacagaacccggaatgcccttgacaacctggtcatgctccatacatccgaacacggaggccgcgcttatagacacgccgtggaggagctgcctgaaaccatggagacactgctccttctgggcctgatgatcctcctgaccgggggagcgatgctttttctgattagcggcaaagggatcggaaagacgtccattggcctcatctgtgttatcgcctctagcgggatgctgtggatggctgaaattcccctgcaatggatcgcctccgctattgtgctcgagttctttatgatggtgcttctgatccctgagcccgaaaagcagcggaccccgcaggataatcaactggcctacgtcgttattggaatcctcacactggcggccattatcgctgccaacgagatgggccttctggaaaccacaaaacgcgacctcggcatgagcaaggagcctggggtggtgtctcccacctcctatctggatgtcgacctgcatcccgctagcgcctggacgctctacgctgtggccacaaccgttatcacacctatgcttagacacaccattgaaaattctaccgcgaacgtgagcctggccgctatcgccaaccaggctgtcgtgctgatgggactcgacaaaggctggccgatttccaagatggatctgggggtcccccttctggccctcggatgctactctcaggtgaatcctctgacactgacggccgcggttctccttctgatcacccattatgctattatcggccccgggctgcaggccaaagctacacgggaggcccaaaagagaaccgccgctggaatcatgaagaaccctacagtggacggcattatgaccatcgatctcgaccccgtcatttacgatagcaaattcgagaagcagctgggccaggtgatgcttctggttctctgtgccgtgcagctgctgctcatgcgcacgtcctgggcgctttgcgaagccctgacactggctaccgggcctatcaccacactctgggagggatctccgggcaaattttggaataccacaattgccgtcagcatggctaacatcttccgggggtcctatctggccggagcgggccttgcctttagcatcatgaagtctgtggggacgggaaaaagaggcaccggctcccaaggggaaacactgggagagaagtggaagaaaaagctcaatcagctgagccgcaaagagttcgacctgtacaagaaatccggcattaccgaggtggatcggacagaggctaaggaagggctcaaaagaggagagaccacgcaccatgccgtttctcggggcagcgctaaacttcagtggtttgtcgaacgcaacatggtgatccccgaggggagagtgattgacctgggatgtggccggggcgggtggtcctattactgcgccggactgaagaaagtcaccgaagttcgcggctatacaaaagggggacctggccacgaggagcccgtgcctatgtctacctacgggtggaatatcgtgaaactcatgagcggaaaggatgtcttctacctgcccccggaaaaatgtgacacacttctgtgcgatattggcgagtccagcccttctcccaccgtggaagagtccagaacaatccgggttctcaagatggtggagccctggctgaagaacaatcagttctgtattaaagtcctgaacccttatatgcccaccgtgatcgaacacctcgagcgccttcaaagaaagcatggcgggatgctggttcggaatcctctgagccgcaactctacgcacgaaatgtactggatctccaatggaacaggcaacattgtggctagcgtcaatatggtgtctagactcctgcttaaccggtttaccatgacccatagacgcccgacaatcgagaaagacgtggatctgggggccggaacgcggcacgtcaacgcggaacccgagacccctaatatggacgttattggcgagagaatcaagcgcattaaagaagaacacaacagcacatggcattatgacgatgaaaatccctacaagacctgggcctatcacgggtcctacgaggtgaaggctacaggatctgccagctccatgatcaacggcgtggtcaaactcctgaccaagccttgggacgtggttcccatggtgacacagatggctatgaccgatacgaccccgttcggccagcaacgggtctttaaagaaaaggtggacacaagaacccctcgcagcatgcccgggacacggagagttatgggaatcaccgccgagtggctgtggcgcacgctcggccggaataaaaagcctagactgtgcacacgcgaggagttcaccaagaaagtgcggacaaacgccgcgatgggggctgtctttaccgaggaaaatcagtgggattccgccaaggccgctgtggaggacgaagatttctggaaacttgttgacagagagcgcgagctgcataagctcggaaaatgtggctcttgcgtgtataacatgatggggaagagagagaagaagctgggcgagtttggaaaggccaaaggcagccgggctatttggtacatgtggcttggggcccgctacctggagttcgaggcgctcggatttctgaatgaggatcactggttctccagagaaaactcttatagcggcgtcgagggggaaggactgcataagctcggctacatcctgcgggacatttccaaaatccccgggggcgccatgtatgctgatgacacggccggatgggacaccagaattacagaggatgaccttcacaatgaagagaagatcacccagcagatggatcctgagcaccggcaactggctaacgccatctttaaactcacataccagaataaggtggtcaaggtgcagcgccccaccccgacaggcaccgttatggacattatctctagaaaagatcagcgggggagcggacaagtgggcacgtatgggctgaacacattcaccaatatggaagcgcagcttattcgccagatggagggagaaggcgtcctgtccaaggccgacctcgagaaccctcatctgcccgagaagaagatcacccagtggctggagacaaaaggggtggagagactcaagcggatggctattagcggcgatgactgcgtggttaagcccatcgatgaccgctttgccaacgctctgcttgccctgaatgatatgggaaaagtgagaaaggacatccctcaatggcagccgtctaaaggctggcacgattggcagcaggtccccttctgttcccatcacttccacgaactcattatgaaggacgggcggaaactggtggttccttgccgcccccaagacgagcttatcggacgggctcggattagccagggcgccgggtggtctctgcgcgaaaccgcgtgtctcggaaaggcctacgctcagatgtggtccctgatgtattttcatagacgggatctgcgcctcgccagcaacgccatctgctctgctgtgcctgtccactgggtgcccacatccagaacgacctggagcattcatgcccaccatcaatggatgacaaccgaggacatgctgacagtctggaatcgggtgtggatcgaagataacccttggatggaggacaagacccccgttacgacctgggagaatgtgccgtaccttggcaaaagagaagatcagtggtgtgggtccctgattggcctcacaagccgcgcgacctgggctcagaacatccctacagccatccagcaagtccggtctctgattggaaatgaggagttccttgactacatgcccagcatgaagagatttcgcaaagaggaggaatccgagggcgccatctggtga

SEQ ID NO: 20662 - RNA, 9873 nt, synthetic construct
  misc_feature 1..9873: note = derived and/or modified CDS sequence (opt5) from DENV-3__EU482555__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggagtgatcaccctgtatctcggcgctgttgtgcaggccgacatggggtgtgtcattaattggaaaggaaaggagctgaagtgcggcagcgggatcttcgtgacaaacgaggttcatacgtggaccgaacagtacaaatttcaagcggattcccccaagcggctggccacagctattgccggcgcttgggagaatggagtgtgtggcatcagaagcaccacacgcatggaaaaccttctctggaaacagattgccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggccaagattgtcaccgctgaaatccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggacctcgattttaattattgcgagggaaccacggttgtgatcacagagaactgtggcacccggggcccctctctgagaacaaccacagtctccgggaaactgatccacgaatggtgctgtcgcagctgcacccttccgcctctccggtacatgggagaggacggctgttggtatgggatggaaattagacccatctctgagaaggaagagaatatggtgaaatccctggttagcgccggatctggcaaggtggataacttcacgatgggggtcctgtgcctcgccattctgtttgaggaagtgatgcggggaaagttcggcaaaaagcatatgatcgctggcgttttctttaccttcgtgcttctgctcagcgggcagattacatggcgcgacatggcccacaccctgatcatgattggatccaatgcgagcgataaaatgggcatgggggtcacatacctggctcttatcgccacctttaagatccagcccttcctggccctcggatttttcctgagaaaactcacgtctcgggagaacctgcttctgggcgtggggctcgctatggccacaaccctgcaactgcctgaagacattgagcagatggctaatggaatcgcccttggcctgatggcgctcaagctgattacacagtttgaaacctatcagctctggaccgccctgatctcccttacatgtagcaacacgatgttcaccctgacagtggcttggagaaccgccacactcattctggctggcgtctccctgcttccggtttgccaatctagctccatgcgcaagaccgattggctgcccatggccgtggccgctatgggggtgcctcccctccctctgtttatcttctctctcaaagacacgctgaagcggagaagctggccccttaatgagggagtcatggcggtgggcctggtttccatcctggcctctagcctcctgcgcaacgatgtgcctatggctgggccccttgtcgccggaggcctgctcattgcctgttacgtgatcacagggacctccgctgacctgaccgttgagaaagccgcggacattacatgggaagaggaagctgagcagaccggagtgagccataacctcatgatcacagtcgatgacgatggcacgatgagaattaaggacgatgaaaccgagaatatcctgacagtgcttctgaaaaccgccctgctcatcgtctctggcgtgtttccgtactccattcctgccacactgcttgtttggcacacctggcagaagcagacgcaacggagcggggtgctgtgggacgtcccctctcctcccgagacccagaaagctgaactcgaggaaggagtgtatcgcatcaagcagcagggcattttcgggaagacacaagttggagtgggcgtccagaaagagggggtgtttcataccatgtggcacgtgacaagaggagccgttctgacctacaacggcaagcggctcgagccgaattgggcgtccgtcaaaaaggatctgatcagctatggcgggggatggcgcctttctgctcagtggcaaaaaggcgaagaggtgcaggtgattgccgtcgaacctgggaagaaccccaagaatttccagacaatgcctggaacgttccagaccacaaccggcgagatcggggccattgctctggactttaaacccggaacctccggcagccccatcatcaacagagaaggcaaggtggttgggctgtacggaaatggcgtggtcacaaaaaacgggggatatgtgtccggcattgcccaaacgaatgctgagcctgatgggccgacccccgagctcgaagaggaaatgttcaagaaacggaacctgacaatcatggaccttcaccctggcagcggaaagacccgcaagtacctgcccgccattgttagagaggcgatcaaacggcgcctcagaacactgattctcgcccctacccgggtggtcgctgccgaaatggaggaggctctgaagggccttcccatcagatatcagacgacagccaccaaatctgaacataccgggcgcgagatcgtggatctgatgtgccacgccacatttaccatgcggctgctcagccctgttagagtgccgaattacaacctgattatcatggacgaagctcatttcacagatcccgcgtccattgccgctcgcggatacatctctacccgggtcggcatgggggaggccgccgctatttttatgacggccacacctcccggaaccgcggacgctttccctcagagcaatgcccccatccaggacgaagagagagatatcccggagcgctcctggaactctggcaatgaatggattacagactttgccgggaagaccgtgtggttcgtgcctagcatcaaagctggcaacgatattgccaactgtcttcggaagaatggaaagaaagtcatccaactgtccagaaagacgtttgacaccgagtatcagaaaacaaagctcaacgattgggacttcgttgtgaccacagatatttctgaaatgggcgcgaattttaaagccgaccgcgtgatcgatccccggagatgcctgaagcccgtcattctgaccgacgggcctgagcgggtgatcctcgctggacccatgcctgttacagccgctagcgccgctcagcgcagaggccgggtggggcgcaacccgcagaaggagaatgatcaatacatcttcaccggacagccccttaacaatgacgaagaccacgcccattggacggaggcgaaaatgctgctggataacattaatacacctgaaggcatcattcccgccctcttcgagcctgaaagagagaagtccgctgccatcgacggggagtatcggctgaaaggcgaaagcagaaagacctttgtcgagcttatgcgccggggagatctgcccgtgtggctcgctcacaaagttgcctctgaaggcattaagtacaccgacagaaaatggtgcttcgatgggcagcgcaacaatcagatcctggaggaaaacatggacgtggagatctggacaaaggagggagaaaagaaaaagctgcggccgagatggctcgatgcccgcacctattccgaccctcttgctctgaaagagtttaaggatttcgcggccggccggaaaagcattgctctggacctcgtcacagaaatcgggagagtgccctctcacctggcccatcgcacgagaaatgcccttgataacctggtcatgctccacacctccgagcatggaggccgggcttaccgccacgccgtggaagagctgcctgagacaatggaaaccctgctccttctgggcctgatgattctcctgacagggggagcgatgctttttctgatcagcggcaaggggattggaaagacctccatcggcctcatctgtgttattgcctctagcgggatgctgtggatggctgagatccccctgcaatggattgcctccgctatcgtgctcgaattctttatgatggtgcttctgattcctgagcccgagaaacagagaacgccgcaggacaatcaactggcctatgtcgttatcggaattctcaccctggcggccatcatcgctgccaacgaaatgggccttctggagacaaccaagcgggatctcggcatgagcaaagaacctggggtggtgtctcccacatcctacctggacgtcgacctgcaccccgctagcgcctggaccctctacgctgtggccacgacagttattacccctatgcttcgccatacaatcgagaattctaccgcgaacgtgagcctggccgctattgccaaccaggctgtcgtgctgatgggactcgataagggctggccgatctccaaaatggacctgggggtcccccttctggccctcggatgctattctcaggtgaatcctctgaccctgacagccgcggttctccttctgattacgcactacgctatcatcggccccgggctgcaggccaaggctaccagagaagcccaaaagcggacagccgctggaattatgaaaaaccctaccgtggatggcatcatgacaattgacctcgatcccgtcatctatgacagcaagttcgagaaacagctgggccaggtgatgcttctggttctctgtgccgtgcagctgctgctcatgagaacctcctgggcgctttgcgaggccctgacgctggctacagggcctattaccaccctctgggaaggatctccgggcaagttttggaatacaaccatcgccgtcagcatggctaacatcttccgcgggtcctacctggccggagcgggccttgcctttagcattatgaaatctgtggggacaggaaagcggggcacgggctcccaaggggagaccctgggagaaaagtggaaaaagaaactcaatcagctgagcagaaaggagttcgatctgtataaaaagtccggcatcacagaagtggaccgcaccgaggctaaagaggggctcaagcggggagaaacaacccatcacgccgtttctagaggcacggctaagcttcagtggtttgtcgagcggaacatggtgattcccgaagggcgcgtgatcgatctgggatgtggcagaggcgggtggagctactattgcgccggactgaaaaaggtcaccgaggttcggggctacacaaaagggggacctggccatgaagagcccgtgcctatgtccacctacgggtggaatattgtgaagctcatgtctggaaaagacgtcttctatctgcccccggagaagtgtgatacacttctgtgcgacatcggcgaaagctcccctagccccaccgtggaggaatctcgcacaattagagttctcaagatggtggagccctggctgaaaaacaatcagttctgtatcaaggtcctgaacccttacatgcccaccgtgatcgagcacctcgaacggcttcaacgcaaacacggcgggatgctggttagaaatcctctgtcccggaacagcacgcatgagatgtattggatttctaatggaacaggcaacatcgtggcttccgtcaatatggtgagccgcctcctgcttaacagatttaccatgacccaccggagaccgacaattgaaaaggatgtggacctgggggccggaacgcgccatgtcaacgcggagcccgaaacccctaatatggacgttatcggcgagcggattaaaagaatcaaggaggaacacaactctacatggcactacgatgacgagaatccctataagacctgggcctaccatgggagctatgaagtgaaagctacaggatccgcctctagcatgatcaacggcgtggtcaagctcctgaccaaaccttgggatgtggttcccatggtgacacagatggctatgaccgacacgaccccgttcggccagcaacgcgtctttaaggagaaagtggatacacggacccctagatccatgcccgggacacgccgggttatgggaattaccgccgaatggctgtggagaacgctcggccgcaataagaagcctcggctgtgcacaagagaggagttcaccaaaaaggtgcgcacaaacgccgcgatgggggctgtctttaccgaagagaatcagtgggacagcgccaaagccgctgtggaagatgaggacttctggaagcttgttgatcgggaaagagagctgcacaaactcggaaagtgtggctcctgcgtgtacaacatgatggggaaacgcgagaagaagctgggcgaatttggaaaagccaagggctctagagctatctggtacatgtggcttggggcccggtatctggagttcgaagcgctcggatttctgaatgaggaccattggttcagccgcgagaactcctactctggcgtcgaaggggagggactgcacaaactcggctatattctgagagatatcagcaagattcccgggggcgccatgtacgctgacgacacggccggatgggatacccggatcacagaagacgatcttcataatgaggaaaaaatcacccagcagatggaccctgagcacagacaactggctaacgccatttttaagctcacatatcagaataaggtggtcaaagtgcagcggcccaccccgacaggcaccgttatggatatcatttcccgcaaggaccagagagggtctggacaagtgggcacgtacgggctgaacacattcaccaatatggaggcgcagcttatccggcagatggaaggagagggcgtcctgagcaaagccgatctcgaaaaccctcacctgcccgagaagaaaattacccagtggctggaaacaaagggggtggagcgcctcagacggatggctatctccggcgacgattgcgtggttaagcccatcgacgatcgctttgccaacgctctgcttgccctgaatgacatgggaaaagtgagaaaggatattcctcaatggcagccgagcaaaggctggcatgactggcagcaggtccccttctgttctcaccatttccacgagctcatcatgaaggacgggcggaaactggtggttccttgccgcccccaagatgaacttattggaagagctcggatctcccagggcgccgggtggagcctgcgcgagaccgcgtgtctcggaaaggcctatgctcagatgtggtctctgatgtactttcacagacgggacctgcgcctcgcctccaacgccatttgcagcgctgtgcctgtccattgggtgcccacatctagaacgacctggtccatccacgcccatcaccaatggatgacaaccgaagatatgctgacagtctggaatcgggtgtggattgaggacaacccttggatggaagataagacccccgttacgacctgggagaatgtgccgtaccttggcaaaagagaggaccagtggtgtgggagcctgatcggcctcacatcccgcgcgacctgggctcagaacatccctacagccattcagcaagtccggagcctgatcggaaatgaagagttccttgattatatgccctctatgaagagatttcgcaaagaagaggagagcgaaggcgccatttggtga

SEQ ID NO: 20663 - RNA, 9873 nt, synthetic construct
  misc_feature 1..9873: note = derived and/or modified CDS sequence (opt5) from DENV-3__EU529692__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggagtgatcaccctgtatctcggcgctgttgtgcaggccgacatggggtgtgtcattaattggaaaggaaaggagctgaagtgcggcagcgggatcttcgtgacaaacgaggttcatacgtggaccgaacagtacaaatttcaagcggattcccccaagcggctggccacagctattgccggcgcttgggagaatggagtgtgtggcatcagaagcaccacacgcatggaaaaccttctctggaaacagattgccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggccaagattgtcaccgctgaaatccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggacctcgattttaattattgcgagggaaccacggttgtgatcacagagaactgtggcacccggggcccctctctgagaacaaccacagtctccgggaaactgatccacgaatggtgctgtcgcagctgcacccttccgcctctccggtacatgggagaggacggctgttggtatgggatggaaattagacccatctctgagaaggaagagaatatggtgaaatccctggttagcgccggatctggcaaggtggataacttcacgatgggggtcctgtgcctcgccattctgtttgaggaagtgatgcggggaaagttcggcaaaaagcatatgatcgctggcgttttctttaccttcgtgcttctgctcagcgggcagattacatggcgcgacatggcccacaccctgatcatgattggatccaatgcgagcgataaaatgggcatgggggtcacatacctggctcttatcgccacctttaagatccagcccttcctggccctcggatttttcctgagaaaactcacgtctcgggagaacctgcttctgggcgtggggctcgctatggccacaaccctgcaactgcctgaagacattgagcagatggctaatggaatcgcccttggcctgatggcgctcaagctgattacacagtttgaaacctatcagctctggaccgccctgatctcccttacatgtagcaacacgatgttcaccctgacagtggcttggagaaccgccacactcattctggctggcgtctccctgcttccggtttgccaatctagctccatgcgcaagaccgattggctgcccatggccgtggccgctatgggggtgcctcccctccctctgtttatcttctctctcaaagacacgctgaagcggagaagctggccccttaatgagggagtcatggcggtgggcctggtttccatcctggcctctagcctcctgcgcaacgatgtgcctatggctgggccccttgtcgccggaggcctgctcattgcctgttacgtgatcacagggacctccgctgacctgaccgttgagaaagccgcggacattacatgggaagaggaagctgagcagaccggagtgagccataacctcatgatcacagtcgatgacgatggcacgatgagaattaaggacgatgaaaccgagaatatcctgacagtgcttctgaaaaccgccctgctcatcgtctctggcgtgtttccgtactccattcctgccacactgcttgtttggcacacctggcagaagcagacgcaacggagcggggtgctgtgggacgtcccctctcctcccgagacccagaaagctgaactcgaggaaggagtgtatcgcatcaagcagcagggcattttcgggaagacacaagttggagtgggcgtccagaaagagggggtgtttcataccatgtggcacgtgacaagaggagccgttctgacctacaacggcaagcggctcgagccgaattgggcgtccgtcaaaaaggatctgatcagctatggcgggggatggcgcctttctgctcagtggcaaaaaggcgaagaggtgcaggtgattgccgtcgaacctgggaagaaccccaagaatttccagacaatgcctggaacgttccagaccacaaccggcgagatcggggccattgctctggactttaaacccggaacctccggcagccccatcatcaacagagaaggcaaggtggttgggctgtacggaaatggcgtggtcacaaaaaacgggggatatgtgtccggcattgcccaaacgaatgctgagcctgatgggccgacccccgagctcgaagaggaaatgttcaagaaacggaacctgacaatcatggaccttcaccctggcagcggaaagacccgcaagtacctgcccgccgttgtgagagaggcgattaaacggcgcctcagaacactgatcctcgcccctacccgggtcgtggctgccgaaatggaggaggctctgaagggccttcccattagatatcagacgacagccaccaaatctgaacataccgggcgcgagatcgttgatctgatgtgccacgccacatttaccatgcggctgctcagccctgtgagagtcccgaattacaacctgatcattatggacgaagctcatttcacagatcccgcgtccatcgccgctcgcggatacatttctacccgggtgggcatgggggaggccgccgctatctttatgacggccacacctcccggaaccgcggacgctttccctcagagcaatgcccccattcaggacgaagagagagatatcccggagcgctcctggaactctggcaatgaatggatcacagactttgccgggaagaccgtgtggttcgtccctagcattaaagctggcaacgatatcgccaactgtcttcggaagaatggaaagaaagttattcaactgtccagaaagacgtttgacaccgagtatcagaaaacaaagctcaacgattgggacttcgtggtgaccacagatatctctgaaatgggcgcgaattttaaagccgaccgcgtcattgatccccggagatgcctgaagcccgtgatcctgaccgacgggcctgagcgggttattctcgctggacccatgcctgtgacagccgctagcgccgctcagcgcagaggccgggtcgggcgcaacccgcagaaggagaatgatcaatacatcttcaccggacagccccttaacaatgacgaagaccacgcccattggacggaggcgaaaatgctgctggataacatcaatacacctgaaggcattatccccgccctcttcgagcctgaaagagagaagtccgctgccattgacggggagtatcggctgaaaggcgaaagcagaaagacctttgtggagcttatgcgccggggagatctgcccgtttggctcgctcacaaagtggcctctgaaggcatcaagtacaccgacagaaaatggtgcttcgatgggcagcgcaacaatcagattctggaggaaaacatggacgtcgagatctggacaaaggagggagaaaagaaaaagctgcggccgagatggctcgatgcccgcacctattccgaccctcttgctctgaaagagtttaaggatttcgcggccggccggaaaagcatcgctctggacctcgtgacagaaattgggagagtcccctctcacctggcccatcgcacgagaaatgcccttgataacctggtgatgctccacacctccgagcatggaggccgggcttaccgccacgccgttgaagagctgcctgagacaatggaaaccctgctccttctgggcctgatgatcctcctgacagggggagcgatgctttttctgattagcggcaaggggatcggaaagacctccattggcctcatctgtgtgatcgcctctagcgggatgctgtggatggctgagattcccctgcaatggatcgcctccgctattgtgctcgaattctttatgatggtccttctgatccctgagcccgagaaacagagaacgccgcaggacaatcaactggcctatgttgtgattggaatcctcaccctggcggccattatcgctgccaacgaaatgggccttctggagacaaccaagcgggatctcggcatgagcaaagaacctggggtggtctctcccacatcctacctggacgtggacctgcaccccgctagcgcctggaccctctacgctgttgccacgacagtgatcacccctatgcttcgccatacaattgagaattctaccgcgaacgtcagcctggccgctatcgccaaccaggctgtggtcctgatgggactcgataagggctggccgatttccaaaatggacctgggggtgccccttctggccctcggatgctattctcaggttaatcctctgaccctgacagccgcggtgctccttctgatcacgcactacgctattatcggccccgggctgcaggccaaggctaccagagaagcccaaaagcggacagccgctggaatcatgaaaaaccctaccgtcgatggcattatgacaatcgacctcgatcccgtgatttatgacagcaagttcgagaaacagctgggccaggttatgcttctggtgctctgtgccgtccagctgctgctcatgagaacctcctgggcgctttgcgaggccctgacgctggctacagggcctatcaccaccctctgggaaggatctccgggcaagttttggaatacaaccattgccgtgagcatggctaacatcttccgcgggtcctacctggccggagcgggccttgcctttagcatcatgaaatctgtggggacaggaaagcggggcacgggctcccaaggggagaccctgggagaaaagtggaaaaagaaactcaatcagctgagcagaaaggagttcgatctgtataaaaagtccggcattacagaagttgaccgcaccgaggctaaagaggggctcaagcggggagaaacaacccatcacgccgtctctagaggcacggctaagcttcagtggtttgtggagcggaacatggtgatccccgaagggcgcgtcattgatctgggatgtggcagaggcgggtggagctactattgcgccggactgaaaaaggttaccgaggtgcggggctacacaaaagggggacctggccatgaagagcccgtgcctatgtccacctacgggtggaatatcgtcaagctcatgtctggaaaagacgtgttctatctgcccccggagaagtgtgatacacttctgtgcgacattggcgaaagctcccctagccccaccgttgaggaatctcgcacaatcagagtgctcaagatggtcgagccctggctgaaaaacaatcagttctgtattaaggtgctgaacccttacatgcccaccgttatcgagcacctcgaacggcttcaacgcaaacacggcgggatgctggtgagaaatcctctgtcccggaacagcacgcatgagatgtattggatctctaatggaacaggcaacattgtcgcttccgtgaatatggtgagccgcctcctgcttaacagatttaccatgacccaccggagaccgacaatcgaaaaggatgtcgacctgggggccggaacgcgccatgttaacgcggagcccgaaacccctaatatggacgtgattggcgagcggatcaaaagaattaaggaggaacacaactctacatggcactacgatgacgagaatccctataagacctgggcctaccatgggagctatgaagtgaaagctacaggatccgcctctagcatgatcaacggcgtcgtgaagctcctgaccaaaccttgggatgttgtgcccatggtcacacagatggctatgaccgacacgaccccgttcggccagcaacgcgtgtttaaggagaaagttgatacacggacccctagatccatgcccgggacacgccgggtgatgggaatcaccgccgaatggctgtggagaacgctcggccgcaataagaagcctcggctgtgcacaagagaggagttcaccaaaaaggtccgcacaaacgccgcgatgggggctgtgtttaccgaagagaatcagtgggacagcgccaaagccgctgttgaagatgaggacttctggaagcttgtggatcgggaaagagagctgcacaaactcggaaagtgtggctcctgcgtctacaacatgatggggaaacgcgagaagaagctgggcgaatttggaaaagccaagggctctagagctatttggtacatgtggcttggggcccggtatctggagttcgaagcgctcggatttctgaatgaggaccattggttcagccgcgagaactcctactctggcgtggaaggggagggactgcacaaactcggctatatcctgagagatattagcaagatccccgggggcgccatgtacgctgacgacacggccggatgggatacccggattacagaagacgatcttcataatgaggaaaaaatcacccagcagatggaccctgagcacagacaactggctaacgccatctttaagctcacatatcagaataaggtcgtgaaagttcagcggcccaccccgacaggcaccgtgatggatattatctcccgcaaggaccagagagggtctggacaagtcggcacgtacgggctgaacacattcaccaatatggaggtgcagcttattcggcagatggaaggagagggcgtgctgagcaaagcggatctcgaaaaccctcacctgcccgagaagaaaatcacccagtggctggaaacaaagggggttgagcgcctcagacggatggccatttccggcgacgattgcgtggtcaagcccatcgacgatcgctttgctaacgccctgcttgctctgaatgacatgggaaaagtgagaaaggatatccctcaatggcagccgagcaaaggctggcatgactggcagcaggttcccttctgttctcaccatttccacgagctcattatgaaggacgggcggaaactggtggtcccttgccgcccccaagatgaacttatcggaagagcccggatttcccagggcgctgggtggagcctgcgcgagaccgcctgtctcggaaaggcgtatgcccagatgtggtctctgatgtactttcacagacgggacctgcgcctcgcttccaacgccatctgcagcgccgtgcctgtccattgggtgcccacatctagaacgacctggtccattcacgctcatcaccaatggatgacaaccgaagatatgctgacagtttggaatcgggtgtggatcgaggacaacccttggatggaagataagacccccgtcacgacctgggagaatgtgccgtaccttggcaaaagagaggaccagtggtgtgggagcctgattggcctcacatcccgcgccacctgggcgcagaacatccctacagctatccagcaagttcggagcctgattggaaatgaagagttccttgattatatgccctctatgaagagatttcgcaaagaagaggagagcgaaggcgccatctggtga

SEQ ID NO: 20664 - RNA, 9873 nt, synthetic construct
  misc_feature 1..9873: note = derived and/or modified CDS sequence (opt5) from DENV-3__EU482558__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaataccagcgacagaatgggcatgggggtcacgtacctggcccttatcgcgacatttaaaatccagcccttcctggctctcggatttttcctgcggaagctcacctctagagaaaacctgcttctgggcgtggggctcgccatggccacaaccctgcaactgcctgaggatattgaacagatggctaatggaatcgcccttggcctgatggctctcaaactgattacccagtttgagacatatcagctctggacggccctgatctcccttacctgtagcaacacaattttcaccctgacagtggcgtggcgcaccgccacgctcatcctggctggcgtctccctgcttccggtttgccaatctagctccatgcggaagacagactggctgcccatgaccgtggccgctatgggggtgcctcccctccctctgtttatcttctctctcaaggataccctgaaaagacgcagctggccccttaatgagggagtcatggccgtgggcctggtttccattctggcctctagcctcctgagaaacgacgtgcctatggctgggccccttgtcgcgggaggcctgctcatcgcctgttacgtgattacagggacctccgctgatctgacagttgaaaaggccgccgacgtgacgtgggaggaagaggctgaacagaccggagtcagccataacctcatgatcacagtggacgatgacggcaccatgcggattaaagatgacgagacagagaatatcctgaccgtccttctgaagacggccctgctcatcgtgtctggcatttttccgtactccatccctgcgaccctgcttgtttggcacacatggcagaaacagacccaacgcagcggggtgctgtgggatgtcccctctcctcccgaaacacagaaggctgagctcgaagagggagtgtatagaattaaacagcagggcatcttcgggaagacccaagttggagtgggcgtccagaaggagggggtgtttcatacaatgtggcacgtgacgcggggagccgttctgacctacaacggcaaacgcctcgaaccgaattgggcctccgtcaagaaagacctgattagctatggcgggggatggagactttctgctcagtggcaaaagggcgaggaagtccaggtgatcgccgtcgagcctgggaaaaaccccaagaatttccagacaatgcctggaaccttccagaccacaacgggcgaaattggggcgatcgctctggattttaagcccggaacctccggcagccccatcattaaccgggagggcaaagtggttgggctgtacggaaatggcgtggtcacaaagaacgggggatatgtgtccggcatcgcccaaaccaatgccgagcctgacgggccgacacccgaactcgaggaagagatgttcaaaaagcgcaacctgaccattatggatcttcaccctggcagcggaaaaacgagaaagtacctgcccgctatcgttcgggaagccattaagcgcagactccggacactgatcctcgctcctaccagagtggtcgccgcggagatggaggaagccctgaaaggccttcccatccgctatcagaccacagctaccaagtctgagcatacagggcgggaaattgtggacctgatgtgccacgccacctttacgatgagactgctcagccctgttcgcgtgccgaattacaacctgatcattatggatgaggctcatttcacagaccccgcctccatcgccgctcggggatacatttctaccagagtcggcatgggggaagcggccgctatctttatgacagccacccctcccggaacggccgatgctttccctcagagcaatgcccccatccaggacgaggagcgcgacattccggaacggtcctggaactctggcaatgagtggatcaccgattttgcggggaaaacagtgtggttcgtgcctagcattaaggctggcaacgacatcgccaactgtcttcgcaaaaatggaaagaaggtcattcaactgtccagaaaaacctttgatacagaatatcagaagaccaaactcaacgactgggatttcgttgtgacaaccgacatctctgagatgggcgccaattttaaggctgatcgggtgattgaccccagacggtgcctgaaacccgtcatcctgacggatgggcctgagcgcgtgatcctcgccggacccatgcctgttacagcggccagcgctgcccagagacggggccgcgtggggagaaacccgcagaaggaaaatgaccaatacattttcaccggacagccccttaacaatgatgaggaccacgctcattggaccgaagccaagatgctgctggacaacatcaatacacctgagggcattatccccgctctcttcgaacctgagcgggagaaatccgccgcgattgatggggaatatagactgaagggcgagagccgcaaaacctttgtcgaacttatgcggagaggagacctgcccgtgtggctcgcccacaaggttgcttctgagggcatcaaatacacagatcgcaagtggtgcttcgacgggcagcggaacaatcagatcctggaagagaacatggatgtggagatttggacgaaagaaggagagaagaagaaactgagaccgcgctggctcgacgcccggacctattccgatcctcttgctctgaaggaatttaaagacttcgccgccggcagaaagagcatcgctctggatctcgtcacagagattgggcgcgtgccctctcacctggcgcatagaacccggaatgcccttgacaacctggtcatgctccacacatccgaacatggaggcaaggcttaccgccacgccgtggaggagctgcctgaaaccatggagacgctgctccttctgggcctgatgatcctcctgaccgggggagccatgctttttctgattagcggcaaggggatcggaaagacatccatcggcctcatttgtgttatcgcttctagcgggatgctgtggatggccgaaattcccctgcaatggatcgcgtccgccattgtgctcgagttctttatgatggtgcttctgatccctgagcccgaaaaacagagaaccccgcaggataatcaactggcttatgtcgttattggaatcctcacactggccgctatcattgccgcgaacgagatgggccttctggaaaccacgaagcgggacctcggcatgagcaaagagcctggggtggtgtctcccacatcctacctggatgtcgacctgcaccccgccagcgcttggaccctctacgccgtggctacaaccgttatcacccctatgcttcgccatacaattgaaaattctacggccaacgtgagcctggctgccatcgcgaaccaggccgtcgtgctgatgggactcgacaagggctggccgatttccaaaatggatctgggggtcccccttctggctctcggatgctattctcaggtgaatcctctgaccctgacagccgctgttctccttctgatcacccactacgccatcattggccccgggctgcaggccaaggcgacaagagaggctcaaaagcggaccgccgctggaatcatgaaaaaccctacggtggacggcattatgacaatcgatctcgaccccgtcatttatgatagcaagttcgagaaacagctgggccaggtgatgcttctggttctctgtgccgtgcagctgctgctcatgagaacctcctgggccctttgcgaagctctgaccctggccacagggcctatcaccacactctgggagggatctccgggcaagttttggaatacgaccatcgcggtcagcatggccaacattttccgcgggtcctacctggctggagccggccttgcttttagcatcatgaaatctgtggggacaggaaagcggggcaccggctcccaaggggaaacactgggagagaagtggaaaaagaaactcaatcagctgagcagaaaggagttcgacctgtataaaaagtccggcattaccgaggtggatcgcacggaggccaaagaagggctcaagcggggagagatcacccatcacgcggtttctagaggcagcgccaaacttcagtggtttgtcgaacggaacatggtgattcccgaggggcgcgtgatcgacctgggatgtggcagaggcgggtggtcctactattgcgctggactgaaaaaggtcacagaagttcggggctacaccaaagggggacctggccatgaggagcccgtgcctatgtctacatacgggtggaatattgtgaagctcatgagcggaaaagatgtcttctatctgcccccggaaaagtgtgacacccttctgtgcgatatcggcgagtccagcccttctcccacagtggaagagtcccgcaccatcagagttctcaagatggtggagccctggctgaaaaacaatcagttctgtattaaggtcctgaacccttacatgcccacggtgatcgaacacctcgagcggcttcaacgcaaacacggcgggatgctggttagaaatcctctgagccggaactctacacatgaaatgtattggatttccaatggaaccggcaacatcgtggccagcgtcaatatggtgtctcgcctcctgcttaacagatttaccatgacacaccggagaccgacgattgagaaggacgtggatctgggggctggaacccgccatgtcaacgccgaacccgagacacctaatatggacgttatcggcgagcggatcaaaagaattaaggaagaacacaacagcacctggcactacgacgatgaaaatccctataagacatgggcttaccatgggtcctatgaggtgaaagccaccggatctgcgagctccatgatcaacggcgtggtcaagctcctgacaaaaccttgggacgtggttcccatggtgacccagatggccatgacggataccacaccgttcggccagcaacgcgtctttaaggaaaaagtggacacccggacacctagaagcatgcccgggacccgccgggttatgggaattacggctgagtggctgtggagaacactcggccgcaataagaagcctcggctgtgcaccagagaggagttcaccaagaaggtgcgcaccaacgccgctatgggggccgtctttacggaggaaaatcagtgggattccgccaaagcggctgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagccatctggtacatgtggcttggggctcggtatctggagttcgaggccctcggatttctgaatgaggatcattggttctcccgcgaaaactcttacagcggcgtcgagggggaaggactgcacaaactcggctatattctgagagacatctccaagatccccgggggcgctatgtacgccgatgacaccgcgggatgggacacacggattaccgaggatgaccttcataatgaagagaaaatcacacagcagatggatcctgagcacagacaactggccaacgctatttttaagctcacctatcagaataaggtggtcaaagtgcagcggcccacaccgaccggcacggttatggacatcatttctcgcaaggatcagagagggagcggacaagtgggcacatacgggctgaacaccttcaccaatatggaagcccagcttatccggcagatggagggagaaggcgtcctgtccaaagctgacctcgagaaccctcatctgcccgaaaagaaaatcacacagtggctggagaccaagggggtggagcgcctcaagagaatggccattagcggcgatgactgcgtggttaaacccatcgatgaccggtttgcgaacgccctgcttgctctgaatgatatgggaaaggtgcgcaaagacattcctcaatggcagccgtctaagggctggcatgattggcagcaggtccccttctgttcccaccatttccacgaactcatcatgaaagacgggagaaagctggtggttccttgccggccccaagacgagcttattggacgcgccagaatcagccagggcgctgggtggtctctgcgggaaacagcctgtctcggaaaggcttatgcccagatgtggtccctgatgtactttcaccgcagagatctgcggctcgcgagcaacgccatttgctctgctgtgcctgtccattgggtgcccacgtcccgcaccacatggagcatccacgcccatcaccaatggatgaccacagaggacatgctgaccgtctggaatagagtgtggatcgaagataacccttggatggaggacaaaacgcccgttaccacatgggagaatgtgccgtaccttggcaagcgggaagatcagtggtgtgggtccctgattggcctcaccagcagagccacatgggctcagaacatccctaccgccattcagcaagtccgctctctgatcggaaatgaggagttccttgactatatgcccagcatgaaacggtttagaaaggaggaggaatccgagggcgcgatttggtga

SEQ ID NO: 20665 - RNA, 9873 nt, synthetic construct
  misc_feature 1..9873: note = derived and/or modified CDS sequence (opt5) from DENV-3__EU482563__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgtgctcccggaggaacaggaccagaattatgtctgtaaacacacatacgtggatcggggctgggggaacggatgcggcctgttcgggaagggaagccttgttacctgcgctaagtttcaatgtctggagcccatcgagggcaaagtggtccagtatgaaaatctcaagtacaccgtgattatcacagttcataccggggaccagcaccaggtgggaaacgagacacaaggcgtcacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggttgtgctcgggtctcaggagggagctatgcacacagccctgaccggcgccacagaaattcagaattccgggggcaccagcatcttcgctggacatctgaagtgtcgcctcaaaatggacaagctggagcttaaaggcatgtcttacgccatgtgcaccaacacatttgtcctgaagaaagaggtgtccgaaacgcagcacgggaccattctcatcaaggttgagtacaagggagaagatgcgccctgtaaaatccctttcagcacagaggacggccaagggaaggctcataacggaagactgattaccgccaatcccgtggtcacaaaaaaggaggaacccgtgaacatcgaggccgaacctccgttcggcgagtccaatattgtgatcgggattggcgataacgctctgaaaatcaattggtataagaagggatctagcatcggcaaaatgtttgaagccaccgctcggggggccagacgcatggcgattcttggagacacggcctgggatttcggctccgttgggggagtcctcaacagcctgggcaagatggtgcaccagatctttgggtctgcttacacagccctgttctccggcgtgagctgggtcatgaaaattggaatcggcgtgctcctgacctggattgggcttaattctaagaacaccagcatgtccttttcttgcatcgctattggaatcatcacactgtatctcggcgccgttgtgcaggcggacaccgggtgtgtcattaattggaaaggaaaggagctgaagtgcggcagcgggatcttcgtgacaaacgaggttcatacgtggaccgaacagtacaaatttcaagccgattcccccaagcggctggctacagccattgctggcgcctgggagaatggagtgtgtggcatcagaagcaccacacgcatggaaaaccttctctggaaacaggtcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtgtgggaagtcgaggactatggctttggcgttttcacaaccaatatttggctcaaactgcgcgaagtgtacacgcagctgtgtgaccaccggcttatgagcgccgccgtgaaggatgagagagctgtccacgccgacatggggtactggatcgagtcccagaaaaacggatcttggaagctcgaaaaagcgagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatctctgaaaaggaggagaatatggttaaatccctggtgagcgccggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcgcacacactgatcatgattggatccaatgctagcgacagaatgggcatgggggtgacctacctggcccttatcgccacgtttaaaattcagcccttcctggctctcggatttttcctgcggaagctcacatctagagaaaacctgcttctgggcgtggggctcgccatggctaccacactgcaactgcctgaggatatcgaacagatggccaatggaatcgcgcttggcctgatggccctcaaactgattacccagtttgagacctatcagctctggacagctctgatctcccttacgtgtagcaacaccattttcacactgaccgtcgcctggcgcacagctaccctcatcctggccggcgtttccctgcttccggtgtgccaatctagctccatgcggaagtctgactggctgcccatgacggtggccgctatgggggtccctcccctccctctgtttattttcagcctcaaggatacactgaaaagacgctcctggccccttaatgagggagtgatggcggttggcctggtgtctatcctggccagctccctcctgagaaacgacgtccctatggctgggccccttgtggccggaggcctgctcatcgcctgttacgttattaccgggaccagcgctgatctgacagtggaaaaggccgcggacgtcacctgggaggaagaggctgaacagacaggagtgtctcataacctcatgatcacggtcgacgatgacggcaccatgcggattaaagatgacgagacagagaatatcctgaccgtgcttctgaagacagccctgctcattgtttccggcatctttccgtacagcatccctgccaccctgcttgtgtggcacacgtggcagaaacagacccgcagatctggggtcctgtgggatgtgccctcccctcccgaaacacaaaaggctgagctcgaagagggagtttatcggattaaacagcagggcatcttcgggaagacccaggtgggagtcggcgtgcaaaaggagggggtgtttcatacaatgtggcacgttacccgcggagccgtcctgacatacaacggcaaaagactcgaaccgaattgggcgagcgtgaagaaagacctgatttcttatggcgggggatggcggctttccgctcagtggcagaagggcgaggaagtgcaagtcatcgccgtggagcctgggaaaaaccccaagaatttccagacgatgcctggaaccttccagacaaccaccggcgaaattggggccatcgctctggattttaagcccggaacaagcggctcccccattatcaaccgcgagggcaaagttgtggggctgtacggaaatggcgtcgtgacgaagaacgggggatatgttagcggcatcgcccagaccaatgctgagcctgacgggccgacacccgaactcgaggaagagatgttcaaaaagagaaacctgaccattatggatcttcaccctggctctggaaaaacacggaagtacctgcccgccatcgtgcgcgaagcgattaagagacggctcagaaccctgatcctcgcccctacgcgcgtcgtggctgccgagatggaggaagctctgaaaggccttcccattcggtatcaaacaaccgccaccaagagcgagcatacagggagagaaatcgttgacctgatgtgccacgccacctttacaatgcgcctgctctcccctgtgcgggtcccgaattacaacctgatcattatggatgaggctcatttcaccgaccccgcgtctatcgccgctagaggatacattagcacgcgcgtgggcatgggggaagccgccgctatctttatgacagccacccctcccggaacagcggatgctttccctcagtccaatgcccccattcaggacgaggagcgggacatcccggaaagatcttggaacagcggcaatgagtggatcaccgattttgccgggaaaacggtgtggttcgtcccttccattaaggctggcaacgacatcgccaactgtcttcgcaaaaatggaaagaaggttattcagctgtctcggaaaacctttgatacagaatatcaaaagaccaaactcaacgactgggatttcgtggtgacaaccgacatcagcgagatgggcgcgaattttaaggccgatagagtcattgacccccggcgctgcctgaaacccgtgatcctgacagatgggcctgagagagttattctcgctggacccatgcctgtgaccgccgcttccgccgctcagcggcgcggcagagtcgggcggaacccgcagaaggaaaatgaccagtacatcttcacgggacaaccccttaacaatgatgaggaccacgcccattggacagaagcgaagatgctgctggacaacatcaatacccctgagggcattatccccgccctcttcgaacctgagagagagaaaagcgctgccattgatggggaatatcgcctgaagggcgagtctcggaaaacctttgtggaacttatgagacgcggagacctgcccgtttggctcgctcacaaggtggcctccgagggcatcaaatacacagatcggaagtggtgcttcgacgggcagagaaacaatcagattctggaagagaacatggatgtcgagatctggaccaaagaaggagagaagaagaaactgcgcccgcggtggctcgacgccagaacatatagcgatcctcttgctctgaaggaatttaaagacttcgcggccggccgcaagtctatcgctctggatctcgtgacggagattgggagagtcccctcccacctggcccatcggacccgcaatgcccttgacaacctggtgatgctccacacaagcgaacatggaggcaaagcttacagacacgccgttgaggagctgcctgaaaccatggagacactgctccttctgggcctgatgatcctcctgaccgggggagcgatgctttttctgatttccggcaaggggatcggaaagacgtctattggcctcatctgtgtgatcgccagctccgggatgctgtggatggctgaaattcccctgcagtggatcgccagcgctattgtgctcgagttctttatgatggtccttctgatccctgagcccgaaaaacaacggaccccgcaggataatcagctggcctatgttgtgattggaatcctcacactggcggccattatcgctgccaacgagatgggccttctggaaaccacaaagcgcgacctcggcatgtctaaagagcctggggtggtctcccccaccagctacctggatgtggacctgcaccccgcttctgcctggacgctctacgctgttgccacaaccgtgatcacacctatgcttagacataccattgaaaatagcaccgcgaacgtctccctggccgctatcgccaaccaagctgtggtcctgatgggactcgacaagggctggccgatttctaaaatggatctgggggtgccccttctggccctcggatgctatagccaggttaatcctctgacactgacggccgcggtgctccttctgatcacccactacgctattatcggccccgggctgcaggccaaggctacacgggaggcccagaagagaaccgccgctggaatcatgaaaaaccctacagtcgacggcattatgaccatcgatctcgaccccgtgatttatgattccaagttcgagaaacaactgggccaggttatgcttctggtgctctgtgccgtccagctgctgctcatgcgcacgtcttgggcgctttgcgaagccctgacactggctaccgggcctatcaccacactctgggagggaagcccgggcaagttttggaataccacaattgccgtgtccatggctaacatcttccgggggagctacctggccggagcgggccttgccttttctatcatgaaatccgtggggacgggaaagagaggcaccggcagccagggggaaacactgggagagaagtggaaaaagaaactcaatcaactgtcccgcaaggaattcgacctgtataaaaagtctggcattaccgaggttgatcggacagaggctaaagaagggctcaagagaggagagatcacccatcacgccgtcagccggggctccgctaagcttcagtggtttgtggaacgcaacatggtgattcccgaggggagagtcatcgacctgggatgtggccggggcgggtggtcttactattgcgccggactgaaaaaggttacggaagtgcgcggctacaccaaagggggacctggccatgaggagcccgtgcctatgagcacatacgggtggaatattgtcaagctcatgtccggaaaagatgtgttctatctgcccccggaaaagtgtgacacccttctgtgcgatatcggcgagagctctccttcccccacagttgaagagagcagaaccattcgggtgctcaagatggtcgagccctggctgaaaaacaatcagttctgtatcaaggtgctgaacccttacatgcccacagttatcgaacacctcgagcgccttcagagaaaacacggcgggatgctggtgcggaatcctctgtctcgcaactccacccatgaaatgtattggattagcaatggaacgggcaacatcgtcgcttctgtgaatatggtgagcagactcctgcttaaccggtttacaatgacccacagacgcccgaccattgagaaggacgtcgatctgggggccggaacacggcatgttaacgcggaacccgagacgcctaatatggacgtgatcggcgagagaattaaacgcatcaaggaagagcacaactccacctggcactacgacgatgaaaatccctataagacatgggcctaccatgggtcttatgaggtgaaagctaccggaagcgcctccagcatgatcaacggcgtcgtgaagctcctgacaaaaccttgggacgttgtgcccatggtcacccaaatggctatgacagataccacgccgttcggccagcagcgggtgtttaaggaaaaagttgacaccagaacacctcgctccatgcccgggacccggagagtgatgggaattacagccgagtggctgtggcgcaccctcggccggaataagaagcctagactgtgcacgcgcgaggaattcacaaaaaaggtccggaccaacgccgcgatgggggctgtgtttacagaggaaaatcaatgggattctgccaaagccgctgttgaggacgaagatttctggaagcttgtggacagagagcgcgagctgcacaaactcggaaagtgtggcagctgcgtctacaacatgatggggaaaagagaaaagaagctgggcgagtttggaaaagccaagggctcccgggctatctggtacatgtggcttggggcccgctatctggaattcgaggcgctcggatttctgaatgaggatcattggttctctagagaaaacagctactccggcgtggagggggaaggactgcacaaactcggctatattctgcgggacatctctaagattcccgggggcgccatgtacgctgatgacaccgccggatgggacacgagaatcaccgaggatgaccttcataatgaagagaaaatcacacagcagatggatcctgagcaccggcagctggctaacgccatttttaagctcacctatcaaaataaggtcgtgaaagttcagcgccccacaccgaccggcacagtgatggacatcattagcagaaaggatcagcgggggtccggacaggtcggcacctacgggctgaacacgttcacaaatatggaagcgcaacttatccgccagatggagggagaaggcgtgctgaccaaagccgacctcgagaaccctcacctgagcgaaaagaaaattacccagtggctggagacaaagggggtggagagactcaagcggatggctatctctggcgatgactgcgttgtgaaacccatcgatgaccgctttgccaacgctctgcttgccctgaatgatatgggaaaggtcagaaaagacattccccagtggcaaccttccaagggctggcatgattggcagcaggtgccgttctgtagccaccatttccacgaactcatcatgaaagacgggcggaagctggttgtgccctgccgccctcaggacgagcttattggaagagctcggatctctcaaggcgccgggtggtccctgcgcgaaaccgcgtgtctcggaaaggcctatgctcagatgtggagcctgatgtactttcacagacgggatctgcgcctcgcctctaacgccatttgctccgctgtccccgtgcattgggtccctacaagcagaacgacctggtccatccacgcccatcaccagtggatgacaaccgaggacatgctgacagtgtggaatcgggtttggattgaagataacccctggatggaggacaaaacccctgtgacgacctgggagaatgtcccctaccttggcaagagagaagatcaatggtgtgggagcctgatcggcctcacatctcgcgcgacctgggctcagaacatcccgacagccattcagcaggtgcggagcctgatcggaaatgaggaattccttgactatatgccttccatgaaaagatttcgcaaggaggaggaatctgagggcgccatttggtga

SEQ ID NO: 20666 - RNA, 9873 nt, synthetic construct
  misc_feature 1..9873: note = derived and/or modified CDS sequence (opt5) from DENV-3__EU529696__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggagtgatcaccctgtatctcggcgctgttgtgcaggccgacatggggtgtgtcattaattggaaaggaaaggagctgaagtgcggcagcgggatcttcgtgacaaacgaggttcatacgtggaccgaacagtacaaatttcaagcggattcccccaagcggctggccacagctattgccggcgcttgggagaatggagtgtgtggcatcagaagcaccacacgcatggaaaaccttctctggaaacagattgccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggccaagattgtcaccgctgaaatccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggacctcgattttaattattgcgagggaaccacggttgtgatcacagagaactgtggcacccggggcccctctctgagaacaaccacagtctccgggaaactgatccacgaatggtgctgtcgcagctgcacccttccgcctctccggtacatgggagaggacggctgttggtatgggatggaaattagacccatctctgagaaggaagagaatatggtgaaatccctggttagcgccggatctggcaaggtggataacttcacgatgggggtcctgtgcctcgccattctgtttgaggaagtgatgcggggaaagttcggcaaaaagcatatgatcgctggcgttttctttaccttcgtgcttctgctcagcgggcagattacatggcgcgacatggcccacaccctgatcatgattggatccaatgcgagcgataaaatgggcatgggggtcacatacctggctcttatcgccacctttaagatccagcccttcctggccctcggatttttcctgagaaaactcacgtctcgggagaacctgcttctgggcgtggggctcgctatggccacaaccctgcaactgcctgaagacattgagcagatggctaatggaatcgcccttggcctgatggcgctcaagctgattacacagtttgaaacctatcagctctggaccgccctgatctcccttacatgtagcaacacgatgttcaccctgacagtggcttggagaaccgccacactcattctggctggcgtctccctgcttccggtttgccaatctagctccatgcgcaagaccgattggctgcccatggccgtggccgctatgggggtgcctcccctccctctgtttatcttctctctcaaagacacgctgaagcggagaagctggccccttaatgagggagtcatggcggtgggcctggtttccatcctggcctctagcctcctgcgcaacgatgtgcctatggctgggccccttgtcgccggaggcctgctcattgcctgttacgtgatcacagggacctccgctgacctgaccgttgagaaagccgcggacattacatgggaagaggaagctgagcagaccggagtgagccataacctcatgatcacagtcgatgacgatggcacgatgagaattaaggacgatgaaaccgagaatatcctgacagtgcttctgaaaaccgccctgctcatcgtctctggcgtgtttccgtactccattcctgccacactgcttgtttggcacacctggcagaagcagacgcaacggagcggggtgctgtgggacgtcccctctcctcccgagacccagaaagctgaactcgaggaaggagtgtatcgcatcaagcagcagggcattttcgggaagacacaagttggagtgggcgtccagaaagagggggtgtttcataccatgtggcacgtgacaagaggagccgttctgacctacaacggcaagcggctcgagccgaattgggcgtccgtcaaaaaggatctgatcagctatggcgggggatggcgcctttctgctcagtggcaaaaaggcgaagaggtgcaggtgattgccgtcgaacctgggaagaaccccaagaatttccagacaatgcctggaacgttccagaccacaaccggcgagatcggggccattgctctggactttaaacccggaacctccggcagccccatcatcaacagagaaggcaaggtggttgggctgtacggaaatggcgtggtcacaaaaaacgggggatatgtgtccggcattgcccaaacgaatgctgagcctgatgggccgacccccgagctcgaagaggaaatgttcaagaaacggaacctgacaatcatggaccttcaccctggcagcggaaagacccgcaagtacctgcccgccgttgtgagagaggcgattaaacggcgcctcagaacactgatcctcgcccctacccgggtcgtggctgccgaaatggaggaggctctgaagggccttcccattagatatcagacgacagccaccaaatctgaacataccgggcgcgagatcgttgatctgatgtgccacgccacatttaccatgcggctgctcagccctgtgagagtcccgaattacaacctgatcattatggacgaagctcatttcacagatcccgcgtccatcgccgctcgcggatacatttctacccgggtgggcatgggggaggccgccgctatctttatgacggccacacctcccggaaccgcggacgctttccctcagagcaatgcccccattcaggacgaagagagagatatcccggagcgctcctggaactctggcaatgaatggatcacagactttgccgggaagaccgtgtggttcgtccctagcattaaagctggcaacgatatcgccaactgtcttcggaagaatggaaagaaagttattcaactgtccagaaagacgtttgacaccgagtatcagaaaacaaagctcaacgattgggacttcgtggtgaccacagatatctctgaaatgggcgcgaattttaaagccgaccgcgtcattgatccccggagatgcctgaagcccgtgatcctgaccgacgggcctgagcgggttattctcgctggacccatgcctgtgacagccgctagcgccgctcagcgcagaggccgggtcgggcgcaacccgcagaaggagaatgatcaatacatcttcaccggacagccccttaacaatgacgaagaccacgcccattggacggaggcgaaaatgctgctggataacatcaatacacctgaaggcattatccccgccctcttcgagcctgaaagagagaagtccgctgccattgacggggagtatcggctgaaaggcgaaagcagaaagacctttgtggagcttatgcgccggggagatctgcccgtttggctcgctcacaaagtggcctctgaaggcatcaagtacaccgacagaaaatggtgcttcgatgggcagcgcaacaatcagattctggaggaaaacatggacgtcgagatctggacaaaggagggagaaaagaaaaagctgcggccgagatggctcgatgcccgcacctattccgaccctcttgctctgaaagagtttaaggatttcgcggccggccggaaaagcatcgctctggacctcgtgacagaaattgggagagtcccctctcacctggcccatcgcacgagaaatgcccttgataacctggtgatgctccacacctccgagcatggaggccgggcttaccgccacgccgttgaagagctgcctgagacaatggaaaccctgctccttctgggcctgatgatcctcctgacagggggagcgatgctttttctgattagcggcaaggggatcggaaagacctccattggcctcatctgtgtgatcgcctctagcgggatgctgtggatggctgagattcccctgcaatggatcgcctccgctattgtgctcgaattctttatgatggtccttctgatccctgagcccgagaaacagagaacgccgcaggacaatcaactggcctatgttgtgattggaatcctcaccctggcggccattatcgctgccaacgaaatgggccttctggagacaaccaagcgggatctcggcatgagcaaagaacctggggtggtctctcccacatcctacctggacgtggacctgcaccccgctagcgcctggaccctctacgctgttgccacgacagtgatcacccctatgcttcgccatacaattgagaattctaccgcgaacgtcagcctggccgctatcgccaaccaggctgtggtcctgatgggactcgataagggctggccgatttccaaaatggacctgggggtgccccttctggccctcggatgctattctcaggttaatcctctgaccctgacagccgcggtgctccttctgatcacgcactacgctattatcggccccgggctgcaggccaaggctaccagagaagcccaaaagcggacagccgctggaatcatgaaaaaccctaccgtcgatggcattatgacaatcgacctcgatcccgtgatttatgacagcaagttcgagaaacagctgggccaggttatgcttctggtgctctgtgccgtccagctgctgctcatgagaacctcctgggcgctttgcgaggccctgacgctggctacagggcctatcaccaccctctgggaaggatctccgggcaagttttggaatacaaccattgccgtgagcatggctaacatcttccgcgggtcctacctggccggagcgggccttgcctttagcatcatgaaatctgtggggacaggaaagcggggcacgggctcccaaggggagaccctgggagaaaagtggaaaaagaaactcaatcagctgagcagaaaggagttcgatctgtataaaaagtccggcattacagaagttgaccgcaccgaggctaaagaggggctcaagcggggagaaacaacccatcacgccgtctctagaggcacggctaagcttcagtggtttgtggagcggaacatggtgatccccgaagggcgcgtcattgatctgggatgtggcagaggcgggtggagctactattgcgccggactgaaaaaggttaccgaggtgcggggctacacaaaagggggacctggccatgaagagcccgtgcctatgtccacctacgggtggaatatcgtcaagctcatgtctggaaaagacgtgttctatctgcccccggagaagtgtgatacacttctgtgcgacattggcgaaagctcccctagccccaccgttgaggaatctcgcacaatcagagtgctcaagatggtcgagccctggctgaaaaacaatcagttctgtattaaggtgctgaacccttacatgcccaccgttatcgagcacctcgaacggcttcaacgcaaacacggcgggatgctggtgagaaatcctctgtcccggaacagcacgcatgagatgtattggatctctaatggaacaggcaacattgtcgcttccgtgaatatggtgagccgcctcctgcttaacagatttaccatgacccaccggagaccgacaatcgaaaaggatgtcgacctgggggccggaacgcgccatgttaacgcggagcccgaaacccctaatatggacgtgattggcgagcggatcaaaagaattaaggaggaacacaactctacatggcactacgatgacgagaatccctataagacctgggcctaccatgggagctatgaagtgaaagctacaggatccgcctctagcatgatcaacggcgtcgtgaagctcctgaccaaaccttgggatgttgtgcccatggtcacacagatggctatgaccgacacgaccccgttcggccagcaacgcgtgtttaaggagaaagttgatacacggacccctagatccatgcccgggacacgccgggtgatgggaatcaccgccgaatggctgtggagaacgctcggccgcaataagaagcctcggctgtgcacaagagaggagttcaccaaaaaggtccgcacaaacgccgcgatgggggctgtgtttaccgaagagaatcagtgggacagcgccaaagccgctgttgaagatgaggacttctggaagcttgtggatcgggaaagagagctgcacaaactcggaaagtgtggctcctgcgtctacaacatgatggggaaacgcgagaagaagctgggcgaatttggaaaagccaagggctctagagctatttggtacatgtggcttggggcccggtatctggagttcgaagcgctcggatttctgaatgaggaccattggttcagccgcgagaactcctactctggcgtggaaggggagggactgcacaaactcggctatatcctgagagatattagcaagatccccgggggcgccatgtacgctgacgacacggccggatgggatacccggattacagaagacgatcttcataatgaggaaaaaatcacccagcagatggaccctgagcacagacaactggctaacgccatctttaagctcacatatcagaataaggtcgtgaaagttcagcggcccaccccgacaggcaccgtgatggatattatctcccgcaaggaccagagagggtctggacaagtcggcacgtacgggctgaacacattcaccaatatggaggcgcagcttattcggcagatggaaggagagggcgtgctgagcaaagccgatctcgaaaaccctcacctgcccgagaagaaaatcacccagtggctggaaacaaagggggtggagcgcctcagacggatggctatttccggcgacgattgcgttgtgaagcccatcgacgatcgctttgccaacgctctgcttgccctgaatgacatgggaaaagtcagaaaggatatccctcaatggcagccgagcaaaggctggcatgactggcagcaggtgcccttctgttctcaccatttccacgagctcattatgaaggacgggcggaaactggttgtgccttgccgcccccaagatgaacttatcggaagagctcggatttcccagggcgccgggtggagcctgcgcgagaccgcgtgtctcggaaaggcctatgctcagatgtggtctctgatgtactttcacagacgggacctgcgcctcgcctccaacgccatctgcagcgctgtccctgtgcattgggtccccacatctagaacgacctggtccattcacgcccatcaccaatggatgacaaccgaagatatgctgacagtgtggaatcgggtttggatcgaggacaacccttggatggaagataagacccccgtgacgacctgggagaatgtcccgtaccttggcaaaagagaggaccagtggtgtgggagcctgattggcctcacatcccgcgcgacctgggctcagaacatccctacagccatccagcaagtgcggagcctgattggaaatgaagagttccttgattatatgccctctatgaagagatttcgcaaagaagaggagagcgaaggcgccatctggtga

SEQ ID NO: 20667 - RNA, 9873 nt, synthetic construct
  misc_feature 1..9873: note = derived and/or modified CDS sequence (opt5) from DENV-3__EU529697__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgctctcccggaggaacaggaccagaattatgtgtgtaaacacacatacgtcgatcggggctgggggaacggatgcggcctgttcgggaagggaagccttgtgacctgcgccaagtttcaatgtctggagcccatcgagggcaaagttgtgcagtatgaaaatctcaagtacaccgtcattatcacagtgcataccggggaccagcaccaggttggaaacgagacacaaggcgtgacggctgaaatcacccctcaggcctctacaaccgaggccattctgcccgaatatggcacactggggctcgagtgctcccctcgcaccggactggacttcaatgagatgatccttctgacgatgaaaaacaaggcttggatggtccatagacagtggtttttcgatctccccctgccgtggaccagcggcgcgacaaccgaaacacctacctggaatcggaaagagcttctggtgacgtttaagaacgcccacgctaaaaagcaagaagtcgtggttctcgggtctcaggagggagccatgcacacagccctgaccggcgctacagaaattcagaattccgggggcaccagcatcttcgccggacatctgaagtgtcgcctcaaaatggacaagctggagcttaaaggcatgtcttacgcgatgtgcaccaacacatttgtgctgaagaaagaggtctccgaaacgcagcacgggaccattctcatcaaggtggagtacaagggagaagatgctccctgtaaaatccctttcagcacagaggacggccaagggaaggcccataacggaagactgattaccgccaatcccgttgtgacaaaaaaggaggaacccgtcaacatcgaggctgaacctccgttcggcgagtccaatattgtgatcgggattggcgataacgccctgaaaatcaattggtataagaagggatctagcatcggcaaaatgtttgaagctaccgcccggggggcgagacgcatggccattcttggagacacggcttgggatttcggctccgtggggggagttctcaacagcctgggcaagatggtccaccagatctttgggtctgcctacacagctctgttctccggcgtgagctgggtgatgaaaattggaatcggcgtcctcctgacctggattgggcttaattctaagaacaccagcatgtccttttcttgcatcgccattggaatcatcacactgtatctcggcgcggtggttcaggccgacaccgggtgtgtgattaattggaaaggaaaggagctgaagtgcggcagcgggatcttcgtcacaaacgaggtgcatacgtggaccgaacagtacaaatttcaagctgattcccccaagcggctggccacagctattgccggcgcctgggagaatggagtttgtggcatcagaagcaccacacgcatggaaaaccttctctggaaacaggtggctaatgagctgaactatattctgtgggaaaataacatcaagctcaccgtcgtggttggggacatcattggagtgctggagcagggcaaacggacgcttacccctcagcccatggagctgaagtactcttggaaaacatgggggaaggcgaagatcgtcaccgccgaaacacaaaactccagcttcattatcgatggacctaatacccccgagtgcccgtctgcttccagagcctggaacgtgtgggaagtggaggactatggctttggcgtcttcacaaccaatatttggctcaaactgcgcgaagtttacacgcagctgtgtgaccaccggcttatgagcgccgctgtgaaggatgagagagccgtgcacgcggacatggggtactggatcgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgccggcccttggcaccttgggaagctggagctcgactttaattattgcgagggaacgacagttgtgatcaccgaaaactgtggcacacggggcccctctctgagaaccacaaccgtctccgggaaactgattcacgagtggtgctgtcgcagctgcacgcttccgcctctccggtacatgggagaagatggctgttggtatgggatggagatcagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgcgggcgttttctttacattcgtgcttctgctcagcgggcagattacctggcgcgatatggctcacacactgatcatgattggatccaatgccagcgacagaatgggcatgggggtcacccatctggcccttatcgctacgtttaaaattcagcccttcctggccctcggatttttcctgcggaagctcacatctagagaaaacctgcttctgggcgtggggctcgctatggccaccacactgcaactgcctgaggatatcgaacagatggcgaatggaatcgcccttggcctgatggctctcaaactgattacccagtttgagacctaccagctctggacagccctgatctcccttacgtgtagcaacaccattttcacactgaccgtggcttggcgcacagccaccctcatcctggccggcgtctccctgcttccggtttgccaatctagctccatgcggaagtctgactggctgcccatgacggtggctgcgatgggggtgcctcccctccctctgtttattttcagcctcaaggatacactgaaaagacgctcctggccccttaatgagggagtcatggccgtgggcctggtttctatcctggctagctccctcctgagaaacgacgtgcctatggccgggccccttgtcgccggaggcctgctcatcgcttgttatgtgattaccgggaccagcgccgatctgacagttgaaaaggcggctgacgtgacctgggaggaagaggccgaacagacaggagtctctcacaacctcatgatcacggtggacgatgacggcaccatgcggattaaagatgacgagacagagaatatcctgaccgtccttctgaagacagccctgctcattgtgtccggcatctttccgtacagcatccctgctaccctgcttgtttggcatacgtggcagaaacagacccgcagatctggggtgctgtgggatgtcccctcccctcccgaaacacaaaaggccgagctcgaagagggagtgtaccggattaaacagcagggcatcttcgggaagacccaggttggagtgggcgtccaaaaggagggggtgtttcacacaatgtggcacgtgacccgcggagcggttctgacatataacggcaaaagactcgaaccgaattgggctagcgtcaagaaagacctgatttcttacggcgggggatggcggctttccgcccagtggcagaagggcgaggaagtgcaagtgatcgccgtcgagcctgggaaaaaccccaagaatttccagacgatgcctggaaccttccagacaaccaccggcgaaattggggctatcgccctggattttaagcccggaacaagcggctcccccattatcaaccgcgagggcaaagtggttgggctgtatggaaatggcgtggtcacgaagaacgggggatacgtgagcggcatcgctcagaccaatgccgagcctgacgggccgacacccgaactcgaggaagagatgttcaaaaagagaaacctgaccattatggatcttcatcctggctctggaaaaacacggaagtatctgcccgcgatcgttcgcgaagccattaagagacggctcagaaccctgatcctcgctcctacgcgcgtggtcgccgctgagatggaggaagccctgaaaggccttcccattcggtaccaaacaaccgccaccaagagcgagcacacagggagagaaatcgtggacctgatgtgccatgctacctttacaatgcgcctgctctcccctgttcgggtgccgaattataacctgatcattatggatgaggcgcacttcaccgaccccgcctctatcgctgccagaggatacattagcacgcgcgtcggcatgggggaagccgctgccatctttatgacagcgacccctcccggaacagctgatgccttccctcagtccaatgcccccattcaggacgaggagcgggacatcccggaaagatcttggaacagcggcaatgagtggatcaccgattttgctgggaaaacggtgtggttcgtgccttccattaaggccggcaacgacatcgcgaactgtcttcgcaaaaatggaaagaaggtcattcagctgtctcggaaaacctttgatacagaataccaaaagaccaaactcaacgactgggatttcgttgtgacaaccgacatcagcgagatgggcgccaattttaaggctgatagagtgattgacccccggcgctgcctgaaacccgtcatcctgacagatgggcctgagagagtgattctcgccggacccatgcctgttaccgctgcctccgctgcccagcggcgcggcagagtggggcggaacccgcagaaggaaaatgaccagtatatcttcacgggacaaccccttaacaatgatgaggaccatgcgcactggacagaagccaagatgctgctggacaacatcaatacccctgagggcattatccccgctctcttcgaacctgagagagagaaaagcgccgctattgatggggaataccgcctgaagggcgagtctcggaaaacctttgtcgaacttatgagacgcggagacctgcccgtgtggctcgcccacaaggttgcctccgagggcatcaaatatacagatcggaagtggtgcttcgacgggcagagaaacaatcagattctggaagagaacatggatgtggagatctggaccaaagaaggagagaagaagaaactgcgcccgcggtggctcgacgctagaacatacagcgatcctcttgcgctgaaggaatttaaagacttcgccgctggccgcaagtctatcgccctggatctcgtcacggagattgggagagtgccctcccatctggcccaccggacccgcaatgctcttgacaacctggtcatgctccatacaagcgaacacggaggcaaagcctatagacacgcggtggaggagctgcctgaaaccatggagacactgctccttctgggcctgatgatcctcctgaccgggggagccatgctttttctgatttccggcaaggggatcggaaagacgtctattggcctcatctgtgttatcgctagctccgggatgctgtggatggccgaaattcccctgcagtggatcgctagcgccattgtgctcgagttctttatgatggtgcttctgatccctgagcccgaaaaacaacggaccccgcaggataatcagctggcgtacgtcgttattggaatcctcacactggccgctattatcgccgctaacgagatgggccttctggaaaccacaaagcgcgacctcggcatgtctaaagagcctggggtggtgtcccccaccagctatctggatgtcgacctgcatcccgcctctgcttggacgctctacgccgtggcgacaaccgttatcacacctatgcttagacacaccattgaaaatagcaccgccaacgtgtccctggctgccatcgctaaccaagccgtcgtgctgatgggactcaataagggctggccgatttctaaaatggacctgggggtcccccttctggccctcggatgctacagccaggtgaaccctctgacactgacggcggctgttctccttctgatcacccattatgccattatcggccccgggctgcaggctaaggccacacgggaggcccagaagagaaccgctgccggaatcatgaaaaatcctacagtggatggcattatgaccatcgacctcgatcccgtcatttacgactccaagttcgagaaacaactgggccaggtgatgcttctggttctctgtgcggtgcagctgctgctcatgcgcacgtcttgggccctttgcgaagctctgacactggccaccgggcctatcaccacactctgggagggaagcccgggcaagttttggaacaccacaattgctgtctccatggccaatatcttccgggggagctatctggcgggagccggccttgctttttctatcatgaaatccgtggggacgggaaagagaggcaccggcagccagggggaaacactgggagagaagtggaaaaagaaactcaaccaactgtcccgcaaggaattcgatctgtacaaaaagtctggcattaccgaggtggaccggacagaggccaaagaagggctcaagagaggagagatcacccaccatgctgttagccggggctccgccaagcttcagtggtttgtcgaacgcaatatggtgattcccgaggggagagtgatcgatctgggatgtggccggggcgggtggtcttattactgcgctggactgaaaaaggtcacggaagttcgcggctataccaaagggggacctggccacgaggagcccgtgcctatgagcacatacgggtggaacattgtgaagctcatgtccggaaaagacgtcttctacctgcccccggaaaagtgtgatacccttctgtgcgacatcggcgagagctctccttcccccacagtggaagagagcagaaccattcgggttctcaagatggtggagccctggctgaaaaataaccagttctgtatcaaggtcctgaatccttatatgcccacagtgatcgaacacctcgagcgccttcagagaaaacatggcgggatgctggttcggaaccctctgtctcgcaattccacccacgaaatgtactggattagcaacggaacgggcaatatcgtggcctctgtcaacatggtgagcagactcctgcttaaccggtttacaatgacccatagacgcccgaccattgagaaggatgtggacctgggggcgggaacacggcacgtcaatgccgaacccgagacgcctaacatggatgttatcggcgagagaattaaacgcatcaaggaagagcacaattccacctggcattatgacgacgaaaacccctacaagacatgggcttatcacgggtcttacgaggtgaaagccaccggaagcgcttccagcatgatcaatggcgtggtcaagctcctgacaaaaccttgggatgtggttcccatggtgacccaaatggccatgacagacaccacgccgttcggccagcagcgggtctttaaggaaaaagtggataccagaacacctcgctccatgcccgggacccggagagttatgggaattacagccgagtggctgtggcgcaccctcggccggaacaagaagcctagactgtgcacgcgcgaggaattcacaaaaaaggtgcggaccaatgcggctatgggggccgtctttacagaggaaaaccaatgggactctgccaaagctgccgtggaggatgaagacttctggaagcttgttgatagagagcgcgagctgcataaactcggaaagtgtggcagctgcgtgtataatatgatggggaaaagagaaaagaagctgggcgagtttggaaaagctaagggctcccgggccatctggtacatgtggcttggggcgcgctacctggaattcgaggccctcggatttctgaacgaggaccactggttctctagagaaaatagctattccggcgtcgagggggaaggactgcataaactcggctacattctgcgggatatctctaagattcccgggggcgctatgtatgccgacgataccgctggatgggacacgagaatcaccgaggacgatcttcacaacgaagagaaaatcacacagcagatggaccctgagcaccggcagctggccaatgcgatttttaagctcacctaccaaaacaaggtggtcaaagtgcagcgccccacaccgaccggcacagttatggatatcattagcagaaaggaccagcgggggtccggacaggtgggcacctatgggctgaatacgttcacaaacatggaagcccaacttatccgccagatggagggagaaggcgtcctgaccaaagctgatctcgagaaccctcatctgagcgaaaagaaaattacccagtggctggagacaaagggggtggagagactcaagcggatggccatctctggcgacgattgcgtggttaaacccatcgacgatcgctttgctaatgccctgcttgctctgaacgacatgggaaaggtgagaaaagatattccccagtggcaaccttccaagggctggcacgactggcagcaggtcccgttctgtagccatcacttccacgaactcatcatgaaagatgggcggaagctggtggttccctgccgccctcaggacgagcttattggaagagcccggatctctcaaggcgcggggtggtccctgcgcgaaaccgcctgtctcggaaaggcttacgcccagatgtggagcctgatgtattttcatagacgggacctgcgcctcgcctctaatgctatttgctccgccgtgcccgtccactgggtgcctacaagcagaacgacctggtccatccatgcgcaccatcagtggatgacaaccgaggatatgctgacagtctggaaccgggtgtggattgaagacaatccctggatggaggataaaacccctgttacgacctgggagaacgtgccctaccttggcaagagagaagaccaatggtgtgggagcctgatcggcctcacatctcgcgctacctgggcccagaatatcccgacagccattcagcaggtccggagcctgatcggaaacgaggaattccttgattacatgccttccatgaaaagatttcgcaaggaggaggaatctgagggcgctatttggtga

SEQ ID NO: 20668 - RNA, 9873 nt, synthetic construct
  misc_feature 1..9873: note = derived and/or modified CDS sequence (opt5) from DENV-3__EU482564__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggagtgatcaccctgtatctcggcgctgttgtgcaggccgacatggggtgtgtcattaattggaaaggaaaggagctgaagtgcggcagcgggatcttcgtgacaaacgaggttcatacgtggaccgaacagtacaaatttcaagcggattcccccaagcggctggccacagctattgccggcgcttgggagaatggagtgtgtggcatcagaagcaccacacgcatggaaaaccttctctggaaacagattgccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggccaagattgtcaccgctgaaatccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggacctcgattttaattattgcgagggaaccacggttgtgatcacagagaactgtggcacccggagaccctctctgcgcacaaccacagtctccggcaaactgatccacgaatggtgctgtcggagctgcacccttccgcctctcagatacatgggggaggacggatgttggtatggcatggaaattcggcccatctctgagaaggaagagaatatggtgaaatccctggttagcgccgggtctggaaaggtggataacttcacgatgggcgtcctgtgcctcgccattctgtttgaggaagtgatgcgcgggaagttcggaaaaaagcatatgatcgctggcgttttctttaccttcgtgcttctgctcagcggccagattacatggagagacatggcccacaccctgatcatgattgggtccaatgcgagcgataaaatgggaatgggcgtcacatacctggctcttatcgccacctttaagatccagcccttcctggccctcgggtttttcctgcggaaactcacgtctagagagaacctgcttctgggagtgggcctcgctatggccacaaccctgcaactgcctgaagacattgagcagatggctaatgggatcgcccttggactgatggcgctcaagctgattacacagtttgaaacctatcagctctggaccgccctgatctcccttacatgtagcaacacgatgttcaccctgacagtggcttggcgcaccgccacactcattctggctggcgtctccctgcttccggtttgccaatctagctccatgcggaagaccgattggctgcccatggccgtggccgctatgggcgtgcctcccctccctctgtttatcttctctctcaaagacacgctgaagagacgcagctggccccttaatgagggggtcatggcggtgggactggtttccatcctggcctctagcctcctgagaaacgatgtgcctatggctggcccccttgtcgccgggggactgctcattgcctgttacgtgatcacaggcacctccgctgacctgaccgttgagaaagccgcggacattacatgggaagaggaagctgagcagaccggggtgagccataacctcatgatcacagtcgatgacgatggaacgatgcggattaaggacgatgaaaccgagaatatcctgacagtgcttctgaaaaccgccctgctcatcgtctctggcgtgtttccgtactccattcctgccacactgcttgtttggcacacctggcagaagcagacgcaacgcagcggcgtgctgtgggacgtcccctctcctcccgagacccagaaagctgaactcgaggaaggggtgtatagaatcaagcagcagggaattttcggcaagacacaagttggggtgggagtccagaaagagggcgtgtttcataccatgtggcacgtgacacggggggccgttctgacctacaacggaaagcgcctcgagccgaattgggcgtccgtcaaaaaggatctgatcagctatggcggcgggtggagactttctgctcagtggcaaaaaggagaagaggtgcaggtgattgccgtcgaacctggcaagaaccccaagaatttccagacaatgcctgggacgttccagaccacaaccggagagatcggcgccattgctctggactttaaacccgggacctccggaagccccatcatcaaccgggaaggcaaggtggttggcctgtacgggaatggagtggtcacaaaaaacggcgggtatgtgtccggaattgcccaaacgaatgctgagcctgatggcccgacccccgagctcgaagaggaaatgttcaagaaacgcaacctgacaatcatggaccttcaccctgggagcggcaagaccagaaagtacctgcccgccgttgtgcgggaggcgattaaacgcagactccggacactgatcctcgcccctaccagagtcgtggctgccgaaatggaggaggctctgaagggacttcccattcgctatcagacgacagccaccaaatctgaacataccggccgggagatcgttgatctgatgtgccacgccacatttaccatgagactgctcagccctgtgcgcgtcccgaattacaacctgatcattatggacgaagctcatttcacagatcccgcgtccatcgccgctcgggggtacatttctaccagagtgggaatgggcgaggccgccgctatctttatgacggccacacctcccgggaccgcggacgctttccctcagagcaatgcccccattcaggacgaagagcgcgatatcccggagcggtcctggaactctggaaatgaatggatcacagactttgccggcaagaccgtgtggttcgtccctagcattaaagctgggaacgatatcgccaactgtcttagaaagaatggcaagaaagttattcaactgtcccgcaagacgtttgacaccgagtatcagaaaacaaagctcaacgattgggacttcgtggtgaccacagatatctctgaaatgggagcgaattttaaagccgaccgggtcattgatcccagacggtgcctgaagcccgtgatcctgaccgacggccctgagcgcgttattctcgctgggcccatgcctgtgacagccgctagcgccgctcagagacggggacgcgtcggcagaaacccgcagaaggagaatgatcaatacatcttcaccgggcagccccttaacaatgacgaagaccacgcccattggacggaggcgaaaatgctgctggataacatcaatacacctgaaggaattatccccgccctcttcgagcctgaacgggagaagtccgctgccattgacggcgagtatagactgaaaggggaaagccgcaagacctttgtggagcttatgcggagaggcgatctgcccgtttggctcgctcacaaagtggcctctgaaggaatcaagtacaccgaccgcaaatggtgcttcgatggccagcggaacaatcagattctggaggaaaacatggacgtcgagatctggacaaaggagggggaaaagaaaaagctgagaccgcgctggctcgatgcccggacctattccgaccctcttgctctgaaagagtttaaggatttcgcggccggaagaaaaagcatcgctctggacctcgtgacagaaattggccgcgtcccctctcacctggcccatagaacgcggaatgcccttgataacctggtgatgctccacacctccgagcatgggggacgcgcttacagacacgccgttgaagagctgcctgagacaatggaaaccctgctccttctgggcctgatgatcctcctgacaggcggggcgatgctttttctgattagcggaaagggcatcgggaagacctccattggactcatctgtgtgatcgcctctagcggcatgctgtggatggctgagattcccctgcaatggatcgcctccgctattgtgctcgaattctttatgatggtccttctgatccctgagcccgagaaacagcggacgccgcaggacaatcaactggcctatgttgtgattgggatcctcaccctggcggccattatcgctgccaacgaaatgggacttctggagacaaccaagcgcgatctcggcatgagcaaagaacctggcgtggtctctcccacatcctacctggacgtggacctgcaccccgctagcgcctggaccctctacgctgttgccacgacagtgatcacccctatgcttagacatacaattgagaattctaccgcgaacgtcagcctggccgctatcgccaaccaggctgtggtcctgatggggctcgataagggatggccgatttccaaaatggacctgggcgtgccccttctggccctcgggtgctattctcaggttaatcctctgaccctgacagccgcggtgctccttctgatcacgcactacgctattatcggacccggcctgcaggccaaggctacccgggaagcccaaaagagaacagccgctgggatcatgaaaaaccctaccgtcgatggaattatgacaatcgacctcgatcccgtgatttatgacagcaagttcgagaaacagctgggccaggttatgcttctggtgctctgtgccgtccagctgctgctcatgcgcacctcctgggcgctttgcgaggccctgacgctggctacaggccctatcaccaccctctgggaagggtctccgggaaagttttggaatacaaccattgccgtgagcatggctaacatcttccggggctcctacctggccggggcgggacttgcctttagcatcatgaaatctgtgggcacagggaagagaggaacgggctcccaaggcgagaccctgggggaaaagtggaaaaagaaactcaatcagctgagccgcaaggagttcgatctgtataaaaagtccggaattacagaagttgaccggaccgaggctaaagagggcctcaagagaggggaaacaacccatcacgccgtctctcggggaacggctaagcttcagtggtttgtggagcgcaacatggtgatccccgaaggcagagtcattgatctggggtgtggacggggcggctggagctactattgcgccgggctgaaaaaggttaccgaggtgcgcggatacacaaaaggcgggcctggacatgaagagcccgtgcctatgtccacctacggctggaatatcgtcaagctcatgtctgggaaagacgtgttctatctgcccccggagaagtgtgatacacttctgtgcgacattggagaaagctcccctagccccaccgttgaggaatctagaacaatccgggtgctcaagatggtcgagccctggctgaaaaacaatcagttctgtattaaggtgctgaacccttacatgcccaccgttatcgagcacctcgaacgccttcaaagaaaacacggcggcatgctggtgcggaatcctctgtcccgcaacagcacgcatgagatgtattggatctctaatgggacaggaaacattgtcgcttccgtgaatatggtgagcagactcctgcttaaccggtttaccatgacccacagacgcccgacaatcgaaaaggatgtcgacctgggcgccgggacgcggcatgttaacgcggagcccgaaacccctaatatggacgtgattggagagagaatcaaacgcattaaggaggaacacaactctacatggcactacgatgacgagaatccctataagacctgggcctaccatggcagctatgaagtgaaagctacagggtccgcctctagcatgatcaacggagtcgtgaagctcctgaccaaaccttgggatgttgtgcccatggtcacacagatggctatgaccgacacgaccccgttcggccagcaacgggtgtttaaggagaaagttgatacaagaacccctcgctccatgcccggcacacggagagtgatggggatcaccgccgaatggctgtggcgcacgctcggacggaataagaagcctagactgtgcacacgcgaggagttcaccaaaaaggtccggacaaacgccgcgatgggcgctgtgtttaccgaagagaatcagtgggacagcgccaaagccgctgttgaagatgaggacttctggaagcttgtggatagagaacgcgagctgcacaaactcgggaagtgtggatcctgcgtctacaacatgatgggcaaaagagagaagaagctgggggaatttggcaaagccaagggatctcgggctatttggtacatgtggcttggcgcccgctatctggagttcgaagcgctcgggtttctgaatgaggaccattggttcagcagagagaactcctactctggagtggaaggcgaggggctgcacaaactcggatatatcctgcgggatattagcaagatccccggcggggccatgtacgctgacgacacggccggctgggataccagaattacagaagacgatcttcataatgaggaaaaaatcacccagcagatggaccctgagcaccggcaactggctaacgccatctttaagctcacatatcagaataaggtcgtgaaagttcagcgccccaccccgacaggaaccgtgatggatattatctccagaaaggaccagcggggctctgggcaagtcggaacgtacggcctgaacacattcaccaatatggaggcgcagcttattcgccagatggaaggggagggagtgctgagcaaagccgatctcgaaaaccctcacctgcccgagaagaaaatcacccagtggctggaaacaaagggcgtggagagactccggcgcatggctatttccggggacgattgcgttgtgaagcccatcgacgatagatttgccaacgctctgcttgccctgaatgacatgggcaaagtccggaaggatatccctcaatggcagccgagcaaaggatggcatgactggcagcaggtgcccttctgttctcaccatttccacgagctcattatgaaggacggccgcaaactggttgtgccttgcagaccccaagatgaacttatcgggcgggctcgcatttcccagggagccggctggagcctgagagagaccgcgtgtctcgggaaggcctatgctcagatgtggtctctgatgtactttcaccggcgcgacctgagactcgcctccaacgccatctgcagcgctgtccctgtgcattgggtccccacatctcggacgacctggtccattcacgcccatcaccaatggatgacaaccgaagatatgctgacagtgtggaatagagtttggatcgaggacaacccttggatggaagataagacccccgtgacgacctgggagaatgtcccgtaccttggaaaacgcgaggaccagtggtgtggcagcctgattgggctcacatcccgggcgacctgggctcagaacatccctacagccatccagcaagtgagaagcctgattggcaatgaagagttccttgattatatgccctctatgaagcgctttcggaaagaagaggagagcgaaggagccatctggtga

SEQ ID NO: 20669 - RNA, 9873 nt, synthetic construct
  misc_feature 1..9873: note = derived and/or modified CDS sequence (opt5) from DENV-3__EU529699__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccgtgtctgaaaaggaggagaatatggttaaatccctggtgagcgctggatctggcaaggtcgacaacttcacaatgggggtgctgtgcctcgccattctgtttgaagaggttatgcggggaaagttcggcaaaaagcatatgatcgccggcgtgttctttaccttcgtccttctgctcagcgggcagattacatggcgcgatatggctcacaccctgatcatgattggatccaatgccagcgacagaatgggcatgggggtgacgtacctggcgcttatcgctacatttaaaattcagcccttcctggccctcggatttttcctgcggaagctcacctctagagaaaacctgcttctgggcgtggggctcgccatggctacaaccctgcaactgcctgaggatatcgaacagatggccaatggaatcgctcttggcctgatggccctcaaactgattacccagtttgagacatatcagctctggacggcgctgatctcccttacctgtagcaacacaattttcaccctgacagtcgcctggcgcaccgctacgctcatcctggccggcgtttccctgcttccggtgtgccaatctagctccatgcggaagacagactggctgcccatgaccgtggctgccatgggggtccctcccctccctctgtttattttctctctcaaggataccctgaaaagacgcagctggccccttaatgagggagtgatggccgttggcctggtgtccatcctggcttctagcctcctgagaaacgacgtccctatggcggggccccttgtggccggaggcctgctcatcgcttgttacgttattacagggacctccgccgatctgacagtggaaaaggccgctgacgtcacgtgggaggaagaggccgaacagaccggagtgagccataacctcatgatcacagtcgacgatgacggcaccatgcggattaaagatgacgagacagagaatatcctgaccgtgcttctgaagacggcgctgctcattgtttctggcatctttccgtactccatccctgctaccctgcttgtgtggcacacatggcagaaacagacccaacgcagcggggtcctgtgggatgtgccctctcctcccgaaacacagaaggccgagctcgaagagggagtttatagaattaaacagcagggcatcttcgggaagacccaagtgggagtcggcgtgcagaaggagggggtgtttcatacaatgtggcacgttacgcggggagccgtcctgacctacaacggcaaacgcctcgaaccgaattgggcttccgtgaagaaagacctgattagctatggcgggggatggagactttctgcccagtggcaaaagggcgaggaagtgcaggtcatcgcggtggagcctgggaaaaaccccaagaatttccagacaatgcctggaaccttccagaccacaacgggcgaaattggggctatcgccctggattttaagcccggaacctccggcagccccattatcaaccgggagggcaaagttgtggggctgtacggaaatggcgtcgtgacaaagaacgggggatatgtttccggcatcgcccaaaccaatgctgagcctgacgggccgacacccgaactcgaggaagagatgttcaaaaagcgcaacctgaccattatggatcttcaccctggcagcggaaaaacgagaaagtacctgcccgccatcgtgcgggaagctattaagcgcagactccggacactgatcctcgcccctaccagagtcgtggcggccgagatggaggaagctctgaaaggccttcccattcgctatcagaccacagccaccaagtctgagcatacagggcgggaaatcgttgacctgatgtgccacgctacctttacgatgagactgctcagccctgtgcgcgtcccgaattacaacctgatcattatggatgaggcccatttcacagaccccgcctccatcgctgcgcggggatacatttctaccagagtgggcatgggggaagccgctgccatctttatgacagccacccctcccggaacggctgatgccttccctcagagcaatgcgcccattcaggacgaggagcgcgacatcccggaacggtcctggaactctggcaatgagtggatcaccgattttgctgggaaaacagtgtggttcgtccctagcattaaggccggcaacgacatcgccaactgtcttcgcaaaaatggaaagaaggttattcaactgtccagaaaaacctttgatacagaatatcagaagaccaaactcaacgactgggatttcgtggtgacaaccgacatctctgagatgggcgctaattttaaggccgatcgggtcattgaccccagacggtgcctgaaacccgtgatcctgacggatgggcctgagcgcgttattctcgcgggacccatgcctgtgacagccgctagcgccgctcagagacggggccgcgtcgggagaaacccgcagaaggaaaatgaccaatacatcttcaccggacagccccttaacaatgatgaggaccacgcccattggaccgaagctaagatgctgctggacaacatcaatacacctgagggcattatccccgccctcttcgaacctgagcgggagaaatccgcggccattgatggggaatatagactgaagggcgagagccgcaaaacctttgtggaacttatgcggagaggagacctgcccgtttggctcgctcacaaggtggcctctgagggcatcaaatacacagatcgcaagtggtgcttcgacgggcagcggaacaatcagattctggaagagaacatggatgtcgagatctggacgaaagaaggagagaagaagaaactgagaccgcgctggctcgacgctcggacctattccgatcctcttgccctgaaggaatttaaagacttcgccgctggcagaaagagcatcgcgctggatctcgtgacagagattgggcgcgtcccctctcacctggcccatagaacccggaatgctcttgacaacctggtgatgctccacacatccgaacatggaggcaaagcctaccgccacgccgttgaggagctgcctgaaaccatggagacgctgctccttctgggcctgatgatcctcctgaccgggggagctatgctttttctgattagcggcaaggggatcggaaagacatccattggcctcatctgtgtgatcgcctctagcgggatgctgtggatggcggaaattcccctgcaatggatcgcctccgctattgtgctcgagttctttatgatggtccttctgatccctgagcccgaaaaacagagaaccccgcaggataatcaactggcctatgttgtgattggaatcctcacactggctgccattatcgcggccaacgagatgggccttctggaaaccacgaagcgggacctcggcatgagcaaagagcctggggtggtctctcccacatcctacctggatgtggacctgcaccccgctagcgcctggaccctctacgctgttgccacaaccgtgatcacccctatgcttcgccatacaattgaaaattctacggctaacgtcagcctggccgcgatcgccaaccaggctgtggtcctgatgggactcgacaagggctggccgatttccaaaatggatctgggggtgccccttctggccctcggatgctattctcaggttaatcctctgaccctgacagctgccgtgctccttctgatcacccactacgccattatcggccccgggctgcaggcgaaggctacaagagaggcccaaaagcggaccgctgccggaatcatgaaaaaccctacggtcgacggcattatgacaatcgatctcgaccccgtgatttatgatagcaagttcgagaaacagctgggccaggttatgcttctggtgctctgtgccgtccagctgctgctcatgagaacctcctgggctctttgcgaagccctgaccctggcgacagggcctatcaccacactctgggagggatctccgggcaagttttggaatacgaccattgccgtgagcatggctaacatcttccgcgggtcctacctggccggagctggccttgcctttagcatcatgaaatctgtggggacaggaaagcggggcaccggctcccaaggggaaacactgggagagaagtggaaaaagaaactcaatcagctgagcagaaaggagttcgacctgtataaaaagtccggcattaccgaggttgatcgcacggaggcgaaagaagggctcaagcggggagagatcacccatcacgccgtctctagaggcagcgctaaacttcagtggtttgtggaacggaacatggtgattcccgaggggcgcgtcatcgacctgggatgtggcagaggcgggtggtcctactattgcgccggactgaaaaaggttacagaagtgcggggctacaccaaagggggacctggccatgaggagcccgtgcctatgtctacatacgggtggaatattgtcaagctcatgagcggaaaagatgtgttctatctgcccccggaaaagtgtgacacccttctgtgcgatatcggcgagtccagcccttctcccacagttgaagagtcccgcaccattagagtgctcaagatggtcgagccctggctgaaaaacaatcagttctgtatcaaggtgctgaacccttacatgcccacggttatcgaacacctcgagcggcttcaacgcaaacacggcgggatgctggtgagaaatcctctgagccggaactctacacatgaaatgtattggatttccaatggaaccggcaacatcgtcgctagcgtgaatatggtgtctcgcctcctgcttaacagatttaccatgacacaccggagaccgacgattgagaaggacgtcgatctgggggccggaacccgccatgttaacgctgaacccgagacacctaatatggacgtgatcggcgagcggattaaaagaatcaaggaagaacacaacagcacctggcactacgacgatgaaaatccctataagacatgggcctaccatgggtcctatgaggtgaaagcgaccggatctgccagctccatgatcaacggcgtcgtgaagctcctgacaaaaccttgggacgttgtgcccatggtcacccagatggctatgacggataccacaccgttcggccagcaacgcgtgtttaaggaaaaagttgacacccggacacctagaagcatgcccgggacccgccgggtgatgggaattacggccgagtggctgtggagaacactcggccgcaataagaagcctcggctgtgcaccagagaggagttcaccaagaaggtccgcaccaacgctgccatgggggccgtgtttacggaggaaaatcagtgggattccgcgaaagctgccgttgaggacgaagatttctggaaacttgtggaccgggagagagagctgcacaaactcggaaagtgtggctcttgcgtctacaacatgatggggaaacgcgaaaagaagctgggcgagtttggaaaagccaagggcagcagagctatctggtacatgtggcttggggcccggtatctggagttcgaggctctcggatttctgaatgaggatcattggttctcccgcgaaaactcttacagcggcgtggagggggaaggactgcacaaactcggctatattctgagagacatctccaagattcccgggggcgccatgtacgcggatgacaccgccggatgggacacacggatcaccgaggatgaccttcataatgaagagaaaatcacacagcagatggatcctgagcacagacaactggctaacgccatttttaagctcacctatcagaataaggtcgtgaaagttcagcggcccacaccgaccggcacggtgatggacatcatttctcgcaaggatcagagagggagcggacaagtcggcacatacgggctgaacaccttcaccaatatggaagctcagcttatccggcagatggagggagaaggcgtgctgtccaaagccgacctcgagaaccctcatctgcccgaaaagaaaattacacagtggctggagaccaagggggtggagcgcctcaagagaatggcgatcagcggcgatgactgcgttgtgaaacccatcgatgaccggtttgccaacgctctgcttgccctgaatgatatgggaaaggtccgcaaagacattcctcaatggcagccgtctaagggctggcatgattggcaacaggtgcccttctgttcccaccatttccacgaactcatcatgaaagacgggagaaagctggttgtgccttgccggccccaagacgagcttattggacgcgctagaatcagccagggcgccgggtggtctctgcgggaaacagcttgtctcggaaaggcctatgcgcagatgtggtccctgatgtactttcaccgcagagatctgcggctcgccagcaacgctatttgctctgccgtccctgtgcattgggtccccacgtcccgcaccacatggagcatccacgcccatcaccaatggatgaccacagaggacatgctgaccgtgtggaatagagtttggattgaagataacccttggatggaggacaaaacgcccgtgaccacatgggagaatgtcccgtaccttggcaagcgggaagatcagtggtgtgggtccctgatcggcctcaccagcagagctacatgggcccagaacatccctaccgcgattcagcaagtgcgctctctgatcggaaatgaggagttccttgactatatgcccagcatgaaacggtttagaaaggaggaggaatccgagggcgctatttggtga

SEQ ID NO: 20670 - RNA, 9873 nt, synthetic construct
  misc_feature 1..9873: note = derived and/or modified CDS sequence (opt5) from DENV-3__EU482566__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctcggggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcaccaaaggcccctctctgcggacaaccacggtctccgggaagctgatccacgagtggtgctgtagaagctgcacccttccgcctctccgctacatgggagaagatggctgttggtatgggatggagatccggcccatttctgaaaaagaggagaatatggtgaagtccctggttagcgctggatctggcaaggtggacaacttcacaatgggggtcctgtgcctcgccatcctgtttgaagaggtgatgagaggaaaattcggcaagaaacatatgattgccggcgttttctttaccttcgtgcttctgctcagcgggcagatcacatggcgggatatggctcacaccctgattatgatcggatccaatgccagcgaccgcatgggcatgggggtcacgtacctggcgcttattgctacatttaagatccagcccttcctggccctcggatttttcctgagaaaactcacctctcgggaaaacctgcttctgggcgtggggctcgccatggctacaaccctgcaactgcctgaggatatcgaacagatggccaatggaattgctcttggcctgatggccctcaagctgatcacccagtttgagacatatcagctctggacggcgctgatttcccttacctgtagcaacacaatcttcaccctgacagtggcctggagaaccgctacgctcattctggccggcgtctccctgcttccggtttgccaatctagctccatgcgcaagacagactggctgcccatgaccgtggctgccatgggggtgcctcccctccctctgtttatcttctctctcaaagataccctgaagcggagaagctggccccttaatgagggagtcatggccgtgggcctggtttccatcctggcttctagcctcctgcgcaacgacgtgcctatggcggggccccttgtcgccggaggcctgctcattgcttgttacgtgatcacagggacctccgccgatctgacagttgaaaaagccgctgacgtgacgtgggaggaagaggccgaacagaccggagtcagccataacctcatgattacagtggacgatgacggcaccatgagaatcaaggatgacgagacagagaatattctgaccgtccttctgaaaacggcgctgctcatcgtgtctggcatctttccgtactccattcctgctaccctgcttgtttggcacacatggcagaagcagacccaacggagcggggtgctgtgggatgtcccctctcctcccgaaacacagaaagccgagctcgaagagggagtgtatcgcatcaagcagcagggcattttcgggaagacccaagttggagtgggcgtccagaaagagggggtgtttcatacaatgtggcacgtgacgagaggagccgttctgacctacaacggcaagcggctcgaaccgaattgggcttccgtcaaaaaggacctgatcagctatggcgggggatggcgcctttctgcccagtggcaaaaaggcgaggaagtgcaggtgattgcggtcgagcctgggaagaaccccaagaatttccagacaatgcctggaaccttccagaccacaacgggcgaaatcggggctattgccctggattttaaacccggaacctccggcagccccatcatcaacagagagggcaaggtggttgggctgtacggaaatggcgtggtcacaaaaaacgggggatatgtgtccggcattgcccaaaccaatgctgagcctgacgggccgacacccgaactcgaggaagagatgttcaagaaacggaacctgaccatcatggatcttcaccctggcagcggaaagacgcgcaagtacctgcccgccattgttagagaagctatcaaacggcgcctcagaacactgattctcgcccctacccgggtggtcgcggccgagatggaggaagctctgaagggccttcccatcagatatcagaccacagccaccaaatctgagcatacagggcgcgaaatcgtggacctgatgtgccacgctacctttacgatgcggctgctcagccctgttagagtgccgaattacaacctgattatcatggatgaggcccatttcacagaccccgcctccattgctgcgcgcggatacatctctacccgggtcggcatgggggaagccgctgccatttttatgacagccacccctcccggaacggctgatgccttccctcagagcaatgcgcccatccaggacgaggagagagacatcccggaacgctcctggaactctggcaatgagtggattaccgattttgctgggaagacagtgtggttcgtgcctagcatcaaagccggcaacgacattgccaactgtcttcggaagaatggaaagaaagtcatccaactgtccagaaagacctttgatacagaatatcagaaaaccaagctcaacgactgggatttcgttgtgacaaccgacatttctgagatgggcgctaattttaaagccgatcgcgtgatcgacccccggagatgcctgaagcccgtcattctgacggatgggcctgagcgggtgatcctcgcgggacccatgcctgttacagccgctagcgccgctcagcgcagaggccgggtggggcgcaacccgcagaaggaaaatgaccaatacatcttcaccggacagccccttaacaatgatgaggaccacgcccattggaccgaagctaaaatgctgctggacaacattaatacacctgagggcatcattcccgccctcttcgaacctgagagagagaagtccgcggccatcgatggggaatatcggctgaaaggcgagagcagaaagacctttgtcgaacttatgcgccggggagacctgcccgtgtggctcgctcacaaagttgcctctgagggcattaagtacacagatagaaaatggtgcttcgacgggcagcgcaacaatcagatcctggaagagaacatggatgtggagatctggacgaaggaaggagagaagaaaaagctgcggccgagatggctcgacgctcgcacctattccgatcctcttgccctgaaagaatttaaggacttcgccgctggccggaaaagcattgcgctggatctcgtcacagagatcgggagagtgccctctcacctggcccatcgcaccagaaatgctcttgacaacctggtcatgctccacacatccgaacatggaggcaaggcctaccggcacgccgtggaggagctgcctgaaaccatggagacgctgctccttctgggcctgatgattctcctgaccgggggagctatgctttttctgatcagcggcaaggggattggaaaaacatccatcggcctcatctgtgttattgcctctagcgggatgctgtggatggcggaaatccccctgcaatggattgcctccgctatcgtgctcgagttctttatgatggtgcttctgattcctgagcccgaaaagcagcgcaccccgcaggataatcaactggcctatgtcgttatcggaattctcacactggctgccatcatcgcggccaacgagatgggccttctggaaaccacgaaaagagacctcggcatgagcaaggagcctggggtggtgtctcccacatcctacctggatgtcgacctgcaccccgctagcgcctggaccctctacgctgtggccacaaccgttattacccctatgcttcggcatacaatcgaaaattctacggctaacgtgagcctggccgcgattgccaaccaggctgtcgtgctgatgggactcgacaaaggctggccgatctccaagatggatctgggggtcccccttctggccctcggatgctattctcaggtgaatcctctgaccctgacagctgccgttctccttctgattacccactacgccatcatcggccccgggctgcaggcgaaggctacacgcgaggcccaaaaaagaaccgctgccggaattatgaagaaccctacggtggacggcatcatgacaattgatctcgaccccgtcatctatgatagcaaattcgagaagcagctgggccaggtgatgcttctggttctctgtgccgtgcagctgctgctcatgcggacctcctgggctctttgcgaagccctgaccctggcgacagggcctattaccacactctgggagggatctccgggcaaattttggaatacgaccatcgccgtcagcatggctaacatcttcagagggtcctacctggccggagctggccttgcctttagcattatgaagtctgtggggacaggaaagcgcggcaccggctcccaaggggaaacactgggagagaaatggaagaaaaagctcaatcagctgagccggaaagaattcgacctgtataagaaatccggcatcaccgaggtggatagaacggaggcgaaggaagggctcaagcgcggagagattacccatcacgccgtttctcggggcagcgctaaacttcagtggtttgtcgaaagaaacatggtgatccccgaggggcgggtgattgacctgggatgtggccgcggcgggtggtcctactattgcgccggactgaagaaagtcacagaagttagaggctacaccaaggggggacctggccatgaggagcccgtgcctatgtctacatacgggtggaatatcgtgaaactcatgagcggaaaggatgtcttctatctgcccccggaaaagtgtgacacccttctgtgcgatattggcgagtccagcccttctcccacagtggaagagtcccggaccatccgcgttctcaaaatggtggagccctggctgaagaacaatcagttctgtatcaaagtcctgaacccttacatgcccacggtgattgaacacctcgagagacttcaacggaagcacggcgggatgctggttcgcaatcctctgagcagaaactctacacatgaaatgtattggatctccaatggaaccggcaacattgtggctagcgtcaatatggtgtctcggctcctgcttaaccgctttaccatgacacacagacggccgacgatcgagaaagacgtggatctgggggccggaaccagacatgtcaacgctgaacccgagacacctaatatggacgttattggcgagcgcatcaagcggatcaaggaagagcacaacagcacctggcactacgacgatgaaaatccctataaaacatgggcctaccatgggtcctatgaggtgaaggcgaccggatctgccagctccatgattaacggcgtggtcaaactcctgacaaagccttgggacgtggttcccatggtgacccagatggctatgacggataccacaccgttcggccagcaaagagtctttaaagaaaaggtggacacccgcacacctcggagcatgcccgggaccagacgcgttatgggaatcacggccgagtggctgtggcggacactcggcagaaataagaaacctcgcctgtgcacccgggaggaattcacaaagaaagtgagaaccaacgctgccatgggggccgtctttacggaggaaaatcagtgggattccgcgaaggctgccgtggaggacgaagatttctggaaacttgttgaccgcgagcgggagctgcacaagctcggaaaatgtggctcttgcgtgtacaacatgatggggaagagagaaaagaaactgggcgagtttggaaaggccaaaggcagccgcgctatttggtacatgtggcttggggccagatatctggaattcgaggctctcggatttctgaatgaggatcattggttctcccgggaaaactcttacagcggcgtcgagggggaaggactgcacaagctcggctatatcctgcgcgacatttccaaaatccccgggggcgccatgtacgcggatgacaccgccggatgggacacaagaatcaccgaggatgaccttcataatgaagagaagattacacagcagatggatcctgagcaccggcaactggctaacgccatctttaagctcacctatcagaataaagtggtcaaggtgcagagacccacaccgaccggcacggttatggacattatctctcggaaagatcagcgcgggagcggacaagtgggcacatacgggctgaacaccttcaccaatatggaagctcagcttattagacagatggagggagaaggcgtcctgtccaaggccgacctcgagaaccctcacctgcccgaaaaaaagatcacacagtggctggagaccaagggggtggagcggctcaaacgcatggcgatcagcggcgatgactgcgtggttaagcccattgatgacagatttgccaacgctctgcttgccctgaatgatatgggaaaagtgcggaaggacatccctcaatggcagccgtctaaaggctggcatgattggcagcaggtccccttctgttcccaccatttccacgaactcattatgaaggacgggcgcaagctggtggttccttgcagaccccaagacgagcttatcggacgggctcgcattagccagggcgccgggtggtctctgagagaaacagcttgtctcggaaaagcctatgcgcagatgtggtccctgatgtactttcaccggcgcgatctgagactcgccagcaacgctatctgctctgccgtgcctgtccattgggtgcccacgtcccggaccacatggagcattcacgcccatcaccaatggatgaccacagaggacatgctgaccgtctggaatcgcgtgtggatcgaagataacccttggatggaggacaagacgcccgttaccacatgggagaatgtgccgtaccttggcaaaagagaagatcagtggtgtgggtccctgatcggcctcaccagccgggctacatgggcccagaacattcctaccgcgatccagcaagtcagatctctgattggaaatgaggaattccttgactatatgcccagcatgaagcgctttcggaaagaggaggaatccgagggcgctatctggtga

SEQ ID NO: 20671 - RNA, 9873 nt, synthetic construct
  misc_feature 1..9873: note = derived and/or modified CDS sequence (opt5) from DENV-3__EU529702__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacgtggggacgtccctcacacagaaggtcgtgatcttcattctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacaactggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaagtccctttcagcaccgaggacggccaagggaaggcccataacggaagactgatcacagcgaatcccgtggtgaccaaaaaggaggaacccgttaacattgaggctgaacctccgttcggcgagtccaatatcgtcattgggatcggcgataacgccctgaaaattaattggtataagaagggatctagcatcggcaaaatgtttgaagccacggctagaggggccagacgcatggctatccttggagacacagcctgggatttcggctccgtcgggggagtgctcaacagcctgggcaagatggtccaccagatttttgggtctgcgtacaccgccctgttctccggcgtgagctgggttatgaaaatcggaattggcgtgctcctgacctggatcgggcttaattctaagaacacaagcatgtccttttcttgcattgtcatcggaattatcaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagctgattcccccaagcggctggccacagcgatcgccggcgcttgggagaatggagtttgtggcattagaagcaccacacgcatggaaaaccttctctggaaacagatcgccaatgagctgaactatattctgtgggaaaataacatcaagctcaccgtggtcgtgggggacatcattggagtgctggagcagggcaaacggacgcttacccctcagcccatggagctgaagtactcttggaaaacatgggggaaggctaagatcgtcaccgccgaaacacaaaactccagcttcattatcgatggacctaatacccccgagtgcccgtctgcctccagagcttggaacgtttgggaagtggaggactatggctttggcgtgttcagcacaaatatttggctcaaactgcgcgaagtctacacccagctgtgtgaccaccggcttatgtccgcggccgtgaaggatgagagagctgttcacgccgacatggggtactggatcgagtctcagaaaaacggaagctggaagctcgaaaaagcctccctgatcgaggtgaagacgtgcacatggcctaagtctcataccctgtggagcaatggcgtcctcgaatccgatatgattatccccaaaagcctggctgggcctatttctcagcacaactatcgccccggataccatacccaaacagccggcccttggcaccttgggaagctggagctcgactttaattattgcgagggaaccacggtggttatcacagaaaactgtggcacccggggcccctccctgagaacaaccacagtgagcgggaaactgattcacgagtggtgctgtcgctcttgcacccttccgcctctccggtacatgggagaagatggctgttggtatgggatggagatcagacccatctccgaaaaggaggagaatatggtcaaaagcctggtgtctgcgggaagcggcaaggttgacaacttcacgatgggggctctgtgcctcgccattctgtttgaagaggtgatgcggggaaagttcggcaaaaagcatatgatcgccggcgtcttctttaccttcgtgcttctgctctccgggcagattacatggcgcgatatggctcacaccctgatcatgattggaagcaatgcctctgacagaatgggcatgggggtgacatacctggcgcttatcgctacctttaaaattcagcccttcctggccctcggatttttcctgcggaagctcacgtccagagaaaacctgcttctgggcgtcgggctcgccatggctacaaccctgcaactgcctgaggatatcgaacagatggccaatggaatcgctcttggcctgatggccctcaaactgattacacagtttgagacctatcagctctggaccgcgctgatcagccttacatgttccaacacgattttcaccctgacagttgcctggcgcaccgctacactcatcctggccggcgtgtctctgcttccggtgtgccaaagctcctctatgcggaagaccgactggctgcccatgacggtcgctgccatgggggtgcctcccctccctctgtttattttcagcctcaaggatacactgaaaagacgctcctggccccttaatgagggagttatggccgtgggcctggtctctatcctggctagctccctcctgagaaacgacgtgcctatggcggggccccttgttgccggaggcctgctcatcgcttgttacgtgattaccgggaccagcgccgatctgacagtcgaaaaggccgctgacgtgacctgggaggaagaggccgaacagacaggagtctctcataacctcatgatcacggtggacgatgacggcaccatgcggattaaagatgacgagacagagaatatcctgaccgttcttctgaagacagcgctgctcattgtgtccggcatctttccgtacagcatccctgctaccctgcttgtctggcacacgtggcagaaacagacccaacgctctggggtgctgtgggatgttccctcccctcccgaaacacagaaggccgagctcgaagagggagtgtatagaattaaacagcagggcatcttcgggaagacccaagtcggagtgggcgtgcagaaggagggggtttttcatacaatgtggcacgtcacccggggagccgtgctgacatacaacggcaaacgcctcgaaccgaattgggctagcgtgaagaaagacctgatttcttatggcgggggatggagactttccgcccagtggcaaaagggcgaggaagtccaggtgatcgcggttgagcctgggaaaaaccccaagaatttccagacgatgcctggaaccttccagacaaccaccggcgaaattggggctatcgccctggattttaagcccggaacaagcggctcccccattatcaaccgggagggcaaagtggtcgggctgtacggaaatggcgtggttacgaagaacgggggatatgtgagcggcatcgcccaaaccaatgctgagcctgacgggccgacacccgaactcgaggaagagatgttcaaaaagcgcaacctgaccattatggatcttcaccctggctctggaaaaacaagaaagtacctgcccgccatcgtccgggaagctattaagcgcagactccggaccctgatcctcgcccctacgagagtggttgcggccgagatggaggaagctctgaaaggccttcccattcgctatcagacaaccgccaccaagagcgagcatacagggcgggaaatcgtggacctgatgtgccacgctacctttacaatgagactgctctcccctgtccgcgtgccgaattacaacctgatcattatggatgaggcccatttcaccgaccccgcctctatcgctgcgcggggatacattagcacgagagtgggcatgggggaagccgctgccatctttatgacagccacccctcccggaacagctgatgccttccctcagtccaatgcgcccattcaggacgaggagcgcgacatcccggaacggtcttggaacagcggcaatgagtggatcaccgattttgctgggaaaacggtctggttcgttccttccattaaggccggcaacgacatcgccaactgtcttcgcaaaaatggaaagaaggtgattcaactgtctagaaaaacctttgatacagaatatcagaagaccaaactcaacgactgggatttcgtggtcacaaccgacatcagcgagatgggcgctaattttaaggccgatcgggtgattgaccccagacggtgcctgaaacccgttatcctgacagatgggcctgagcgcgtgattctcgcgggacccatgcctgtcaccgccgcttccgccgctcagagacggggccgcgtggggagaaacccgcagaaggaaaatgaccaatacatcttcacgggacagccccttaacaatgatgaggaccacgcccattggacagaagctaagatgctgctggacaacatcaatacccctgagggcattatccccgccctcttcgaacctgagcgggagaaaagcgcggccattgatggggaatatagactgaagggcgagtctcgcaaaacctttgttgaacttatgcggagaggagacctgcccgtgtggctcgctcacaaggtcgcctccgagggcatcaaatacacagatcgcaagtggtgcttcgacgggcagcggaacaatcagattctggaagagaacatggatgtggagatctggaccaaagaaggagagaagaagaaactgagaccgcgctggctcgacgctcggacatatagcgatcctcttgccctgaaggaatttaaagacttcgccgctggcagaaagtctatcgcgctggatctcgtcacggagattgggcgcgtgccctcccacctggcccatagaacccggaatgctcttgacaacctggttatgctccacacaagcgaacatggaggcaaagcctaccgccacgccgtggaggagctgcctgaaaccatggagacactgctccttctgggcctgatgatcctcctgaccgggggagctatgctttttctgatttccggcaaggggatcggaaagacgtctattggcctcatctgtgtgatcgccagctccgggatgctgtggatggcggaaattcccctgcaatggatcgccagcgctattgtcctcgagttctttatgatggttcttctgatccctgagcccgaaaaacagagaaccccgcaggataatcaactggcctatgtggtgattggaatcctcacactggctgccattatcgcggccaacgagatgggccttctggaaaccacaaagcgggacctcggcatgtctaaagagcctggggtcgtgtcccccaccagctacctggatgttgacctgcaccccgcttctgcctggacgctctacgctgtggccacaaccgtcatcacacctatgcttcgccataccattgaaaatagcaccgctaacgtgtccctggccgcgatcgccaaccaggctgtcgtgctgatgggactcgacaagggctggccgatttctaaaatggatctgggggttccccttctggccctcggatgctatagccaggtgaatcctctgacactgacggctgccgtcctccttctgatcacccactacgccattatcggccccgggctgcaggcgaaggctacaagagaggcccaaaagcggaccgctgccggaatcatgaaaaaccctacagtggacggcattatgaccatcgatctcgaccccgttatttatgattccaagttcgagaaacagctgggccaggtgatgcttctggtcctctgtgccgtgcagctgctgctcatgagaacgtcttgggctctttgcgaagccctgacactggcgaccgggcctatcaccacactctgggagggaagcccgggcaagttttggaataccacaattgccgtgtccatggctaacatcttccgcgggagctacctggccggagctggccttgccttttctatcatgaaatccgttgggacgggaaagcggggcaccggcagccaaggggaaacactgggagagaagtggaaaaagaaactcaatcagctgtccagaaaggagttcgacctgtataaaaagtctggcattaccgaggtcgatcgcacagaggcgaaagaagggctcaagcggggagagatcacccatcacgccgtgagcagaggctccgctaaacttcagtggtttgtggaacggaacatggtcattcccgaggggcgcgttatcgacctgggatgtggcagaggcgggtggtcttactattgcgccggactgaaaaaggtgacggaagtgcggggctacaccaaagggggacctggccatgaggagcccgtccctatgagcacatacgggtggaatattgtgaagctcatgtccggaaaagatgttttctatctgcccccggaaaagtgtgacacccttctgtgcgatatcggcgagagctctccttcccccacagtggaagagagccgcaccattagagtcctcaagatggtggagccctggctgaaaaacaatcagttctgtatcaaggttctgaacccttacatgcccacagtgatcgaacacctcgagcggcttcaacgcaaacacggcgggatgctggtcagaaatcctctgtctcggaactccacccatgaaatgtattggattagcaatggaacgggcaacatcgtggcttctgtgaatatggtcagccgcctcctgcttaacagatttacaatgacccaccggagaccgaccattgagaaggacgttgatctgggggccggaacacgccatgtgaacgctgaacccgagacgcctaatatggacgtgatcggcgagcggattaaaagaatcaaggaagaacacaactccacctggcactacgacgatgaaaatccctataagacatgggcctaccatgggtcttatgaggtcaaagcgaccggaagcgcctccagcatgatcaacggcgtggttaagctcctgacaaaaccttgggacgtggtccccatggtgacccagatggctatgacagataccacgccgttcggccagcaacgcgtttttaaggaaaaagtggacacccggacacctagatccatgcccgggacccgccgggtcatgggaattacagccgagtggctgtggagaaccctcggccgcaataagaagcctcggctgtgcacgagagaggagttcaccaagaaggtgcgcaccaacgctgccatgggggccgtttttacagaggaaaatcagtgggattctgcgaaagctgccgtggaggacgaagatttctggacccttgtcgaccgggagagagagctgcacaagctcggaaaatgtggcagctgcgtgtacaacatgatggggaagcgcgagaaaaagctgggcgagtttggaaaggccaaaggctccagagctatctggtacatgtggcttggggcccggtatctggagttcgaggctctcggatttctgaatgaggatcattggttctctcgcgaaaacagctactccggcgtcgagggggaaggactgcacaagctcggctatattctgagagacatctctaaaattcccgggggcgccatgtacgcggatgacacggccggatgggacacccggatcacagaggatgaccttcataatgaagagaagatcacccagcagatggatcctgagcacagacaactggctaacgccatttttaaactcacatatcagaataaggtggttaaggtgcagcggcccaccccgacaggcaccgtcatggacatcattagccgcaaagatcagagagggtccggacaagtgggcacgtacgggctgaacacattcaccaatatggaagctcagcttatccggcagatggagggagaaggcgtgctgagcaaggccgacctcgagaaccctcatctgcccgagaaaaagattacccagtggctggagacaaaaggggttgagcgcctcaagagaatggcgatctctggcgatgactgcgtggtcaagcccatcgatgaccggtttgccaacgctctgcttgccctgaatgatatgggaaaagtgcgcaaggacattcctcaatggcagccgtccaaaggctggcatgattggcagcaggttcccttctgtagccaccatttccacgaactcatcatgaaggacgggagaaaactggtggtcccttgccggccccaagacgagcttattggacgcgctagaatctctcagggcgccgggtggtccctgcgggaaaccgcttgtctcggaaaggcctatgcgcagatgtggagcctgatgtactttcaccgcagagatctgcggctcgcctctaacgctatttgctccgccgtgcctgtccattgggtgcccacaagccgcacgacctggtccatccacgcccatcaccaatggatgacaaccgaggacatgctgacagtttggaatagagtgtggattgaagataacccttggatggaggacaagacccccgtcacgacctgggagaatgtgccgtaccttggcaaacgggaagatcagtggtgtgggagcctgatcggcctcacatctagagctacctgggcccagaacatccctacagcgattcagcaagttcgcagcctgatcggaaatgaggagttccttgactatatgccctccatgaagcggtttagaaaagaggaggaatctgagggcgctatttggtga

SEQ ID NO: 20672 - RNA, 9873 nt, synthetic construct
  misc_feature 1..9873: note = derived and/or modified CDS sequence (opt5) from DENV-3__EU529703__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggccctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgcgccctgtaaaattcctttcagcaccgaggacggccaagggaaggctcataacggaagactgatcacagccaatcccgtggttaccaaaaaggaggaacccgtgaacattgaggccgaacctccgttcggcgagtccaatatcgtcattgggatcggcgataacgctctgaaaatcaattggtataagaagggatctagcattggcaaaatgtttgaagccacggctagaggggccagacgcatggcgatccttggagacacagcctgggatttcggctccgtcgggggagtgctcaacagcctgggcaagatggttcaccagatttttgggtctgcttacaccgccctgttctccggcgtcagctgggtgatgaaaatcggaattggcgtgctcctgacctggatcgggcttaattctaagaacacaagcatgtccttttcttgcattgctatcggaatcattaccctgtatctcggcgccgtcgtgcaggcggacatggggtgtgttatcaattggaaaggaaaggagctgaagtgcggcagcgggattttcgtgacaaacgaggtccatacgtggaccgaacagtacaaatttcaagccgattcccccaagcggctggctacagccatcgctggcgcctgggagaatggagtgtgtggcattagaagcaccacacgcatggaaaaccttctctggaaacagatcgccaatgagctgaactatatcctgtgggaaaataacattaagctcaccgttgtggtcggggacatcattggagtgctggagcagggcaaacggacgcttacccctcagcccatggagctgaagtactcttggaaaacatgggggaaggctaagatcgttaccgcggaaacacaaaactccagcttcattatcgatggacctaatacccccgagtgcccgtctgcctccagagcttggaacgtgtgggaagtcgaggactatggctttggcgtgttcacaaccaatatctggctcaaactgcgcgaagtgtacacgcagctgtgtgaccaccggcttatgagcgccgccgtcaaggatgagagagctgttcacgccgacatggggtactggattgagtcccagaaaaacggatcttggaagctcgaaaaagcgagcctgatcgaggtgaagacatgcacctggcctaagtcccataccctgtggtctaatggcgtgctcgaaagcgatatgattatccccaaatccctggctgggcctattagccagcacaaccatcgccccggatatcacacacaaaccgccggcccttggcaccttgggaagctggagctcgactttaattactgcgagggaacgacagtcgtgatcaccgaaaactgtggcacacggggcccctctctgagaaccacaaccgtttccgggaaactgatccatgagtggtgctgtcgcagctgcacgcttccgcctctccggtatatgggagaagatggctgttggtacgggatggagattagacccatctctgaaaaggaggagaatatggtgaaatccctggtcagcgccggatctggcaaggtggacaacttcaccatgggggttctgtgcctcgctattctgtttgaagaggtgatgcggggaaagttcggcaaaaagcacatgatcgccggcgtcttctttacattcgtgcttctgctcagcgggcagattacctggcgcgatatggcgcatacactgatcatgattggatccaatgctagcgacagaatgggcatgggggttacctatctggcccttatcgccacgtttaaaatccagcccttcctggctctcggatttttcctgcggaagctcacatctagagaaaacctgcttctgggcgtggggctcgccatggctaccacactgcaactgcctgaggatattgaacagatggccaatggaatcgcgcttggcctgatggccctcaaactgattacccagtttgagacctaccagctctggacagctctgatctcccttacgtgtagcaacaccattttcacactgaccgtcgcctggcgcacagctaccctcatcctggccggcgtgtccctgcttccggtgtgccaatctagctccatgcggaagacggactggctgcccatggccgtcgctgcgatgggggttcctcccctccctctgtttatcttctctctcaaggatacactgaaaagacgcagctggccccttaatgagggagtgatggccgtgggcctggtctccattctggcttctagcctcctgagaaacgacgtgcctatggccgggccccttgttgccggaggcctgctcatcgcttgttatgtgattaccgggacctccgccgatctgacagtcgaaaaggcggctgacatcacctgggaggaagaggccgaacagacaggagtgagccacaacctcatgattacggttgacgatgacggcaccatgcggatcaaagatgacgagacagagaatatcctgaccgtgcttctgaagacagccctgctcattgtctctggcatctttccgtactccattcctgctaccctgcttgtgtggcatacgtggcagaaacagacccaacgcagcggggtcctgtgggatgtgccctctcctcccgaaacacagaaggccgagctcgaagagggagtttacagaatcaaacagcagggcattttcgggaagacccaagtgggagtcggcgtgcagaaggagggggtttttcacacaatgtggcacgtgacccggggagcggtcctgacatataacggcaaacgcctcgaaccgaattgggcttccgtgaagaaagacctgatcagctacggcgggggatggagactttctgcccagtggcaaaagggcgaggaagtgcaggttattgccgtcgagcctgggaaaaaccccaagaatttccagacgatgcctggaaccttccagacaaccaccggcgaaatcggggctatcgccctggattttaagcccggaacatccggcagccccattatcaaccgggagggcaaagtggtggggctgtatggaaatggcgtcgtgacgaagaacgggggatacgtttccggcattgctcaaaccaatgccgagcctgacgggccgacacccgaactcgaggaagagatgttcaaaaagcgcaacctgaccatcatggatcttcatcctggcagcggaaaaacaagaaagtatctgcccgcgattgtgcgggaagccatcaagcgcagactccggaccctgatcctcgctcctacgagagtcgtggccgctgagatggaggaagccctgaaaggccttcccattcgctaccagacaaccgccaccaagtctgagcacacagggcgggaaatcgttgacctgatgtgccatgctacctttacaatgagactgctcagccctgtgcgcgtcccgaattataacctgattatcatggatgaggcgcacttcaccgaccccgcctccattgctgcccggggatacatctctacgagagtgggcatgggggaagccgctgccatctttatgacagcgacccctcccggaacagctgatgccttccctcagagcaatgcccccattcaggacgaggagcgcgacatcccggaacggtcctggaactctggcaatgagtggattaccgattttgctgggaaaacggtttggttcgtgcctagcatcaaggccggcaacgacattgcgaactgtcttcgcaaaaatggaaagaaggtcatccaactgtccagaaaaacctttgatacagaataccagaagaccaaactcaacgactgggatttcgtggtgacaaccgacatttctgagatgggcgccaattttaaggctgatcgggtcatcgaccccagacggtgcctgaaacccgttatcctgacagatgggcctgagcgcgtgattctcgccggacccatgcctgtgaccgctgccagcgctgcccagagacggggccgcgtcgggagaaacccgcagaaggaaaatgaccaatatatcttcacgggacagccccttaacaatgatgaggaccatgcgcactggacagaagccaagatgctgctggacaacattaatacccctgagggcatcattcccgctctcttcgaacctgagcgggagaaatccgccgctatcgatggggaatacagactgaagggcgagagccgcaaaacctttgtggaacttatgcggagaggagacctgcccgtttggctcgcccacaaggtggcctctgagggcatcaaatatacagatcgcaagtggtgcttcgacgggcagcggaacaatcagattctggaagagaacatggatgtcgagatctggaccaaagaaggagagaagaagaaactgagaccgcgctggctcgacgctcggacatactccgatcctcttgcgctgaaggaatttaaagacttcgccgctggcagaaagagcattgccctggatctcgtgacggagatcgggcgcgttccctctcatctggcccacagaacccggaatgctcttgacaacctggtgatgctccatacatccgaacacggaggccgcgcctatagacacgcggtcgaggagctgcctgaaaccatggagacactgctccttctgggcctgatgattctcctgaccgggggagccatgctttttctgatcagcggcaaagggatcggaaagacgtccattggcctcatctgtgtgattgcttctagcgggatgctgtggatggccgaaatccccctgcaatggattgcttccgccatcgtcctcgagttctttatgatggtgcttctgattcctgagcccgaaaagcagcggaccccgcaggataatcaactggcgtacgttgtgatcggaatcctcacactggccgctattatcgccgctaacgagatgggccttctggaaaccacaaaacgcgacctcggcatgagcaaggagcctggggtggtctctcccacctcctatctggatgttgacctgcatcccgccagcgcttggacgctctacgccgtggcgacaaccgtgattacacctatgcttagacacaccatcgaaaattctaccgccaacgtcagcctggctgccattgctaaccaggccgtggttctgatgggactcgacaaaggctggccgatctccaagatggatctgggggtgccccttctggccctcggatgctactctcaggtcaatcctctgacactgacggcggctgtgctccttctgatcacccattatgccattatcggccccgggctgcaggctaaagccacacgggaggcccaaaagagaaccgctgccggaattatgaagaaccctacagtcgacggcatcatgaccattgatctcgaccccgtgatctacgatagcaaattcgagaagcagctgggccaggttatgcttctggtgctctgtgcggtccagctgctgctcatgcgcacgtcctgggccctttgcgaagctctgacactggccaccgggcctatcaccacactctgggagggatctccgggcaaattttggaataccacaattgctgtgagcatggccaacatcttccgggggtcctatctggcgggagccggccttgcttttagcattatgaagtctgttgggacgggaaaaagaggcaccggctcccaaggggaaacactgggagagaagtggaagaaaaagctcaatcagctgagccgcaaagagttcgacctgtacaagaaatccggcatcaccgaggtggatcggacagaggccaaggaagggctcaaaagaggagagattacccaccatgctgtctctcggggcagcgccaaacttcagtggtttgtggaacgcaacatggtgatccccgaggggagagttattgacctgggatgtggccggggcgggtggtcctattactgcgctggactgaagaaagtcacggaagtgcgcggctataccaaagggggacctggccacgaggagcccgtgcctatgtctacatacgggtggaatatcgtcaaactcatgagcggaaaggatgttttctacctgcccccggaaaaatgtgacacccttctgtgcgatatcggcgagtccagcccttctcccacagtggaagagtccagaaccattcgggtgctcaagatggtcgagccctggctgaagaacaatcagttctgtatcaaagtgctgaacccttatatgcccacagttattgaacacctcgagcgccttcaaagaaagcatggcgggatgctggtgcggaatcctctgagccgcaactctacccacgaaatgtactggatctccaatggaacgggcaacattgtcgccagcgtgaatatggtttctagactcctgcttaaccggtttacaatgacccatagacgcccgaccatcgagaaagacgtggatctgggggcgggaacacggcacgtcaacgccgaacccgagacgcctaatatggacgtgatcggcgagagaattaagcgcatcaaagaagaacacaacagcacctggcattatgacgatgaaaatccctacaagacatgggcttatcacgggtcctacgaggtgaaggccaccggatctgctagctccatgattaacggcgtcgttaaactcctgacaaagccttgggacgtggtgcccatggtcacccagatggccatgacagataccacgccgttcggccagcaacgggtgtttaaagaaaaggttgacaccagaacacctcgcagcatgcccgggacccggagagtgatgggaatcacagccgagtggctgtggcgcaccctcggccggaataaaaagcctagactgtgcacgcgcgaggagttcacaaagaaagtccggaccaacgcggctatgggggccgtgtttacagaggaaaatcagtgggattccgccaaggctgccgttgaggacgaagatttctggaaacttgtggacagagagcgcgagctgcataagctcggaaaatgtggctcttgcgtctataacatgatggggaagagagagaagaagctgggcgagtttggaaaggctaaaggcagccgggccatttggtacatgtggcttggggcgcgctacctggagttcgaggccctcggatttctgaatgaggatcactggttctccagagaaaactcttatagcggcgtggagggggaaggactgcataagctcggctacatcctgcgggacatctccaaaattcccgggggcgctatgtatgccgatgacaccgctggatgggacacgagaatcaccgaggatgaccttcacaatgaagagaagattacacagcagatggatcctgagcaccggcaactggccaacgcgatctttaaactcacctaccagaataaggttgtgaaggtccagcgccccacaccgaccggcacagtgatggacattatctctagaaaagatcagcgggggagcggacaagtcggcacctatgggctgaacacgttcacaaatatggaagcccagcttatccgccagatggagggagaaggcgtgctgtccaaggctgacctcgagagccatcatctgcctgagaagaagattacccagtggctggagaccaaaggggttgagagactcaagcggatggccatctctggcgatgactgcgtggtcaagcccattgatgaccgctttgctaacgccctgcttgctctgaacgatatgggaaaagtgagaaaggacatcccccaatggcagccttccaaaggctggcatgattggcaacaggtgccgttctgtagccaccacttccatgaactcattatgaaggacgggcggaaactggttgtgccctgccgccctcaagacgagcttatcggacgggcccggatttctcagggcgcggggtggtccctgcgcgaaacagcctgtctcggaaaggcttacgcccagatgtggagcctgatgtattttcacagacgggatctgcgcctcgcctctaatgctatctgctccgccgtccccgtgcattgggttcctaccagcagaacaacgtggtccatccacgcgcatcaccaatggatgaccacagaggacatgctgaccgtgtggaaccgggtctggattgaagataatccctggatggaggacaagacacctgtgaccacgtgggagaacgtcccctaccttggcaaaagagaagatcagtggtgtgggagcctgatcggcctcacctctcgcgctacatgggcccagaatattccgaccgccatccagcaagtgcggagcctgattggaaacgaggagttccttgactacatgccttccatgaagagatttcgcaaagaggaggaatctgagggcgctatctggtga

SEQ ID NO: 20673 - RNA, 9873 nt, synthetic construct
  misc_feature 1..9873: note = derived and/or modified CDS sequence (opt5) from DENV-3__EU529705__SS-prME
  source 1..9873: mol_type = other RNA
acctccctgtgcctcatgatgatcctgcccgccgctcttgccttccacctgacatccagagacggagagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggcggcaggtcgaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggaattggcaaccgggactttgtggaagggctcagcggagctacctgggtcgatgtggtgctggagcacggcgggtgcgtcaccacaatggccaagaataaacccacgctggacatcgagctccagaagaccgaagctacacaactggccacccttcgcaaactgtgtattgagggaaagatcacaaacattaccacggattccagatgccctacacagggcgaagcggttctcccggaggaacaggaccagaattatgtgtgtaaacacacctacgtggatcggggctgggggaacggatgcggcctgttcgggaagggaagccttgtgacctgcgccaagtttcaatgtctggagcccatcgagggcaaagtggttcagtatgaaaatctcaagtacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctgggccttaaagggatgtcttacgctatgtgcacaaacacgtttgttctgaagaaagaggtgtccgagacccagcacggaacaatcctcattaaggtcgaatacaagggcgaggatgtgccctgtaaagttcctttcagcaccgaagacgggcaaggaaaggcccattccggcagactgatcacagcgaaccccgtggtcaccaaaaaggaggagcccgtgaatattgaagctgagcctccgttcggggaatctaacatcgtgattggcatcggagataatgccctgaaaatcaactggtataagaagggcagctccattgggaaaatgtttgaggccacggctcggggagccagacgcatggctatccttggcgacacagcctgggatttcgggagcgttggaggcgtcctcaattctctggggaagatggtgcaccagatttttggctccgcgtacaccgccctgttcagcggagtgtcttgggtcatgaaaatcggcattgggatcctcctgacctggattggacttaacagcaagaatacatccatgtcttttagctgcatcgtgatcggcattatcaccctgtatctcggggctgttgtgcaggccgacatgggatgtgtcattaactggaaaggcaaggaactgaagtgcgggtccggcatcttcgtgacaaatgaggttcatacgtggaccgagcagtacaaatttcaagctgatagccccaagcggctggccacagcgattgccggagcttgggaaaacggcgtgtgtgggatcagatctaccacacgcatggagaatcttctctggaaacagatcgccaacgaactgaattatattctgtgggagaacaatatcaagctcaccgtcgtggttggagacattatcggcgtgctggaacaggggaaacggacgcttacccctcagcccatggagctgaagtactcctggaaggcttggggaaaggccaagattgtcacagccgagacccaaaacagctctttcatcatcgatggccctaacacacccgaatgcccgtccgctagcagagcgtggaatgtgtgggaggtggaagactatggctttggggtcttcaccacaaacatttggctcaaactgcgcgaggtttacacccagctgtgtgaccaccggcttatgtccgccgctgtgaaggatgaaagagccgtgcacgccgacatgggatactggatcgagtctcagaaaaatggcagctggaagctcgagaaagctagcctgattgaagtcaagacgtgcacatggcctaagtctcataccctgtggagcaacggggtgctcgagtccgatatgatcattcccaaaagcctggccggacctatctctcagcacaattatcgccccggctaccatacccaaacagcggggccttggcaccttggaaagctggaactcgactttaactattgcgagggcaccacggttgtgatcacagagaattgtggcacccgggggccctccctgagaacaaccacagtcagcggaaaactgattcacgaatggtgctgtcgctcttgcacccttccgcctctccggtacatgggcgaggatgggtgttggtatggaatggaaatcagacccatttccgagaaggaagagaacatggtgaaaagcctggtttctgctggcagcgggaaggtggacaatttcacgatgggagtcctgtgcctcgccatcctgtttgaggaagtgatgcggggcaagttcggcaaaaagcatatgattgccggggttttctttaccttcgtgcttctgctctccggacagatcacatggcgcgatatggctcacaccctgattatgatcggcagcaacgcctctgacagaatggggatgggagtcacatacctggcgcttatcgctacctttaaaattcagcccttcctggccctcggctttttcctgcggaagctcacgtccagagagaatctgcttctgggggtgggactcgccatggctacaaccctgcaactgcctgaagatatcgagcagatggccaacggcattgctcttggcctgatggccctcaaactgatcacacagtttgaaacctatcagctctggaccgcgctgattagccttacatgttccaatacgatcttcaccctgacagtggcctggcgcaccgctacactcatcctggccggggtctctctgcttccggtttgccaaagctcctctatgcggaagaccgactggctgcccatgacggtggctgccatgggagtgcctcccctccctctgtttattttcagcctcaaggatacactgaaaagacgctcctggccccttaacgagggcgtcatggccgtggggctggtttctatcctggctagctccctcctgagaaatgacgtgcctatggcgggaccccttgtcgccggcgggctgctcattgcttgttacgtgatcaccggaaccagcgccgatctgacagttgagaaggccgctgacgtgacctgggaagaggaagccgagcagacaggcgtctctcataacctcatgattacggtggacgatgacggcaccatgcggatcaaagatgacgaaacagagaacatcctgaccgtccttctgaagacagcgctgctcattgtgtccgggatctttccgtacagcattcctgctaccctgcttgtttggcacacgtggcagaaacagacccaacgctctggagtgctgtgggatgtcccctcccctcccgagacacagaaggccgaactcgaggaaggcgtgtatagaatcaaacagcaggggattttcggaaagacccaagttggcgtgggggtccagaaggagggagtgtttcatacaatgtggcacgtgacccggggcgccgttctgacatacaatggcaaacgcctcgagccgaactgggctagcgtcaagaaagacctgatctcttatgggggaggctggagactttccgcccagtggcaaaagggggaagaggtccaggtgattgcggtcgaacctggcaaaaatcccaagaacttccagacgatgcctggcaccttccagacaaccaccggggagatcggagctatcgccctggattttaagcccggcacaagcggctcccccattatcaatcgggaagggaaagtggttggactgtacggcaacggggtggtcacgaagaatggaggctatgtgagcgggattgcccaaaccaacgctgagcctgacggcccgacacccgagctcgaagaggaaatgttcaaaaagcgcaatctgaccatcatggatcttcaccctggatctggcaaaacaagaaagtacctgcccgccattgttcgggaggctatcaagcgcagactccggaccctgatcctcgcccctacgagagtggtcgcggccgaaatggaggaggctctgaaagggcttcccattcgctatcagacaaccgccaccaagagcgaacatacaggacgggagatcgtggacctgatgtgccacgctacctttacaatgagactgctctcccctgttcgcgtgccgaactacaatctgattatcatggatgaagcccatttcaccgaccccgcctctattgctgcgcggggctacatcagcacgagagtcgggatgggagaggccgctgccatctttatgacagccacccctcccggcacagctgatgccttccctcagtccaacgcgcccattcaggacgaagaaagagacatcccggagcggtcttggaatagcgggaacgaatggattaccgattttgctggcaaaacggtgtggttcgtgccttccatcaaggccggaaatgacattgccaactgtcttcgcaaaaacggcaagaaggtcatccaactgtctcgcaaaacctttgatacagagtatcagaagaccaaactcaatgactgggatttcgttgtgacaaccgacattagcgaaatgggggctaactttaaggccgatcgggtgatcgaccccagacggtgcctgaaacccgtcatcctgacagatggacctgagcgcgtgattctcgcgggccccatgcctgttaccgccgcttccgccgctcagagacgggggcgcgtgggaagaaatccgcagaaggagaacgaccaatacatcttcacgggccagccccttaataacgatgaagaccacgcccattggacagaggctaagatgctgctggacaatattaacacccctgaagggatcattcccgccctcttcgagcctgaacgggagaaaagcgcggccatcgatggcgagtatagactgaagggagaatctcgcaaaacctttgtcgagcttatgcggagaggcgacctgcccgtgtggctcgctcacaaggttgcctccgaagggatcaaatacacagatcgcaagtggtgcttcgacggacagcggaataaccagattctggaggaaaatatggatgtggagatctggaccaaagagggcgaaaagaagaaactgagaccgcgctggctcgacgctcggacatatagcgatcctcttgccctgaaggagtttaaagacttcgccgctgggagaaagtctattgcgctggatctcgtcacggaaatcggacgcgtgccctcccacctggcccatagaacccggaacgctcttgacaatctggtcatgctccacacaagcgagcatggcggccgcgcctacagacacgccgtggaagaactgcctgagaccatggaaacactgctccttctggggctgatgattctcctgaccggaggcgctatgctttttctgatctccgggaaaggaatcggcaagacgtctattgggctcatctgtgttattgccagctccggaatgctgtggatggcggagatccccctgcaatggattgccagcgctatcgtgctcgagttctttatgatggtgcttctgattcctgagcccgagaagcagcggaccccgcaggataaccaactggcctatgtcgttatcggcatcctcacactggctgccattatcgcggccaatgaaatgggccttctggagaccacaaaacgcgacctcgggatgtctaaggaacctggagtggtgtcccccaccagctacctggatgtcgacctgcaccccgcttctgcctggacgctctacgctgtggccacaaccgttattacacctatgcttagacataccatcgagaacagcaccgctaatgtgtccctggccgcgattgccaaccaggctgtcgtgctgatgggcctcgacaaagggtggccgatctctaagatggatctgggagtcccccttctggccctcggctgctatagccaggtgaaccctctgacactgacggctgccgttctccttctgatcacccactacgccattatcgggcccggactgcaggcgaaagctacacgggaagcccaaaagagaaccgctgccggcattatgaagaatcctacagtggacggcatcatgaccattgatctcgaccccgtcatctatgattccaaattcgagaagcagctgggacaggtgatgcttctggttctctgtgccgtgcagctgctgctcatgcgcacgtcttgggctctttgcgaggccctgacactggcgaccggacctatcaccacactctgggaaggcagcccggggaaattttggaacaccacaattgccgtctccatggctaatatcttccggggaagctacctggccggcgctgggcttgccttttctattatgaagtccgtgggaacgggcaaaagaggcaccgggagccaaggagagacactgggcgaaaagtggaagaaaaagctcaaccagctgtcccgcaaagagttcgacctgtataagaaatctgggatcaccgaagtggatcggacagaggcgaaggagggactcaaaagaggcgaaattacccatcacgccgttagccgggggtccgctaaacttcagtggtttgtcgagcgcaatatggtgatccccgaaggaagagtgattgacctgggctgtggcagaggcgggtggtcttactattgcgccgggctgaagaaagtcacggaggttcgcgggtacaccaagggaggccctgggcatgaggaacccgtgcctatgagcacatacggatggaacatcgtgaaactcatgtccggcaaggatgtcttctatctgcccccggagaaatgtgacacccttctgtgcgatatcggcgaaagctctccttcccccacagtggaggaaagcagaaccattcgggttctcaagatggtggagccctggctgaagaataaccagttctgtatcaaagtcctgaatccttacatgcccacagtgattgagcacctcgaacgccttcaaagaaagcacgggggaatgctggttcggaaccctctgtctcgcaattccacccatgagatgtattggatcagcaacggcacggggaatattgtggcttctgtcaacatggtgagcagactcctgcttaatcggtttacaatgacccacagacgcccgaccatcgaaaaagacgtggatctgggagccggcacacggcatgtcaacgctgagcccgaaacgcctaacatggacgttatcggggagagaattaagcgcatcaaagaggaacacaattccacctggcactacgacgatgagaacccctataagacatgggcctaccatggatcttatgaagtgaaggcgaccggcagcgcctccagcatgattaatggcgtggtcaaactcctgacaaagccttgggacgtggttcccatggtgacccagatggctatgacagataccacgccgttcgggcagcaacgggtctttaaagagaaggtggacaccagaacacctcgctccatgcccggaacccggagagttatgggcatcacagccgaatggctgtggcgcaccctcgggcggaacaaaaagcctagactgtgcacgcgcgaggagttcacaaagaaagtgcggaccaatgctgccatgggagccgtctttacagaagagaaccagtgggattctgcgaaggctgccgtggaagacgaggatttctggattcttgttgacagagaacgcgagctgcacaaactcggcaagtgtgggagctgcgtgtacaatatgatgggcaaaagagagaagaaactgggagaatttggcaaggccaaggggtcccgggctatctggtacatgtggcttggagcccgctatctggagttcgaagctctcggctttctgaacgaggatcattggttctctagagagaatagctactccggggtcgaaggagagggcctgcacaaactcgggtatatcctgcgggacatttctaagatccccggcggagccatgtacgcggatgacaccgccggctgggacacgagaattaccgaagatgaccttcataacgaggagaaaatcacacagcagatggatcctgagcaccggcaactggctagcgccatttttaagctcacctatcagaataaagtggtcaaggtgcagcgccccacaccgaccgggacagttatggacatcatctccagaaaggatcagcggggaagcggccaagtggggacctacggactgaacacgttcacaaatatggaggctcagcttattcgccagatggaaggcgagggggtcctgtctaaagccgacctcgaaaaccctcatctgcccgagaagaaaatcacccagtggctggaaaccaagggcgtggagagactcaaacggatggcgatttccggagatgactgcgtggttaagcccatcgatgaccgctttgccaatgctctgcttgccctgaacgatatgggcaaggtgagaaaagacattcctcaatggcagccgagcaaggggtggcatgattggcagcaggtccccttctgttctcaccatttccacgagctcatcatgaaagacggacggaagctggtggttccttgccgcccccaagacgaacttattggcagagctcggatctcccagggggccggatggagcctgcgcgagacagcttgtctcggcaaagcctatgcgcagatgtggtctctgatgtactttcacagacgggatctgcgcctcgcctccaacgctatctgcagcgccgtgcctgtccattgggtgcccacctccagaacaacgtggagcattcacgcccatcaccaatggatgaccacagaagacatgctgaccgtctggaatcgggtgtggatcgaggataacccttggatggaagacaagacacccgttaccacgtgggagaatgtgccgtaccttgggaagagagaggatcagtggtgtggctctctgattggactcaccagccgcgctacatgggcccagaacatccctaccgcgattcagcaagtccggtccctgatcggcaatgaagagttccttgactatatgccctctatgaaaagatttcgcaaggaagaggagagcgaaggggctatctggtga

SEQ ID NO: 20674 - RNA, 9873 nt, synthetic construct
  misc_feature 1..9873: note = derived and/or modified CDS sequence (opt5) from DENV-3__EU596492__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgctctcccggaggaacaggaccagaattatgtgtgtaaacacacatacgtcgatcggggctgggggaacggatgcggcctgttcgggaagggaagccttgtgacctgcgccaagtttcaatgtctggagcccatcgagggcaaagttgtgcagtatgaaaatctcaagtacaccgtcattatcacagtgcataccggggaccagcaccaggttggaaacgagacacaaggcgtgacggctgaaatcacccctcaggcctctacaaccgaggccattctgcccgaatatggcacactggggctcgagtgctcccctcgcaccggactggacttcaatgagatgatccttctgacgatgaaaaacaaggcttggatggtccatagacagtggtttttcgatctccccctgccgtggaccagcggcgcgacaaccgaaacacctacctggaatcggaaagagcttctggtgacgtttaagaacgcccacgctaaaaagcaagaagtcgtggttctcgggtctcaggagggagccatgcacacagccctgaccggcgctacagaaattcagaattccgggggcaccagcatcttcgccggacatctgaagtgtcgcctcaaaatggacaagctggagcttaaaggcatgtcttacgcgatgtgcaccaacacatttgtgctgaagaaagaggtctccgaaacgcagcacgggaccattctcatcaaggtggagtacaagggagaagatgctccctgtaaaatccctttcagcacagaggacggccaagggaaggcccataacggaagactgattaccgccaatcccgttgtgacaaaaaaggaggaacccgtcaacatcgaggctgaacctccgttcggcgagtccaatattgtgatcgggattggcgataacgccctgaaaatcaattggtataagaagggatctagcatcggcaaaatgtttgaagctaccgcccggggggcgagacgcatggccattcttggagacacggcttgggatttcggctccgtggggggagttctcaacagcctgggcaagatggtccaccagatctttgggtctgcctacacagctctgttctccggcgtgagctgggtgatgaaaattggaatcggcgtcctcctgacctggattgggcttaattctaagaacaccagcatgtccttttcttgcatcgccattggaatcatcacactgtatctcggcgcggtggttcaggccgacaccgggtgtgtggtcaattggaaaggaaaggagctgaagtgcggcagcgggattttcgtgacaaacgaggttcatacgtggaccgaacagtacaaatttcaagctgattcccccaagcggctggccacagctatcgccggcgcctgggagaatggagtgtgtggcattagaagcaccacacgcatggaaaaccttctctggaaacaggtcgctaatgagctgaactatatcctgtgggaaaataacattaagctcaccgtggttgtgggggacatcatcggagtcctggagcagggcaaacggacgcttacccctcagcccatggagctgaagtactcttggaaaacatgggggaaggcgaagattgtgaccgccgaaacacaaaactccagcttcatcattgatggacctaatacccccgagtgcccgtctgcttccagagcctggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgcggacatggggtactggattgagtcccagaaaaacggatcttggaagctcgaaaaagctagcctgatcgaggtgaagacatgcacctggcctaagtcccataccctgtggtctaatggcgttctcgaaagcgatatgatcattcccaaatccctggccgggcctatcagccagcacaactatcgccccggataccatacacaaaccgccggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgctggatctggcaaggtcgacaacttcaccatgggggtgctgtgcctcgccatcctgtttgaagaggttatgcggggaaagttcggcaaaaagcatatgattgcgggcgtgttctttacattcgtccttctgctcagcgggcagatcacctggcgcgatatggctcacacactgattatgatcggatccaatgccagcgacagaatgggcatgggggtgacctacctggcccttattgctacgtttaaaatccagcccttcctggccctcggatttttcctgcggaagctcacatctagagaaaacctgcttctgggcgtggggctcgctatggccaccacactgcaactgcctgaggatattgaacagatggcgaatggaatcgcccttggcctgatggctctcaaactgatcacccagtttgagacctatcagctctggacagccctgatttcccttacgtgtagcaacaccatcttcacactgaccgtcgcttggcgcacagccaccctcattctggccggcgtttccctgcttccggtgtgccaatctagctccatgcggaagtctgactggctgcccatgacggtggctgcgatgggggtccctcccctccctctgtttatcttcagcctcaaggatacactgaaaagacgctcctggccccttaatgagggagtgatggccgttggcctggtgtctattctggctagctccctcctgagaaacgacgtccctatggccgggccccttgtggccggaggcctgctcatcgcttgttacgttatcaccgggaccagcgccgatctgacagtggaaaaggcggctgacgtcacctgggaggaagaggccgaacagacaggagtgtctcataacctcatgattacggtcgacgatgacggcaccatgcggatcaaagatgacgagacagagaatattctgaccgtgcttctgaagacagccctgctcatcgtttccggcatttttccgtacagcatccctgctaccctgcttgtgtggcacacgtggcagaaacagacccgcagatctggggtcctgtgggatgtgccctcccctcccgaaacacaaaaggccgagctcgaagagggagtttatcggatcaaacagcagggcattttcgggaagacccaggtgggagtcggcgtgcaaaaggagggggtgtttcatacaatgtggcacgttacccgcggagcggtcctgacatacaacggcaaaagactcgaaccgaattgggctagcgtgaagaaagacctgatctcttatggcgggggatggcggctttccgcccagtggcagaagggcgaggaagtgcaagtcattgccgtggagcctgggaaaaaccccaagaatttccagacgatgcctggaaccttccagacaaccaccggcgaaatcggggctattgccctggattttaagcccggaacaagcggctcccccatcattaaccgcgagggcaaagttgtggggctgtacggaaatggcgtcgtgacgaagaacgggggatatgttagcggcatcgctcagaccaatgccgagcctgacgggccgacacccgaactcgaggaagagatgttcaaaaagagaaacctgaccatcatggatcttcaccctggctctggaaaaacacggaagtacctgcccgcgattgtgcgcgaagccatcaagagacggctcagaaccctgattctcgctcctacgcgcgtcgtggccgctgagatggaggaagccctgaaaggccttcccatccggtatcaaacaaccgccaccaagagcgagcatacagggagagaaattgttgacctgatgtgccacgctacctttacaatgcgcctgctctcccctgtgcgggtcccgaattacaacctgatcatcatggatgaggcgcatttcaccgaccccgcctctattgctgccagaggatacatcagcacgcgcgtgggcatgggggaagccgctgccatttttatgacagcgacccctcccggaacagctgatgccttccctcagtccaatgcccccatccaggacgaggagcgggacattccggaaagatcttggaacagcggcaatgagtggatcaccgattttgctgggaaaacggtgtggttcgtcccttccatcaaggccggcaacgacattgcgaactgtcttcgcaaaaatggaaagaaggttatccagctgtctcggaaaacctttgatacagaatatcaaaagaccaaactcaacgactgggatttcgtggtgacaaccgacattagcgagatgggcgccaattttaaggctgatagagtcatcgacccccggcgctgcctgaaacccgtgattctgacagatgggcctgagagagttatcctcgccggacccatgcctgtgaccgctgcctccgctgcccagcggcgcggcagagtcgggcggaacccgcagaaggaaaatgaccagtacattttcacgggacaaccccttaacaatgatgaggaccacgcgcattggacagaagccaagatgctgctggacaacatcaatacccctgagggcatcattcccgctctcttcgaacctgagagagagaaaagcgccgctatcgatggggaatatcgcctgaagggcgagtctcggaaaacctttgtggaacttatgagacgcggagacctgcccgtttggctcgcccacaaggtggcctccgagggcattaaatacacagatcggaagtggtgcttcgacgggcagagaaacaatcagatcctggaagagaacatggatgtcgagatttggaccaaagaaggagagaagaagaaactgcgcccgcggtggctcgacgctagaacatatagcgatcctcttgcgctgaaggaatttaaagacttcgccgctggccgcaagtctatcgccctggatctcgtgacggagatcgggagagtcccctcccacctggcccatcggacccgcaatgctcttgacaacctggtgatgctccacacaagcgaacatggaggcaaagcctacagacacgcggttgaggagctgcctgaaaccatggagacactgctccttctgggcctgatgattctcctgaccgggggagccatgctttttctgatctccggcaaggggattggaaagacgtctatcggcctcatttgtgtgatcgctagctccgggatgctgtggatggccgaaatccccctgcagtggattgctagcgccatcgtgctcgagttctttatgatggtccttctgattcctgagcccgaaaaacaacggaccccgcaggataatcagctggcgtatgttgtgatcggaattctcacactggccgctatcattgccgctaacgagatgggccttctggaaaccacaaagcgcgacctcggcatgtctaaagagcctggggtggtctcccccaccagctacctggatgtggacctgcaccccgcctctgcttggacgctctacgccgttgcgacaaccgtgatcacacctatgcttagacataccatcgaaaatagcaccgccaacgtctccctggctgccattgctaaccaagccgtggtcctgatgggactcaataagggctggccgatctctaaaatggacctgggggtgccccttctggccctcggatgctatagccaggttaaccctctgacactgacggcggctgtgctccttctgattacccactacgccatcattggccccgggctgcaggctaaggccacacgggaggcccagaagagaaccgctgccggaatcatgaaaaatcctacagtcgatggcatcatgaccattgacctcgatcccgtgatctatgactccaagttcgagaaacaactgggccaggttatgcttctggtgctctgtgcggtccagctgctgctcatgcgcacgtcttgggccctttgcgaagctctgacactggccaccgggcctattaccacactctgggagggaagcccgggcaagttttggaacaccacaatcgctgtgtccatggccaatattttccgggggagctacctggcgggagccggccttgctttttctatcatgaaatccgtggggacgggaaagagaggcaccggcagccagggggaaacactgggagagaagtggaaaaagaaactcaaccaactgtcccgcaaggaattcgatctgtataaaaagtctggcatcaccgaggttgaccggacagaggccaaagaagggctcaagagaggagagattacccatcacgctgtcagccggggctccgccaagcttcagtggtttgtggaacgcaatatggtgatccccgaggggagagtcattgatctgggatgtggccggggcgggtggtcttactattgcgctggactgaaaaaggttacggaagtgcgcggctacaccaaagggggacctggccatgaggagcccgtgcctatgagcacatacgggtggaacatcgtcaagctcatgtccggaaaagacgtgttctatctgcccccggaaaagtgtgatacccttctgtgcgacattggcgagagctctccttcccccacagttgaagagagcagaaccatccgggtgctcaagatggtcgagccctggctgaaaaataaccagttctgtattaaggtgctgaatccttacatgcccacagttatcgaacacctcgagcgccttcagagaaaacacggcgggatgctggtgcggaaccctctgtctcgcaattccacccatgaaatgtattggatcagcaacggaacgggcaatattgtcgcctctgtgaacatggtgagcagactcctgcttaaccggtttacaatgacccacagacgcccgaccatcgagaaggatgtcgacctgggggcgggaacacggcatgttaatgccgaacccgagacgcctaacatggatgtgattggcgagagaatcaaacgcattaaggaagagcacaattccacctggcactacgacgacgaaaacccctataagacatgggcttaccatgggtcttatgaggtgaaagccaccggaagcgcttccagcatgatcaatggcgtcgtgaagctcctgacaaaaccttgggatgttgtgcccatggtcacccaaatggccatgacagacaccacgccgttcggccagcagcgggtgtttaaggaaaaagttgataccagaacacctcgctccatgcccgggacccggagagtgatgggaatcacagccgagtggctgtggcgcaccctcggccggaacaagaagcctagactgtgcacgcgcgaggaattcacaaaaaaggtccggaccaatgcggctatgggggccgtgtttacagaggaaaaccaatgggactctgccaaagctgccgttgaggatgaagacttctggaagcttgtggatagagagcgcgagctgcacaaactcggaaagtgtggcagctgcgtctacaatatgatggggaaaagagaaaagaagctgggcgagtttggaaaagctaagggctcccgggccatttggtacatgtggcttggggcgcgctatctggaattcgaggccctcggatttctgaacgaggaccattggttctctagagaaaatagctactccggcgtggagggggaaggactgcacaaactcggctatatcctgcgggatatttctaagatccccgggggcgctatgtacgccgacgataccgctggatgggacacgagaattaccgaggacgatcttcataacgaagagaaaatcacacagcagatggaccctgagcaccggcagctggccaatgcgatctttaagctcacctatcaaaacaaggtcgtgaaagttcagcgccccacaccgaccggcacagtgatggatattatcagcagaaaggaccagcgggggtccggacaggtcggcacctacgggctgaatacgttcacaaacatggaagcccaacttattcgccagatggagggagaaggcgtgctgaccaaagctgatctcgagaaccctcacctgagcgaaaagaaaatcacccagtggctggagacaaagggggtggagagactcaagcggatggccatttctggcgacgattgcgttgtgaaacccatcgacgatcgctttgctaatgccctgcttgctctgaacgacatgggaaaggtcagaaaagatatgccccagtggcaaccttccaagggctggcatgactggcagcaggtgccgttctgtagccaccatttccacgaactcatcatgaaagatgggcggaagctggttgtgccctgccgccctcaggacgagcttattggaagagcccggatctctcaaggcgcggggtggtccctgcgcgaaaccgcctgtctcggaaaggcttatgcccagatgtggagcctgatgtactttcacagacgggacctgcgcctcgcctctaatgctatttgctccgccgtccccgtgcattgggtccctacaagcagaacgacctggtccatccacgcgcatcaccagtggatgacaaccgaggatatgctgacagtgtggaaccgggtttggattgaagacaatccctggatggaggataaaacccctgtgacgacctgggagaacgtcccctaccttggcaagagagaagaccaatggtgtgggagcctgatcggcctcacatctcgcgctacctgggcccagaatattccgacagccatccagcaggtgcggagcctgatcggaaacgaggaattccttgattatatgccttccatgaaaagatttcgcaaggaggaggaatctgagggcgctatttggtga

SEQ ID NO: 20675 - RNA, 9873 nt, synthetic construct
  misc_feature 1..9873: note = derived and/or modified CDS sequence (opt5) from DENV-3__EU596493__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgtgctcccggaggaacaggaccagaattatgtctgtaaacacacatacgtggatcggggctgggggaacggatgcggcctgttcgggaagggaagccttgttacctgcgctaagtttcaatgtctggagcccatcgagggcaaagtggtccagtatgaaaatctcaagtacaccgtgattatcacagttcataccggggaccagcaccaggtgggaaacgagacacaaggcgtcacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggttgtgctcgggtctcaggagggagctatgcacacagccctgaccggcgccacagaaattcagaattccgggggcaccagcatcttcgctggacatctgaagtgtcgcctcaaaatggacaagctggagcttaaaggcatgtcttacgccatgtgcaccaacacatttgtcctgaagaaagaggtgtccgaaacgcagcacgggaccattctcatcaaggttgagtacaagggagaagatgcgccctgtaaaatccctttcagcacagaggacggccaagggaaggctcataacggaagactgattaccgccaatcccgtggtcacaaaaaaggaggaacccgtgaacatcgaggccgaacctccgttcggcgagtccaatattgtgatcgggattggcgataacgctctgaaaatcaattggtataagaagggatctagcatcggcaaaatgtttgaagccaccgctcggggggccagacgcatggcgattcttggagacacggcctgggatttcggctccgttgggggagtcctcaacagcctgggcaagatggtgcaccagatctttgggtctgcttacacagccctgttctccggcgtgagctgggtcatgaaaattggaatcggcgtgctcctgacctggattgggcttaattctaagaacaccagcatgtccttttcttgcatcgctattggaatcatcacactgtatctcggcgccgttgtgcaggcggacaccgggtgtgtcattaattggaaaggaaaggagctgaagtgcggcagcgggatcttcgtgacaaacgaggttcatacgtggaccgaacagtacaaatttcaagccgattcccccaagcggctggctacagccattgctggcgcctgggagaatggagtgtgtggcatcagaagcaccacacgcatggaaaaccttctctggaaacaggtcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtgtgggaagtcgaggactatggctttggcgttttcacaaccaatatttggctcaaactgcgcgaagtgtacacgcagctgtgtgaccaccggcttatgagcgccgccgtgaaggatgagagagctgtccacgccgacatggggtactggatcgagtcccagaaaaacggatcttggaagctcgaaaaagcgagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatctctgaaaaggaggagaatatggttaaatccctggtgagcgccggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcgcacacactgatcatgattggatccaatgctagcgacagaatgggcatgggggtgacctacctggcccttatcgccacgtttaaaattcagcccttcctggctctcggatttttcctgcggaagctcacatctagagaaaacctgcttctgggcgtggggctcgccatggctaccacactgcaactgcctgaggatatcgaacagatggccaatggaatcgcgcttggcctgatggccctcaaactgattacccagtttgagacctatcagctctggacagctctgatctcccttacgtgtagcaacaccattttcacactgaccgtcgcctggcgcacagctaccctcatcctggccggcgtttccctgcttccggtgtgccaatctagctccatgcggaagtctgactggctgcccatgacggtggccgctatgggggtccctcccctccctctgtttattttcagcctcaaggatacactgaaaagacgctcctggccccttaatgagggagtgatggcggttggcctggtgtctatcctggccagctccctcctgagaaacgacgtccctatggctgggccccttgtggccggaggcctgctcatcgcctgttacgttattaccgggaccagcgctgatctgacagtggaaaaggccgcggacgtcacctgggaggaagaggctgaacagacaggagtgtctcataacctcatgatcacggtcgacgatgacggcaccatgcggattaaagatgacgagacagagaatatcctgaccgtgcttctgaagacagccctgctcattgtttccggcatctttccgtacagcatccctgccaccctgcttgtgtggcacacgtggcagaaacagacccgcagatctggggtcctgtgggatgtgccctcccctcccgaaacacaaaaggctgagctcgaagagggagtttatcggattaaacagcagggcatcttcgggaagacccaggtgggagtcggcgtgcaaaaggagggggtgtttcatacaatgtggcacgttacccgcggagccgtcctgacatacaacggcaaaagactcgaaccgaattgggcgagcgtgaagaaagacctgatttcttatggcgggggatggcggcttaacgctcagtggcagaagggcgaggaagtgcaagtcatcgccgtggagcctgggaaaaatcccaagaacttccagacgatgcctggaaccttccagacaaccaccggcgaaattggggccatcgctctggattttaagcccggaacatccggcagccccattatcaatcgcgagggcaaagttgtggggctgtacggaaacggcgtcgtgacgaagaatgggggatatgtttccggcatcgcccagaccaacgctgagcctgacgggccgacacccgaactcgaggaagagatgttcaaaaagagaaatctgaccattatggatcttcaccctggcagcggaaaaacacggaagtacctgcccgccatcgtgcgcgaagcgattaagagacggctcagaaccctgatcctcgcccctacgcgcgtcgtggctgccgagatggaggaagctctgaaaggccttcccattcggtatcaaacaaccgccaccaagtctgagcatacagggagagaaatcgttgacctgatgtgccacgccacctttacaatgcgcctgctcagccctgtgcgggtcccgaactacaatctgatcattatggatgaggctcatttcaccgaccccgcgtccatcgccgctagaggatacatttctacgcgcgtgggcatgggggaagccgccgctatctttatgacagccacccctcccggaacagcggatgctttccctcagagcaacgcccccattcaggacgaggagcgggacatcccggaaagatcctggaattctggcaacgagtggatcaccgattttgccgggaaaacggtgtggttcgtccctagcattaaggctggcaacgacatcgccaattgtcttcgcaaaaacggaaagaaggttattcagctgtcccggaaaacctttgatacagaatatcaaaagaccaaactcaatgactgggatttcgtggtgacaaccgacatctctgagatgggcgcgaactttaaggccgatagagtcattgacccccggcgctgcctgaaacccgtgatcctgacagatgggcctgagagagttattctcgctggacccatgcctgtgaccgccgctagcgccgctcagcggcgcggcagagtcgggcggaatccgcagaaggaaaacgaccagtacatcttcacgggacaaccccttaataacgatgaggaccacgcccattggacagaagcgaagatgctgctggacaatatcaacacccctgagggcattatccccgccctcttcgaacctgagagagagaaatccgctgccattgatggggaatatcgcctgaagggcgagagccggaaaacctttgtggaacttatgagacgcggagacctgcccgtttggctcgctcacaaggtggcctctgagggcatcaaatacacagatcggaagtggtgcttcgacgggcagagaaataaccagattctggaagagaatatggatgtcgagatctggaccaaagaaggagagaagaagaaactgcgcccgcggtggctcgacgccagaacatattccgatcctcttgctctgaaggaatttaaagacttcgcggccggccgcaagagcatcgctctggatctcgtgacggagattgggagagtcccctctcacctggcccatcggacccgcaacgcccttgacaatctggtgatgctccacacatccgaacatggaggcaaagcttacagacacgccgttgaggagctgcctgaaaccatggagacactgctccttctgggcctgatgatcctcctgaccgggggagcgatgctttttctgattagcggcaaggggatcggaaagacgtccattggcctcatctgtgtgatcgcctctagcgggatgctgtggatggctgaaattcccctgcagtggatcgcctccgctattgtgctcgagttctttatgatggtccttctgatccctgagcccgaaaaacaacggaccccgcaggataaccagctggcctatgttgtgattggaatcctcacactggcggccattatcgctgccaatgagatgggccttctggaaaccacaaagcgcgacctcggcatgagcaaagagcctggggtggtctctcccacctcctacctggatgtggacctgcaccccgctagcgcctggacgctctacgctgttgccacaaccgtgatcacacctatgcttagacataccattgaaaactctaccgcgaacgtcagcctggccgctatcgccaatcaagctgtggtcctgatgggactcgacaagggctggccgatttccaaaatggatctgggggtgccccttctggccctcggatgctattctcaggttaaccctctgacactgacggccgcggtgctccttctgatcacccactacgctattatcggccccgggctgcaggccaaggctacacgggaggcccagaagagaaccgccgctggaatcatgaaaaatcctacagtcgacggcattatgaccatcgatctcgaccccgtgatttatgatagcaagttcgagaaacaactgggccaggttatgcttctggtgctctgtgccgtccagctgctgctcatgcgcacgtcctgggcgctttgcgaagccctgacactggctaccgggcctatcaccacactctgggagggatctccgggcaagttttggaacaccacaattgccgtgagcatggctaatatcttccgggggtcctacctggccggagcgggccttgcctttagcatcatgaaatctgtggggacgggaaagagaggcaccggctcccagggggaaacactgggagagaagtggaaaaagaaactcaaccaactgagccgcaaggaattcgacctgtataaaaagtccggcattaccgaggttgatcggacagaggctaaagaagggctcaagagaggagagatcacccatcacgccgtctctcggggcagcgctaagcttcagtggtttgtggaacgcaatatggtgattcccgaggggagagtcatcgacctgggatgtggccggggcgggtggtcctactattgcgccggactgaaaaaggttacggaagtgcgcggctacaccaaagggggacctggccatgaggagcccgtgcctatgtctacatacgggtggaacattgtcaagctcatgagcggaaaagatgtgttctatctgcccccggaaaagtgtgacacccttctgtgcgatatcggcgagtccagcccttctcccacagttgaagagtccagaaccattcgggtgctcaagatggtcgagccctggctgaaaaataaccagttctgtatcaaggtgctgaatccttacatgcccacagttatcgaacacctcgagcgccttcagagaaaatatggcgggatgctggtgcggaaccctctgagccgcaattctacccacgaaatgtactggatttccaacggaacgggcaatatcgtcgctagcgtgaacatggtgtctagactcctgcttaaccggtttacaatgacccatagacgcccgaccattgagaaggacgtcgatctgggggccggaacacggcacgttaatgcggaacccgagacgcctaacatggacgtgatcggcgagagaattaaacgcatcaaggaagagcataatagcacctggcactatgacgatgaaaacccctacaagacatgggcctatcacgggtcctacgaggtgaaagctaccggatctgccagctccatgatcaatggcgtcgtgaagctcctgacaaaaccttgggacgttgtgcccatggtcacccaaatggctatgacagataccacgccgttcggccagcagcgggtgtttaaggaaaaagttgacaccagaacacctcgcagcatgcccgggacccggagagtgatgggaattacagccgagtggctgtggcgcaccctcggccggaacaagaagcctagactgtgcacgcgcgaggaattcacaaaaaaggtccggaccaatgccgcgatgggggctgtgtttacagaggaaaaccaatgggattccgccaaagccgctgttgaggacgaagatttctggaagcttgtggacagagagcgcgagctgcataaactcggaaagtgtggctcttgcgtctacaatatgatggggaaaagagaaaagaagctgggcgagtttggaaaagccaagggcagccgggctatctggtatatgtggcttggggcccgctacctggaattcgaggcgctcggatttctgaacgaggatcactggttctccagagaaaattcttatagcggcgtggagggggaaggactgcataaactcggctacattctgcgggacatctccaagattcccgggggcgccatgtatgctgatgacaccgccggatgggacacgagaatcaccgaggatgaccttcacaacgaagagaaaatcacacagcagatggatcctgagcatcggcagctggctaatgccatttttaagctcacctaccaaaacaaggtcgtgaaagttcagcgccccacaccgaccggcacagtgatggacatcatttctagaaaggatcagcgggggagcggacaggtcggcacctatgggctgaatacgttcacaaacatggaagcgcaacttatccgccagatggagggagaaggcgtgctgaccaaagccgacctcgagaaccctcacctgtccgaaaagaaaattacccagtggctggagacaaagggggtggagagactcaagcggatggctatcagcggcgatgactgcgttgtgaaacccatcgatgaccgctttgccaatgctctgcttgccctgaacgatatgggaaaggtcagaaaagacattccccagtggcaaccttctaagggctggcacgattggcagcaggtgccgttctgttcccatcacttccatgaactcatcatgaaagacgggcggaagctggttgtgccctgccgccctcaggacgagcttattggaagagctcggatcagccaaggcgccgggtggtctctgcgcgaaaccgcgtgtctcggaaaggcctacgctcagatgtggtccctgatgtactttcacagacgggatctgcgcctcgccagcaatgccatttgctctgctgtccccgtgcactgggtccctacatccagaacgacctggagcatccatgcccaccatcagtggatgacaaccgaggacatgctgacagtgtggaaccgggtttggattgaagataatccctggatggaggacaaaacccctgtgacgacctgggagaacgtcccctatcttggcaagagagaagatcaatggtgtgggtccctgatcggcctcacaagccgcgcgacctgggctcagaatatcccgacagccattcagcaggtgcggtctctgatcggaaacgaggaattccttgactacatgcctagcatgaaaagatttcgcaaggaggaggaatccgagggcgccatttggtga

SEQ ID NO: 20676 - RNA, 9873 nt, synthetic construct
  misc_feature 1..9873: note = derived and/or modified CDS sequence (opt5) from DENV-3__EU596494__SS-prME
  source 1..9873: mol_type = other RNA
accagcctgtgcctcatgatgatcctgcccgcggctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcgccgaagttgaacccgaagacattgattgctggtgtaacctcacatccacctgggtgacatatggaacctgcaatcaggccggcgaacaccggcgggacaagcgctctgtggctctggcccctcatgtcgggatgggactggatacgcggacccagacatggatgagcgctgaaggcgcctggagacaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgtgctcccggaggaacaggaccagaattatgtctgtaaacacacatacgtggatcggggctgggggaacggatgcggcctgttcgggaagggaagccttgttacctgcgctaagtttcaatgtctggagcccatcgagggcaaagtggtccagtatgaaaatctcaagtacaccgtgattatcacagttcataccggggaccagcaccaggtgggaaacgagacacaaggcgtcacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggttgtgctcgggtctcaggagggagctatgcacacagccctgaccggctccacagaaattcagaatagcgggggcacctctatcttcgccggacatctgaagtgtcgcctcaaaatggacaagctggagcttaaaggcatgtcctacgctatgtgcaccaacacatttgtcctgaagaaagaggtgagcgaaacgcagcacgggaccattctcatcaaggttgagtacaagggagaagatgccccctgtaaaatccctttctccacagaggacggccaagggaaggcgcataacggaagactgattaccgctaatcccgtggtcaccaagaaggaggaacccgtgaacatcgaggccgaacctccgttcggcgagtctaatattgtgatcgggattggcgataacgccctgaaaatcaattggtataagaagggaagctccatcggcaaaatgtttgaagctaccgccagaggggctagacgcatggccattcttggagacacggcgtgggatttcggcagcgttgggggagtcctcaactctctgggcaagatggtgcaccagatctttgggtccgcctacacagctctgttcagcggcgtgtcttgggtcatgaaaattggaatcggcgtgctcctgacctggattgggcttaatagcaagaacacctccatgtcttttagctgcatcgccattggaatcatcacactgtatctcggcgctgttgtgcaggccgacaccgggtgtgtcattaattggaaaggaaaggagctgaagtgcggctccgggatcttcgtgacaaacgaggttcatacgtggaccgaacagtacaaatttcaagcggatagccccaagcggctggccacagctattgccggcgcttgggagaatggagtgtgtggcatcagatctaccacacgcatggaaaaccttctctggaaacaggtcgccaatgagctgaactatattctgtgggaaaataacatcaagctcaccgtggttgtgggggacatcattggagtcctggagcagggcaaacggacgcttacccctcagcccatggagctgaagtactcctggaaaacatgggggaaggccaagatcgtgaccgctgaaacacaaaacagctctttcattatcgatggacctaatacccccgagtgcccgtccgcgagcagagcctggaacgtgtgggaagtcgaggactatggctttggcgttttcacaaccaatatttggctcaaactgcgcgaagtgtacacgcagctgtgtgaccaccggcttatgtccgctgccgtgaaggatgagagagccgtccacgctgacatggggtactggatcgagtctcagaaaaacggaagctggaagctcgaaaaagcctccctgatcgaggtgaagacatgcacctggcctaagtctcataccctgtggagcaatggcgttctcgaatccgatatgattatccccaaaagcctggcggggcctatttctcagcacaactatcgccccggataccatacacaaaccgctggcccttggcaccttgggaagctggagctcgactttaattattgcgagggaacgacagtggtcatcaccgaaaactgtggcacacggggcccctccctgagaaccacaaccgtgagcgggaaactgattcacgagtggtgctgtcgctcttgcacgcttccgcctctccggtacatgggagaagatggctgttggtatgggatggagatcagacccatctccgaaaaggaggagaatatggttaaaagcctggtgtctgccggaagcggcaaggtcgacaacttcaccatgggggtgctgtgcctcgccattctgtttgaagaggttatgcggggaaagttcggcaaaaagcatatgatcgctggcgtgttctttacattcgtccttctgctctccgggcagattacctggcgcgatatggcccacacactgatcatgattggaagcaatgcgtctgacagaatgggcatgggggtgacctacctggctcttatcgccacgtttaaaattcagcccttcctggccctcggatttttcctgcggaagctcacatccagagaaaacctgcttctgggcgtggggctcgctatggccaccacactgcaactgcctgaggatatcgaacagatggctaatggaatcgcccttggcctgatggcgctcaaactgattacccagtttgagacctatcagctctggacagccctgatcagccttacgtgttccaacaccattttcacactgaccgtcgcttggcgcacagccaccctcatcctggctggcgtttctctgcttccggtgtgccaaagctcctctatgagaaagagcgactggctgcccatgacggtggccgccatgggggtccctcccctccctctgtttattttctccctcaaggatacactgaaaagacgctcttggccccttaatgagggagtgatggctgttggcctggtgagcatcctggcgtccagcctcctgagaaacgacgtccctatggccgggccccttgtggctggaggcctgctcatcgcctgttacgttattaccgggacctctgccgatctgacagtggaaaaggctgccgacgtcacctgggaggaagaggcggaacagacaggagtgtcccataacctcatgatcacggtcgacgatgacggcaccatgcggattaaagatgacgagacagagaatatcctgaccgtgcttctgaagacagctctgctcattgttagcggcatctttccgtactctatccctgccaccctgcttgtgtggcacacgtggcagaaacagacccgcagatccggggtcctgtgggatgtgcccagccctcccgaaacacaaaaggccgagctcgaagagggagtttatcggattaaacagcagggcatcttcgggaagacccaggtgggagtcggcgtgcaaaaggagggggtgtttcatacaatgtggcacgttacccgcggagctgtcctgacatacaacggcaaaagactcgaaccgaattgggcctctgtgaagaaagacctgatttcctatggcgggggatggcggcttagcgcgcagtggcagaagggcgaggaagtgcaagtcatcgctgtggagcctgggaaaaaccccaagaatttccagacgatgcctggaaccttccagacaaccaccggcgaaattggggccatcgccctggattttaagcccggaacatccggcagccccattatcaaccgcgagggcaaagttgtggggctgtacggaaatggcgtcgtgacgaagaacgggggatatgtttctggcatcgctcagaccaatgccgagcctgacgggccgacacccgaactcgaggaagagatgttcaaaaagagaaacctgaccattatggatcttcaccctggcagcggaaaaacacggaagtacctgcccgctatcgtgcgcgaagccattaagagacggctcagaaccctgatcctcgcgcctacgcgcgtcgtggccgctgagatggaggaagccctgaaaggccttcccattcggtatcaaacaaccgctaccagatccgagcatacagggcgcgaaatcgttgacctgatgtgccacgccacctttacaatgcggctgctctctcctgtgagagtcccgaattacaacctgatcattatggatgaggcccatttcaccgaccccgctagcatcgcggcccgcggatacatttccacgcgggtgggcatgggggaagctgccgccatctttatgacagctacccctcccggaacagccgatgcgttccctcagtctaatgctcccattcaggacgaggagagagacatcccggaacgcagctggaactccggcaatgagtggatcaccgattttgccgggaagacggtgtggttcgtcccttctattaaagccggcaacgacatcgctaactgtcttcggaagaatggcaaaaaggttattcagctgagcagaaagacctttgatacagaatatcagaagacaaagctcaacgactgggatttcgtggtgacaaccgacatctccgagatgggagccaattttaaagcggatcgggtcattgacccccgcagatgcctgaagcccgtgatcctgacagatgggcctgagcgggttattctcgccggacccatgcctgtgaccgctgccagcgctgcccagcgcagaggccgggtcgggagaaacccgcagaaagaaaatgaccagtacatcttcacgggacaaccccttaacaatgatgaggaccacgctcattggacagaagccaagatgctgctggacaacatcaatacccctgagggcattatccccgccctcttcgaacctgagcgcgagaagtctgccgctattgatggggaatatcggctgaaaggcgagtccagaaagacctttgtggaacttatgcgccggggagacctgcccgtttggctcgcccacaaagtggctagcgagggcatcaagtacacagatagaaaatggtgcttcgacgggcagcgcaacaatcagattctggaagagaacatggatgtcgagatctggaccaaggaaggagagaaaaagaagctgcggccgagatggctcgacgcccgcacatattctgatcctcttgccctgaaagaatttaaggacttcgctgcgggcagaaaatccatcgccctggatctcgtgacggagattgggcgggtccccagccacctggctcatcgcaccagaaatgcccttgacaacctggtgatgctccacacatccgaacatggaggcaaggcctaccggcacgctgttgaggagctgcctgaaaccatggagacactgctccttctgggcctgatgatcctcctgaccgggggagccatgctttttctgatttctggcaaagggatcggaaagacgagcattggcctcatctgtgtgatcgcgtccagcgggatgctgtggatggccgaaattcccctgcagtggatcgcttctgccattgtgctcgagttctttatgatggtccttctgatccctgagcccgaaaagcaacgcaccccgcaggataatcagctggcttatgttgtgattggaatcctcacactggccgcgattatcgccgctaacgagatgggccttctggaaaccacaaaaagagacctcggcatgtccaaggagcctggggtggtcagccccacctcttacctggatgtggacctgcaccccgccagcgcttggacgctctacgccgttgctacaaccgtgatcacacctatgcttcggcataccattgaaaattccaccgccaacgtctctctggcggccatcgctaaccaagccgtggtcctgatgggactcgacaaaggctggccgattagcaagatggatctgggggtgccccttctggctctcggatgctattcccaggttaatcctctgacactgacggccgccgtgctccttctgatcacccactacgcgattatcggccccgggctgcaggctaaagccacaagagaggctcagaagcgcaccgccgccggaatcatgaagaaccctacagtcgacggcattatgaccatcgatctcgaccccgtgatttatgattctaaattcgagaagcaactgggccaggttatgcttctggtgctctgtgctgtccagctgctgctcatgcggacgagctgggccctttgcgaagcgctgacactggccaccgggcctatcaccacactctgggagggatccccgggcaaattttggaataccacaattgctgtgagcatggccaacatcttcagagggtcttacctggctggagccggccttgcgttttccatcatgaaaagcgtggggacgggaaaacgcggcaccggctcccagggggaaacactgggagagaagtggaagaaaaagctcaatcaactgtctcggaaagagttcgacctgtataagaaaagcggcattaccgaggttgatagaacagaggccaaggaagggctcaaacggggagagatcacccatcacgctgtctcccgcggctctgccaaacttcagtggtttgtggaaagaaacatggtgattcccgaggggcgggtcatcgacctgggatgtggccgcggcgggtggagctactattgcgctggactgaagaaagttacggaagtgagaggctacaccaaagggggacctggccatgaggagcccgtgcctatgtccacatacgggtggaatattgtcaaactcatgagcggaaaggatgtgttctatctgcccccggaaaaatgtgacacccttctgtgcgatatcggcgagtcttcccctagccccacagttgaagagtctcggaccattcgcgtgctcaagatggtcgagccctggctgaagaacaatcagttctgtatcaaagtgctgaacccttacatgcccacagttatcgaacacctcgagagacttcagcggaagcacggcgggatgctggtgcgcaatcctctgtccagaaacagcacccatgaaatgtattggatttctaatggaacgggcaacatcgtcgccagcgtgaatatggtgtcccggctcctgcttaacagatttacaatgacccaccgccggccgaccattgagaaagacgtcgatctgggggctggaacaagacatgttaacgccgaacccgagacgcctaatatggacgtgatcggcgagcgcattaagcggatcaaagaagaacacaactctacctggcactacgacgatgaaaatccctataagacatgggcgtaccatgggagctatgaggtgaaggccaccggatccgctagctccatgatcaacggcgtcgtgaaactcctgacaaagccttgggacgttgtgcccatggtcacccaaatggccatgacagataccacgccgttcggccagcagagagtgtttaaagaaaaggttgacacccgcacacctcggtctatgcccgggaccagacgcgtgatgggaattacagctgagtggctgtggcggaccctcggcagaaataaaaagcctcgcctgtgcacgcgggaggagttcacaaagaaagtcagaaccaacgccgccatgggggcggtgtttacagaggaaaatcaatgggatagcgctaaggccgccgttgaggacgaagatttctggaaacttgtggaccgcgagagagagctgcacaagctcggaaaatgtggctcctgcgtctacaacatgatggggaagcgggagaagaagctgggcgagtttggaaaggctaaaggctctcgcgccatctggtacatgtggcttggggctagatatctggagttcgaggccctcggatttctgaatgaggatcattggttcagccgggaaaactcctactctggcgtggagggggaaggactgcacaagctcggctatattctgagagacatcagcaaaattcccgggggcgcgatgtacgccgatgacaccgctggatgggacacgcggatcaccgaggatgaccttcataatgaagagaagatcacacagcagatggatcctgagcaccgccagctggccaacgctatttttaaactcacctatcaaaataaggtcgtgaaggttcagagacccacaccgaccggcacagtgatggacatcatttcccggaaagatcagcgcgggagcggacaggtcggcacctacgggctgaacacgttcacaaatatggaagcccaacttatcagacagatggagggagaaggcgtgctgaccaaggcggacctcgagaaccctcacctgtctgagaaaaagattacccagtggctggagacaaaaggggtggagcggctcaagcgcatggccatctccggcgatgactgcgttgtgaagcccatcgatgacagatttgctaacgccctgcttgctctgaatgatatgggaaaagtccggaaggacattccccagtggcaacctagcaaaggctggcatgattggcaacaggtgccgttctgttctcaccatttccacgaactcatcatgaaggacgggcgcaaactggttgtgccctgcagacctcaggacgagcttattggacgggcccgcatctcccaaggcgctgggtggagcctgagagaaaccgcctgtctcggaaaggcgtatgcccagatgtggtctctgatgtactttcaccggcgcgatctgagactcgcttccaacgccatttgcagcgccgtccccgtgcattgggtccctacatcccggacgacctggagcatccacgctcatcaccagtggatgacaaccgaggacatgctgacagtgtggaatagagtttggattgaagataacccctggatggaggacaagacccctgtgacgacctgggagaatgtcccctaccttggcaaacgcgaagatcaatggtgtgggtctctgatcggcctcacaagccgggccacctgggcgcagaacatcccgacagctattcaacaggtgagatccctgatcggaaatgaggagttccttgactatatgccttctatgaagcgctttcggaaagaggaggaaagcgagggcgccatttggtga

SEQ ID NO: 20677 - RNA, 9873 nt, synthetic construct
  misc_feature 1..9873: note = derived and/or modified CDS sequence (opt5) from DENV-3__EU687218__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaaaaatacaagtttcaggccgattcccccaaacggctggcgacagccatcgctggcgcctgggagaatggagtgtgtggcattagaagcaccacacgcatggaaaaccttctctggaagcaaatcgctaatgagctgaactatatcctgtgggaaaataacattaaactcaccgtcgtggttggggacatcattggagtgctggagcagggcaagcggacgcttacccctcagcccatggagctgaaatactcttggaagacatgggggaaggccaaaatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaagctgcgcgaagtttacacgcaactgtgtgaccaccggcttatgagcgccgctgtgaaagatgagagagccgtgcacgccgacatggggtactggattgagtcccagaagaacggatcttggaaactcgaaaaggctagcctgatcgaggtcaagacatgcacctggcctaaatcccataccctgtggtctaatggcgtgctcgaaagcgatatgattatccccaagtccctggccgggcctattagccagcacaactatcgccccggataccatacacagaccgcgggcccttggcaccttgggaaactggagctcgactttaattattgcgagggaacgacagttgtgatcaccgaaaactgtggcacacggggcccctctctgagaaccacaaccgtctccgggaagctgatccacgagtggtgctgtcgcagctgcacgcttccgcctctccggtacatgggagaagatggctgttggtatgggatggagattagacccatctctgaaaaagaggagaatatggtgaagtccctggttagcgctggatctggcaaggtggacaacttcaccatgggggtcctgtgcctcgccattctgtttgaagaggtgatgcggggaaaattcggcaagaaacatatgatcgccggcgttttctttacattcgtgcttctgctcagcgggcaaattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagaaaacctgcttctgggcgtggggctcgccatggctaccacactgcagctgcctgaggatattgaacaaatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccagtctagctccatgcggaagacggactggctgcccatgacagtggctgccatgggggtgcctcccctccctctgtttatcttctctctcaaagataccctgaagagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaagccgctgacgtgacatgggaggaagaggccgaacaaacgggagtcagccataacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcacacctggcagaagcagacacagcgcagcggggtgctgtgggatgtcccctctcctcccgaaacccaaaaagccgagctcgaagagggagtgtatagaattaagcagcagggcatcttcgggaagacacaggttggagtgggcgtccaaaaagagggggtgtttcataccatgtggcacgtgacacggggagccgttctgacgtacaacggcaagcgcctcgaaccgaattgggcttccgtcaaaaaggacctgattagctatggcgggggatggagactttctgcccagtggcagaaaggcgaggaagtgcaagtgatcgcggtcgagcctgggaagaaccccaagaatttccagaccatgcctggaacattccagaccaccacaggcgaaattggggctatcgccctggattttaaacccggaacgtccggcagccccatcattaaccgggagggcaaggtggttgggctgtacggaaatggcgtggtcaccaaaaacgggggatatgtgtccggcatcgcccagacaaatgctgagcctgacgggccgacccccgaactcgaggaagagatgttcaagaaacgcaacctgacaattatggatcttcaccctggcagcggaaagaccagaaagtacctgcccgccatcgttcgggaagctattaaacgcagactccggacgctgatcctcgcccctacaagagtggtcgcggccgagatggaggaagctctgaagggccttcccatccgctatcaaaccaccgccacaaaatctgagcataccgggcgggaaattgtggacctgatgtgccacgctacatttaccatgagactgctcagccctgttcgcgtgccgaattacaacctgatcattatggatgaggcccatttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaagaccgtgtggttcgtgcctagcattaaagccggcaacgacatcgccaactgtcttagaaagaatggaaagaaagtcattcagctgtcccgcaagacatttgataccgaatatcaaaaaacaaagctcaacgactgggatttcgttgtgaccacagacatctctgagatgggcgctaattttaaagccgatcgggtgattgaccccagacggtgcctgaagcccgtcatcctgaccgatgggcctgagcgcgtgatcctcgcgggacccatgcctgttacggccgctagcgccgctcagagacggggccgcgtggggagaaacccgcagaaggaaaatgaccagtacattttcacaggacaaccccttaacaatgatgaggaccacgcccattggaccgaagctaaaatgctgctggacaacatcaatacccctgagggcattatccccgccctcttcgaacctgagcgggagaagtccgcggccattgatggggaatatagactgaaaggcgagagccgcaagacatttgtcgaacttatgcggagaggagacctgcccgtgtggctcgctcacaaagttgcctctgagggcatcaagtacaccgatcgcaaatggtgcttcgacgggcagcggaacaatcagatcctggaagagaacatggatgtggagatttggacaaaggaaggagagaagaaaaagctgagaccgcgctggctcgacgctcggacgtattccgatcctcttgccctgaaagaatttaaggacttcgccgctggcagaaaaagcatcgcgctggatctcgtcaccgagattgggcgcgtgccctctcacctggcccatagaacacggaatgctcttgacaacctggtcatgctccacacctccgaacatggaggcaaggcctaccgccacgccgtggaggagctgcctgaaacaatggagaccctgctccttctgggcctgatgatcctcctgacggggggagctatgctttttctgattagcggcaaggggatcggaaaaacctccatcggcctcatttgtgttatcgcctctagcgggatgctgtggatggcggaaattcccctgcagtggatcgcctccgctattgtgctcgagttctttatgatggtgcttctgatccctgagcccgaaaagcaaagaacaccgcaggataatcagctggcctatgtcgttattggaatcctcaccctggctgccatcattgcggccaacgagatgggccttctggaaacaaccaaacgggacctcggcatgagcaaggagcctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaagctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaggctaccagagaggcccagaaacggacagctgccggaatcatgaagaaccctaccgtggacggcattatgacgatcgatctcgaccccgtcatttatgatagcaaattcgagaagcaactgggccaggtgatgcttctggttctctgtgccgtgcagctgctgctcatgagaacatcctgggctctttgcgaagccctgaccctggcgaccgggcctatcacaaccctctgggagggatctccgggcaaattttggaatacaacgatcgccgtcagcatggctaacattttccgcgggtcctacctggccggagctggccttgcctttagcatcatgaagtctgtggggaccggaaagcggggcacaggctcccagggggaaaccctgggagagaaatggaagaaaaagctcaatcaactgagcagaaaagaattcgacctgtataagaaatccggcattacagaggtggatcgcaccgaggcgaaggaagggctcaagcggggagagatcacgcatcacgccgtttctagaggcagcgctaaacttcagtggtttgtcgaacggaacatggtgattcccgaggggcgcgtgatcgacctgggatgtggcagaggcgggtggtcctactattgcgccggactgaagaaagtcaccgaagttcggggctacacaaaggggggacctggccatgaggagcccgtgcctatgtctacctacgggtggaatattgtgaaactcatgagcggaaaggatgtcttctatctgcccccggaaaagtgtgacacacttctgtgcgatatcggcgagtccagcccttctcccaccgtggaagagtcccgcacaatcagagttctcaaaatggtggagccctggctgaagaacaatcagttctgtattaaagtcctgaacccttacatgcccaccgtgatcgaacacctcgagcggcttcagcgcaagcacggcgggatgctggttagaaatcctctgagccggaactctacgcatgaaatgtattggatttccaatggaacaggcaacatcgtggctagcgtcaatatggtgtctcgcctcctgcttaacagatttaccatgacccaccggagaccgacaattgagaaagacgtggatctgggggccggaacgcgccatgtcaacgctgaacccgagacccctaatatggacgttatcggcgagcggatcaagagaattaaggaagagcacaacagcacatggcactacgacgatgaaaatccctataaaacctgggcctaccatgggtcctatgaggtgaaggcgacaggatctgccagctccatgatcaacggcgtggtcaaactcctgaccaagccttgggacgtggttcccatggtgacacaaatggctatgaccgatacgaccccgttcggccagcagcgcgtctttaaagaaaaggtggacacacggacccctagaagcatgcccgggacacgccgggttatgggaattaccgccgagtggctgtggagaacgctcggccgcaataagaaacctcggctgtgcacaagagaggaattcaccaagaaagtgcgcacaaacgctgccatgggggccgtctttaccgaggaaaatcaatgggattccgcgaaggctgccgtggaggacgaagatttctggaaacttgttgaccgggagagagagctgcacaagctcggaaaatgtggctcttgcgtgtacaacatgatggggaagcgcgaaaagaaactgggcgagtttggaaaggccaaaggcagcagagctatctggtacatgtggcttggggcccggtatctggaattcgaggctctcggatttctgaatgaggatcattggttctcccgcgaaaactcttacagcggcgtcgagggggaaggactgcacaagctcggctatattctgagagacatctccaaaatccccgggggcgccatgtacgcggatgacacggccggatgggacacccggattacagaggatgaccttcataatgaagagaagatcacccagcagatggatcctgagcacagacagctggctaacgccatttttaagctcacatatcaaaataaagtggtcaaggtgcagcggcccaccccgacaggcaccgttatggacatcatttctcgcaaagatcagagagggagcggacaggtgggcacgtacgggctgaacacattcaccaatatggaagctcaacttatccggcagatggagggagaaggcgtcctgtccaaggccgacctcgagaaccctcacctgcccgaaaaaaagatcacccagtggctggagacaaagggggtggagcgcctcaaaagaatggcgattagcggcgatgactgcgtggttaagcccatcgatgaccggtttgccaacgctctgcttgccctgaatgatatgggaaaagtgcgcaaggacattcctcagtggcaaccgtctaaaggctggcatgattggcagcaggtccccttctgttcccaccatttccacgaactcatcatgaaggacgggagaaagctggtggttccttgccggccccaggacgagcttattggacgcgctagaatcagccaaggcgccgggtggtctctgcgggaaaccgcttgtctcggaaaagcctatgcgcagatgtggtccctgatgtactttcaccgcagagatctgcggctcgccagcaacgctatttgctctgccgtgcctgtccattgggtgcccacatcccgcacgacctggagcatccacgcccatcaccagtggatgacaaccgaggacatgctgacagtctggaatagagtgtggatcgaagataacccttggatggaggacaagacccccgttacgacctgggagaatgtgccgtaccttggcaaacgggaagatcaatggtgtgggtccctgattggcctcacaagcagagctacctgggcccagaacatccctacagcgattcagcaggtccgctctctgatcggaaatgaggaattccttgactatatgcccagcatgaagcggtttagaaaagaggaggaatccgagggcgctatttggtga

SEQ ID NO: 20678 - RNA, 9873 nt, synthetic construct
  misc_feature 1..9873: note = derived and/or modified CDS sequence (opt5) from DENV-3__EU726772__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatgacagtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaggccgctgacgtgacatgggaggaagaggccgaacagacgggagtcagccataacctcatgatcaccgtggacgatgacggcacaatgcggattaaagatgacgagaccgagaatatcctgacagtccttctgaagaccgcgctgctcatcgtgtctggcatttttccgtactccatccctgctacgctgcttgtttggcacacctggcagaaacagacacaacgcagcggggtgctgtgggatgtcccctctcctcccgaaacccagaaggccgagctcgaagagggagtgtatagaattaaacagcagggcatcttcgggaagacacaagttggagtgggcgtccagaaggagggggtgtttcataccatgtggcacgtgacacggggagccgttctgacgtacaacggcaaacgcctcgaaccgaattgggcttccgtcaagaaagacctgattagctatggcgggggatggagactttctgcccagtggcaaaagggcgaggaagtccaggtgatcgcggtcgagcctgggaaaaaccccaagaatttccagaccatgcctggaacattccagaccaccacaggcgaaattggggctatcgccctggattttaagcccggaacgtccggcagccccatcattaaccgggagggcaaagtggttgggctgtacggaaatggcgtggtcaccaagaacgggggatatgtgtccggcatcgcccaaacaaatgctgagcctgacgggccgacccccgaactcgaggaagagatgttcaaaaagcgcaacctgacaattatggatcttcaccctggcagcggaaaaaccagaaagtacctgcccgccatcgttcgggaagctattaagcgcagactccggacgctgatcctcgcccctacaagagtggtcgcggccgagatggaggaagctctgaaaggccttcccatccgctatcagaccaccgccacaaagtctgagcataccgggcgggaaattgtggacctgatgtgccacgctacatttaccatgagactgctcagccctgttcgcgtgccgaattacaacctgatcattatggatgaggcccatttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaaaaccgtgtggttcgtgcctagcattaaggccggcaacgacatcgccaactgtcttcgcaaaaatggaaagaaggtcattcaactgtccagaaaaacatttgataccgaatatcagaagacaaaactcaacgactgggatttcgttgtgaccacagacatctctgagatgggcgctaattttaaggccgatcgggtgattgaccccagacggtgcctgaaacccgtcatcctgaccgatgggcctgagcgcgtgatcctcgcgggacccatgcctgttacggccgctagcgccgctcagagacggggccgcgtggggagaaacccgcagaaggaaaatgaccaatacattttcacaggacagccccttaacaatgatgaggaccacgcccattggaccgaagctaagatgctgctggacaacatcaatacccctgagggcattatccccgccctcttcgaacctgagcgggagaaatccgcggccattgatggggaatatagactgaagggcgagagccgcaaaacatttgtcgaacttatgcggagaggagacctgcccgtgtggctcgctcacaaggttgcctctgagggcatcaaatacaccgatcgcaagtggtgcttcgacgggcagcggaacaatcagatcctggaagagaacatggatgtggagatttggacaaaagaaggagagaagaagaaactgagaccgcgctggctcgacgctcggacgtattccgatcctcttgccctgaaggaatttaaagacttcgccgctggcagaaagagcatcgcgctggatctcgtcaccgagattgggcgcgtgccctctcacctggcccatagaacacggaatgctcttgacaacctggtcatgctccacacctccgaacatggaggcaaagcctaccgccacgccgtggaggagctgcctgaaacaatggagaccctgctccttctgggcctgatgatcctcctgacagggggagctatgctttttctgattagcggcaaggggatcggaaagacctccatcggcctcatttgtgttatcgcctctagcgggatgctgtggatggcggaaattcccctgcaatggatcgcctccgctattgtgctcgagttctttatgatggtgcttctgatccctgagcccgaaaaacagagaacaccgcaggataatcaactggcctatgtcgttattggaatcctcaccctggctgccatcattgcggccaacgagatgggccttctggaaacaaccaagcgggacctcggcatgagcaaagagcctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaagggctggccgatttccaaaatggatctgggggtcccccttctggccctcggatgctattctcaggtgaatcctctgacgctgaccgctgccgttctccttctgatcacacactacgccatcattggccccgggctgcaggcgaaggctaccagagaggcccaaaagcggacagctgccggaatcatgaaaaaccctaccgtggacggcattatgacgatcgatctcgaccccgtcatttatgatagcaagttcgagaaacagctgggccaggtgatgcttctggttctctgtgccgtgcagctgctgctcatgagaacatcctgggctctttgcgaagccctgaccctggcgaccgggcctatcacaaccctctgggagggatctccgggcaagttttggaatacaacgatcgccgtcagcatggctaacattttccgcgggtcctacctggccggagctggccttgcctttagcatcatgaaatctgtggggaccggaaagcggggcacaggctcccaaggggaaaccctgggagagaagtggaaaaagaaactcaatcagctgagcagaaaggagttcgacctgtataaaaagtccggcattacagaggtggatcgcaccgaggcgaaagaagggctcaagcggggagagatcacgcatcacgccgtttctagaggcagcgctaaacttcagtggtttgtcgaacggaacatggtgattcccgaggggcgcgtgatcgacctgggatgtggcagaggcgggtggtcctactattgcgccggactgaaaaaggtcaccgaagttcggggctacacaaaagggggacctggccatgaggagcccgtgcctatgtctacctacgggtggaatattgtgaagctcatgagcggaaaagatgtcttctatctgcccccggaaaagtgtgacacacttctgtgcgatatcggcgagtccagcccttctcccaccgtggaagagtcccgcacaatcagagttctcaagatggtggagccctggctgaaaaacaatcagttctgtattaaggtcctgaacccttacatgcccaccgtgatcgaacacctcgagcggcttcaacgcaaacacggcgggatgctggttagaaatcctctgagccggaactctacgcatgaaatgtattggatttccaatggaacaggcaacatcgtggctagcgtcaatatggtgtctcgcctcctgcttaacagatttaccatgacccaccggagaccgacaattgagaaggacgtggatctgggggccggaacgcgccatgtcaacgctgaacccgagacccctaatatggacgttatcggcgagcggatcaaaagaattaaggaagaacacaacagcacatggcactacgacgatgaaaatccctataagacctgggcctaccatgggtcctatgaggtgaaagcgacaggatctgccagctccatgatcaacggcgtggtcaagctcctgaccaaaccttgggacgtggttcccatggtgacacagatggctatgaccgatacgaccccgttcggccagcaacgcgtctttaaggaaaaagtggacacacggacccctagaagcatgcccgggacacgccgggttatgggaattaccgccgagtggctgtggagaacgctcggccgcaataagaagcctcggctgtgcacaagagaggagttcaccaaaaaggtgcgcacaaacgctgccatgggggccgtctttaccgaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatctggtacatgtggcttggggcccggtatctggagttcgaggctctcggatttctgaatgaggatcattggttctcccgcgaaaactcttacagcggcgtcgagggggaaggactgcacaaactcggctatattctgagagacatctccaagatccccgggggcgccatgtacgcggatgacacggccggatgggacacccggattacagaggatgaccttcataatgaagagaaaatcacccagcagatggatcctgagcacagacaactggctaacgccatttttaagctcacatatcagaataaggtggtcaaagtgcagcggcccaccccgacaggcaccgttatggacatcatttctcgcaaggatcagagagggagcggacaagtgggcacgtacgggctgaacacattcaccaatatggaagctcagcttatccggcagatggagggagaaggcgtcctgtccaaagccgacctcgagaaccctcatctgcccgaaaagaaaatcacccagtggctggagacaaagggggtggagcgcctcaagagaatggcgattagcggcgatgactgcgtggttaaacccatcgatgaccggtttgccaacgctctgcttgccctgaatgatatgggaaagggccgcaaagacattcctcaatggcagccgtctaaggggtggcatgattggcaacaggtgcccttctgttcccaccatttccacgaactcatcatgaaagacggaagaaagctggtcgtgccttgccggccccaagacgagcttattggccgcgctagaatcagccagggggccggatggtctctgcgggaaaccgcttgtctcggcaaggcctatgcgcagatgtggtccctgatgtactttcaccgcagagatctgcggctcgccagcaacgctatttgctctgccgttcctgtgcattgggtccccacatcccgcacgacctggagcatccacgcccatcaccaatggatgacaaccgaggacatgctgacagtgtggaatagagtctggatcgaagataacccttggatggaggacaaaacccccgtgacgacctgggagaatgttccgtaccttgggaagcgggaagatcagtggtgtggctccctgattggactcacaagcagagctacctgggcccagaacatccctacagcgattcagcaagtgcgctctctgatcggcaatgaggagttccttgactatatgcccagcatgaaacggtttagaaaggaggaggaatccgagggggctatttggtga

SEQ ID NO: 20679 - RNA, 9873 nt, synthetic construct
  misc_feature 1..9873: note = derived and/or modified CDS sequence (opt5) from DENV-3__FJ182013__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacgtggggacgtccctcacacagaaggtcgtgatcttcattctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacagctggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctagaggggcgagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcaaggtcgacaacttcaccatgggggtgctgtgcctcgccatcctgtttgaagaggttatgcggggaaagttcggcaaaaagcatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaaaatccagcccttcctggccctcggatttttcctgcggaagctcacatctagagaaaacctgcttctgggcgtggggctcgccatggctaccacactgcaactgcctgaggatatcgaacagatggccaatggaattgctcttggcctgatggccctcaaactgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaagacggactggctgcccatggctgtggccgccatgggggtccctcccctccctctgtttatcttctctctcaaggatacactgaaaagacgcagctggccccttaatgagggagtgatggctgttggcctggtgtccatcctggcgtctagcctcctgagaaacgacgtccctatggccgggccccttgtggctggaggcctgctcattgcctgttacgttatcaccgggacctccgccgatctgacagtggaaaaggctgccgacgtcacctgggaggaagaggcggaacagacaggagtgagccataacctcatgattacggtcgacgatgacggcaccatgcggatcaaagatgacgagacagagaatattctgaccgtgcttctgaagacagctctgctcatcgtttctggcatctttccgtactccattcctgccaccctgcttgtgtggcacacgtggcagaaacagacccaacgcagcggggtcctgtgggatgtgccctctcctcccgaaacacagaaggccgagctcgaagagggagtttatagaatcaaacagcagggcattttcgggaagacccaagtgggagtcggcgtgcagaaggagggggtgtttcatacaatgtggcacgttacccggggagctgtcctgacatacaacggcaaacgcctcgaaccgaattgggcctccgtgaagaaagacctgatcagctatggcgggggatggagactttctgcgcagtggcaaaagggcgaggaagtgcaggtcattgctgtggagcctgggaaaaaccccaagaatttccagacgatgcctggaaccttccagacaaccaccggcgaaatcggggccattgccctggattttaagcccggaacatccggcagccccatcatcaaccgggagggcaaagttgtggggctgtacggaaatggcgtcgtgacgaagaacgggggatatgtttccggcattgctcaaaccaatgccgagcctgacgggccgacacccgaactcgaggaagagatgttcaaaaagcgcaacctgaccatcatggatcttcaccctggcagcggaaaaacaagaaagtacctgcccgctattgtgcgggaagccatcaagcgcagactccggaccctgattctcgcgcctacgagagtcgtggccgctgagatggaggaagccctgaaaggccttcccatccgctatcagacaaccgctaccaagtctgagcatacagggcgggaaatcgttgacctgatgtgccacgccacctttacaatgagactgctcagccctgtgcgcgtcccgaattacaacctgattatcatggatgaggcccatttcaccgaccccgcttccattgcggcccggggatacatctctacgagagtgggcatgggggaagctgccgccatttttatgacagctacccctcccggaacagccgatgcgttccctcagagcaatgctcccatccaggacgaggagcgcgacatcccggaacggtcctggaactctggcaatgagtggattaccgattttgccgggaaaacggtgtggttcgtccctagcatcaaggccggcaacgacattgctaactgtcttcgcaaaaatggaaagaaggttatccaactgtccagaaaaacctttgatacagaatatcagaagaccaaactcaacgactgggatttcgtggtgacaaccgacatttctgagatgggcgccaattttaaggcggatcgggtcatcgaccccagacggtgcctgaaacccgtgattctgacagatgggcctgagcgcgttatcctcgccggacccatgcctgtgaccgctgccagcgctgcccagagacggggccgcgtcgggagaaacccgcagaaggaaaatgaccaatacatcttcacgggacagccccttaacaatgatgaggaccacgctcattggacagaagccaagatgctgctggacaacattaatacccctgagggcatcattcccgccctcttcgaacctgagcgggagaaatccgccgctatcgatggggaatatagactgaagggcgagagccgcaaaacctttgtggaacttatgcggagaggagacctgcccgtttggctcgcccacaaggtggcttctgagggcattaaatacacagatcgcaagtggtgcttcgacgggcagcggaacaatcagatcctggaagagaacatggatgtcgagatctggaccaaagaaggagagaagaagaaactgagaccgcgctggctcgacgcccggacatattccgatcctcttgccctgaaggaatttaaagacttcgctgcgggcagaaagagcattgccctggatctcgtgacggagatcgggcgcgtcccctctcacctggctcatagaacccggaatgcccttgacaacctggtgatgctccacacatccgaacatggaggcaaagcctaccgccacgctgttgaggagctgcctgaaaccatggagacactgctccttctgggcctgatgattctcctgaccgggggagccatgctttttctgatcagcggcaaggggattggaaagacgtccatcggcctcatctgtgtgattgcgtctagcgggatgctgtggatggccgaaatccccctgcaatggattgcttccgccatcgtgctcgagttctttatgatggtccttctgattcctgagcccgaaaaacagagaaccccgcaggataatcaactggcttatgttgtgatcggcattctcacactggccgcgatcatcgccgctaacgagatgggccttctggaaaccacaaagcgggacctcggcatgagcaaagagcctggggtggtctctcccacctcctacctggatgtggacctgcaccccgccagcgcttggacgctctacgccgttgctacaaccgtgattacacctatgcttcgccataccatcgaaaattctaccgccaacgtcagcctggcggccattgctaaccaggccgtggtcctgatgggactcgacaagggctggccgatctccaaaatggatctgggggtgccccttctggctctcggatgctattctcaggttaatcctctgacactgacggccgccgtgctccttctgattacccactacgcgatcatcggccccgggctgcaggctaaggccacaagagaggctcaaaagcggaccgccgccggaattatgaaaaaccctacagtcgacggcatcatgaccattgatctcgaccccgtgatctatgatagcaagttcgagaaacagctgggccaggttatgcttctggtgctctgtgctgtccagctgctgctcatgagaacgtcctgggccctttgcgaagcgctgacactggccaccgggcctattaccacactctgggagggatctccgggcaagttttggaataccacaatcgctgtgagcatggccaacatcttccgcgggtcctacctggctggagccggccttgcgtttagcattatgaaatctgtggggacgggaaagcggggcaccggctcccaaggggaaacactgggagagaagtggaaaaagaaactcaatcagctgagcagaaaggagttcgacctgtataaaaagtccggcatcaccgaggttgatcgcacagaggccaaagaagggctcaagcggggagagattacccatcacgctgtctctagaggcagcgccaaacttcagtggtttgtggaacggaacatggtgatccccgaggggcgcgtcattgacctgggatgtggcagaggcgggtggtcctactattgcgctggactgaaaaaggttacggaagtgcggggctacaccaaagggggacctggccatgaggagcccgtgcctatgtctacatacgggtggaatatcgtcaagctcatgagcggaaaagatgtgttctatctgcccccggaaaagtgtgacacccttctgtgcgatattggcgagtccagcccttctcccacagttgaagagtcccgcaccatcagagtgctcaagatggtcgagccctggctgaaaaacaatcagttctgtatcaaggtgctgaacccttacatgcccacagttattgaacacctcgagcggcttcaacgcaaacacggcgggatgctggtgagaaatcctctgagccggaactctacccatgaaatgtattggatctccaatggaacgggcaacattgtcgccagcgtgaatatggtgtctcgcctcctgcttaacagatttacaatgacccaccggagaccgaccatcgagaaggacgtcgatctgggggctggaacacgccatgttaacgccgaacccgagacgcctaatatggacgtgattggcgagcggatcaaaagaatcaaggaagaacacaacagcacctggcactacgacgatgaaaatccctataagacatgggcgtaccatgggtcctatgaggtgaaagccaccggatctgctagctccatgattaacggcgtcgtgaagctcctgacaaaaccttgggacgttgtgcccatggtcacccagatggccatgacagataccacgccgttcggccagcaacgcgtgtttaaggaaaaagttgacacccggacacctagaagcatgcccgggacccgccgggtgatgggaatcacagctgagtggctgtggagaaccctcggccgcaataagaagcctcggctgtgcacgagagaggagttcaccaagaaggtccgcaccaacgccgccatgggggcggtgtttacagaggaaaatcagtgggattccgctaaagccgccgttgaggacgaagatttctggaaacttgtggaccgggagagagagctgcacaaactcggaaagtgtggctcttgcgtctacaacatgatggggaaacgcgaaaagaagctgggcgagtttggaaaagctaagggcagcagagccatttggtacatgtggcttggggctcggtatctggagttcgaggccctcggatttctgaatgaggatcattggttctcccgcgaaaactcttacagcggcgtggagggggaaggactgcacaaactcggctatatcctgagagacatttccaagatccccgggggcgcgatgtacgccgatgacaccgctggatgggacacgcggatcaccgaggatgaccttcataatgaagagaaaattacacagcagatggatcctgagcacagacaactggccaacgctatctttaagctcacctatcagaataaggtcgtgaaagttcagcggcccacaccgaccggcacagtgatggacattatctctcgcaaggatcagagagggagcggacaagtcggcacctacgggctgaacacgttcacaaatatggaagcccagcttattcggcagatggagggagaaggcgtgctgtccaaagcggacctcgagaaccctcatctgcccgaaaagaaaatcacccagtggctggagaccaagggggtggagcgcctcaagagaatggccatcagcggcgatgactgcgttgtgaaacccattgatgaccggtttgctaacgccctgcttgctctgaatgatatgggaaaggtccgcaaagacatccctcaatggcagccgtctaagggctggcatgattggcaacaggtgcccttctgttcccaccatttccacgaactcattatgaaagacgggagaaagctggttgtgccttgccggccccaagacgagcttatcggacgcgccagaattagccagggcgctgggtggtctctgcgggaaacagcctgtctcggaaaggcgtatgcccagatgtggtccctgatgtactttcaccgcagagatctgcggctcgctagcaacgccatctgctctgccgtccctgtgcattgggtccccacctcccgcacaacgtggagcattcacgctcatcaccaatggatgaccacagaggacatgctgaccgtgtggaatagagtttggatcgaagataacccttggatggaggacaaaacacccgtgaccacgtgggagaatgtcccgtaccttggcaagcgggaagatcagtggtgtgggtccctgatcggcctcaccagcagagccacatgggcgcagaacattcctaccgctatccagcaagtgcgctctctgattggaaatgaggagttccttgactatatgcccagcatgaaacggtttagaaaggaggaggaatccgagggcgccatctggtga

SEQ ID NO: 20680 - RNA, 9873 nt, synthetic construct
  misc_feature 1..9873: note = derived and/or modified CDS sequence (opt5) from DENV-3__EU781136__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcgtgaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcaaggtcgacaacttcaccatgggggtgctgtgcctcgccatcctgtttgaagaggttatgcggggaaagttcggcaaaaagcatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaaaatccagcccttcctggccctcggatttttcctgcggaagctcacatctagagaaaacctgcttctgggcgtggggctcgccatggctaccacactgcaactgcctgaggatatcgaacagatggccaatggaattgctcttggcctgatggccctcaaactgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaagacggactggctgcccatgacagtggctgccatgggggtccctcccctccctctgtttatcttctctctcaaggataccctgaaaagacgcagctggccccttaatgagggagtgatggccgttggcctggtgtccatcctggcttctagcctcctgagaaacgacgtccctatggcggggccccttgtggccggaggcctgctcattgcttgttacgttatcaccgggacatccgccgatctgaccgtggaaaaggccgctgacgtcacatgggaggaagaggccgaacagacgggagtgagccataacctcatgattaccgtcgacgatgacggcacaatgcggatcaaagatgacgagaccgagaatattctgacagtgcttctgaagaccgcgctgctcatcgtttctggcatctttccgtactccattcctgctacgctgcttgtgtggcacacctggcagaaacagacacaacgcagcggggtcctgtgggatgtgccctctcctcccgaaacccagaaggccgagctcgaagagggagtttatagaatcaaacagcagggcattttcgggaagacacaagtgggagtcggcgtgcagaaggagggggtgtttcataccatgtggcacgttacacggggagccgtcctgacgtacaacggcaaacgcctcgaaccgaattgggcttccgtgaagaaagacctgatcagctatggcgggggatggagactttctgcccagtggcaaaagggcgaggaagtgcaggtcattgcggtggagcctgggaaaaaccccaagaatttccagaccatgcctggaacattccagaccaccacaggcgaaatcggggctattgccctggattttaagcccggaacgtccggcagccccatcatcaaccgggagggcaaagttgtggggctgtacggaaatggcgtcgtgaccaagaacgggggatatgtttccggcattgcccaaacaaatgctgagcctgacgggccgacccccgaactcgaggaagagatgttcaaaaagcgcaacctgacaatcatggatcttcaccctggcagcggaaaaaccagaaagtacctgcccgccattgtgcgggaagctatcaagcgcagactccggacgctgattctcgcccctacaagagtcgtggcggccgagatggaggaagctctgaaaggccttcccatccgctatcagaccaccgccacaaagtctgagcataccgggcgggaaatcgttgacctgatgtgccacgctacatttaccatgagactgctcagccctgtgcgcgtcccgaattacaacctgattatcatggatgaggcccatttcacggaccccgcctccattgctgcgcggggatacatctctacaagagtgggcatgggggaagccgctgccatttttatgaccgccacacctcccggaaccgctgatgccttccctcagagcaatgcgcccatccaggacgaggagcgcgacatcccggaacggtcctggaactctggcaatgagtggattacggattttgctgggaaaaccgtgtggttcgtccctagcatcaaggccggcaacgacattgccaactgtcttcgcaaaaatggaaagaaggttatccaactgtccagaaaaacatttgataccgaatatcagaagacaaaactcaacgactgggatttcgtggtgaccacagacatttctgagatgggcgctaattttaaggccgatcgggtcatcgaccccagacggtgcctgaaacccgtgattctgaccgatgggcctgagcgcgttatcctcgcgggacccatgcctgtgacggccgctagcgccgctcagagacggggccgcgtcgggagaaacccgcagaaggaaaatgaccaatacatcttcacaggacagccccttaacaatgatgaggaccacgcccattggaccgaagctaagatgctgctggacaacattaatacccctgagggcatcattcccgccctcttcgaacctgagcgggagaaatccgcggccatcgatggggaatatagactgaagggcgagagccgcaaaacatttgtggaacttatgcggagaggagacctgcccgtttggctcgctcacaaggtggcctctgagggcattaaatacaccgatcgcaagtggtgcttcgacgggcagcggaacaatcagatcctggaagagaacatggatgtcgagatctggacaaaagaaggagagaagaagaaactgagaccgcgctggctcgacgctcggacgtattccgatcctcttgccctgaaggaatttaaagacttcgccgctggcagaaagagcattgcgctggatctcgtgaccgagatcgggcgcgtcccctctcacctggcccatagaacacggaatgctcttgacaacctggtgatgctccacacctccgaacatggaggcaaagcctaccgccacgccgttgaggagctgcctgaaacaatggagaccctgctccttctgggcctgatgattctcctgacagggggagctatgctttttctgatcagcggcaaggggattggaaagacctccatcggcctcatctgtgtgattgcctctagcgggatgctgtggatggcggaaatccccctgcaatggattgcctccgctatcgtgctcgagttctttatgatggtccttctgattcctgagcccgaaaaacagagaacaccgcaggataatcaactggcctatgttgtgatcggcattctcaccctggctgccatcatcgcggccaacgagatgggccttctggaaacaaccaagcgggacctcggcatgagcaaagagcctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaagggctggccgatctccaaaatggatctgggggtgccccttctggccctcggatgctattctcaggttaatcctctgacgctgaccgctgccgtgctccttctgattacacactacgccatcatcggccccgggctgcaggcgaaggctaccagagaggcccaaaagcggacagctgccggaattatgaaaaaccctaccgtcgacggcatcatgacgattgatctcgaccccgtgatctatgatagcaagttcgagaaacagctgggccaggttatgcttctggtgctctgtgccgtccagctgctgctcatgagaacatcctgggctctttgcgaagccctgaccctggcgaccgggcctattacaaccctctgggagggatctccgggcaagttttggaatacaacgatcgccgtgagcatggctaacatcttccgcgggtcctacctggccggagctggccttgcctttagcattatgaaatctgtggggaccggaaagcggggcacaggctcccaaggggaaaccctgggagagaagtggaaaaagaaactcaatcagctgagcagaaaggagttcgacctgtataaaaagtccggcatcacagaggttgatcgcaccgaggcgaaagaagggctcaagcggggagagattacgcatcacgccgtctctagaggcagcgctaaacttcagtggtttgtggaacggaacatggtgatccccgaggggcgcgtcattgacctgggatgtggcagaggcgggtggtcctactattgcgccggactgaaaaaggttaccgaagtgcggggctacacaaaagggggacctggccatgaggagcccgtgcctatgtctacctacgggtggaatatcgtcaagctcatgagcggaaaagatgtgttctatctgcccccggaaaagtgtgacacacttctgtgcgatattggcgagtccagcccttctcccaccgttgaagagtcccgcacaatcagagtgctcaagatggtcgagccctggctgaaaaacaatcagttctgtatcaaggtgctgaacccttacatgcccaccgttattgaacacctcgagcggcttcaacgcaaacacggcgggatgctggtgagaaatcctctgagccggaactctacgcatgaaatgtattggatctccaatggaacaggcaacattgtcgctagcgtgaatatggtgtctcgcctcctgcttaacagatttaccatgacccaccggagaccgacaatcgagaaggacgtcgatctgggggccggaacgcgccatgttaacgctgaacccgagacccctaatatggacgtgattggcgagcggatcaaaagaatcaaggaagaacacaacagcacatggcactacgacgatgaaaatccctataagacctgggcctaccatgggtcctatgaggtgaaagcgacaggatctgccagctccatgattaacggcgtcgtgaagctcctgaccaaaccttgggacgttgtgcccatggtcacacagatggctatgaccgatacgaccccgttcggccagcaacgcgtgtttaaggaaaaagttgacacacggacccctagaagcatgcccgggacacgccgggtgatgggaatcaccgccgagtggctgtggagaacgctcggccgcaataagaagcctcggctgtgcacaagagaggagttcaccaaaaaggtccgcacaaacgctgccatgggggccgtgtttaccgaggaaaatcagtgggattccgcgaaagctgccgttgaggacgaagatttctggaaacttgtggaccgggagagagagctgcacaaactcggaaagtgtggctcttgcgtctacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtggagggggaaggactgcacaaactcggctatatcctgagagacatttccaagatccccgggggcgccatgtacgcggatgacacggccggatgggacacccggatcacagaggatgaccttcataatgaagagaaaattacccagcagatggatcctgagcacagacaactggctaacgccatctttaagctcacatatcagaataaggtcgtgaaagttcagcggcccaccccgacaggcaccgtgatggacattatctctcgcaaggatcagagagggagcggacaagtcggcacgtacgggctgaacacattcaccaatatggaagctcagcttattcggcagatggagggagaaggcgtgctgtccaaagccgacctcgagaaccctcatctgcccgaaaagaaaatcacccagtggctggagacaaagggggtggagcgcctcaagagaatggcgatcagcggcgatgactgcgttgtgaaacccattgatgaccggtttgccaacgctctgcttgccctgaatgatatgggaaaggtccgcaaagacatccctcaatggcagccgtctaagggctggcatgattggcaacaggtgcccttctgttcccaccatttccacgaactcattatgaaagacgggagaaagctggttgtgccttgccggccccaagacgagcttatcggacgcgctagaattagccagggcgccgggtggtctctgcgggaaaccgcttgtctcggaaaggcctatgcgcagatgtggtccctgatgtactttcaccgcagagatctgcggctcgccagcaacgctatctgctctgccgtccctgtgcattgggtccccacatcccgcacgacctggagcattcacgcccatcaccaatggatgacaaccgaggacatgctgacagtgtggaatagagtttggatcgaagataacccttggatggaggacaaaacccccgtgacgacctgggagaatgtcccgtaccttggcaagcgggaagatcagtggtgtgggtccctgatcggcctcacaagcagagctacctgggcccagaacattcctacagcgatccagcaagtgcgctctctgattggaaatgaggagttccttgactatatgcccagcatgaaacggtttagaaaggaggaggaatccgagggcgctatctggtga

SEQ ID NO: 20681 - RNA, 9873 nt, synthetic construct
  misc_feature 1..9873: note = derived and/or modified CDS sequence (opt5) from DENV-3__EU781137__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaaaatccagcccttcctggccctcggatttttcctgcggaagctcacctctagagaaaacctgcttctgggcgtggggctcgccatggctacaaccctgcaactgcctgaggatatcgaacagatggccaatggaattgctcttggcctgatggccctcaaactgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaagacagactggctgcccatgaccgtggctgccatgggggtgcctcccctccctctgtttatcttctctctcaaggataccctgaaaagacgcagctggccccttaatgagggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgaaaaggccgctgacgtgacgtgggaggaagaggccgaacagaccggagtcagccataacctcatgattacagtggacgatgacggcaccatgcggatcaaagatgacgagacagagaatattctgaccgtccttctgaagacggcgctgctcatcgtgtctggcatctttccgtactccattcctgctaccctgcttgtttggcacacatggcagaaacagacccaacgcagcggggtgctgtgggatgtcccctctcctcccgaaacacagaaggccgagctcgaagagggagtgtatagaatcaaacagcagggcattttcgggaagacccaagttggagtgggcgtccagaaggagggggtgtttcatacaatgtggcacgtgacgcggggagccgttctgacctacaacggcaaacgcctcgaaccgaattgggcttccgtcaagaaagacctgatcagctatggcgggggatggagactttctgcccagtggcaaaagggcgaggaagtccaggtgattgcggtcgagcctgggaaaaaccccaagaatttccagacaatgcctggaaccttccagaccacaacgggcgaaatcggggctattgccctggattttaagcccggaacctccggcagccccatcatcaaccgggagggcaaagtggttgggctgtacggaaatggcgtggtcacaaagaacgggggatatgtgtccggcattgcccaaaccaatgctgagcctgacgggccgacacccgaactcgaggaagagatgttcaaaaagcgcaacctgaccatcatggatcttcaccctggcagcggaaaaacgagaaagtacctgcccgccattgttcgggaagctatcaagcgcagactccggacactgattctcgcccctaccagagtggtcgcggccgagatggaggaagctctgaaaggccttcccatccgctatcagaccacagccaccaagtctgagcatacagggcgggaaatcgtggacctgatgtgccacgctacctttacgatgagactgctcagccctgttcgcgtgccgaattacaacctgattatcatggatgaggcccatttcacagaccccgcctccattgctgcgcggggatacatctctaccagagtcggcatgggggaagccgctgccatttttatgacagccacccctcccggaacggctgatgccttccctcagagcaatgcgcccatccaggacgaggagcgcgacatcccggaacggtcctggaactctggcaatgagtggattaccgattttgctgggaaaacagtgtggttcgtgcctagcatcaaggccggcaacgacattgccaactgtcttcgcaaaaatggaaagaaggtcatccaactgtccagaaaaacctttgatacagaatatcagaagaccaaactcaacgactgggatttcgttgtgacaaccgacatttctgagatgggcgctaattttaaggccgatcgggtgatcgaccccagacggtgcctgaaacccgtcattctgacggatgggcctgagcgcgtgatcctcgcgggacccatgcctgttacagccgctagcgccgctcagagacggggccgcgtggggagaaacccgcagaaggaaaatgaccaatacatcttcaccggacagccccttaacaatgatgaggaccacgcccattggaccgaagctaagatgctgctggacaacattaatacacctgagggcatcattcccgccctcttcgaacctgagcgggagaaatccgcggccatcgatggggaatatagactgaagggcgagagccgcaaaacctttgtcgaacttatgcggagaggagacctgcccgtgtggctcgctcacaaggttgcctctgagggcattaaatacacagatcgcaagtggtgcttcgacgggcagcggaacaatcagatcctggaagagaacatggatgtggagatctggacgaaagaaggagagaagaagaaactgagaccgcgctggctcgacgctcggacctattccgatcctcttgccctgaaggaatttaaagacttcgccgctggcagaaagagcattgcgctggatctcgtcacagagatcgggcgcgtgccctctcacctggcccatagaacccggaatgctcttgacaacctggtcatgctccacacatccgaacatggaggcaaagcctaccgccacgccgtggaggagctgcctgaaaccatggagacgctgctccttctgggcctgatgattctcctgaccgggggagctatgctttttctgatcagcggcaaggggattggaaagacatccatcggcctcatctgtgttattgcctctagcgggatgctgtggatggcggaaatccccctgcaatggattgcctccgctatcgtgctcgagttctttatgatggtgcttctgattcctgagcccgaaaaacagagaaccccgcaggataatcaactggcctatgtcgttatcggcattctcacactggctgccatcatcgcggccaacgagatgggccttctggaaaccacgaagcgggacctcggcatgagcaaagagcctggggtggtgtctcccacatcctacctggatgtcgacctgcaccccgctagcgcctggaccctctacgctgtggccacaaccgttattacccctatgcttcgccatacaatcgaaaattctacggctaacgtgagcctggccgcgattgccaaccaggctgtcgtgctgatgggactcgacaagggctggccgatctccaaaatggatctgggggtcccccttctggccctcggatgctattctcaggtgaatcctctgaccctgacagctgccgttctccttctgattacccactacgccatcatcggccccgggctgcaggcgaaggctacaagagaggcccaaaagcggaccgctgccggaattatgaaaaaccctacggtggacggcatcatgacaattgatctcgaccccgtcatctatgatagcaagttcgagaaacagctgggccaggtgatgcttctggttctctgtgccgtgcagctgctgctcatgagaacctcctgggctctttgcgaagccctgaccctggcgacagggcctattaccacactctgggagggatctccgggcaagttttggaatacgaccatcgccgtcagcatggctaacatcttccgcgggtcctacctggccggagctggccttgcctttagcattatgaaatctgtggggacaggaaagcggggcaccggctcccaaggggaaacactgggagagaagtggaaaaagaaactcaatcagctgagcagaaaggagttcgacctgtataaaaagtccggcatcaccgaggtggatcgcacggaggcgaaagaagggctcaagcggggagagattacccatcacgccgtttctagaggcagcgctaaacttcagtggtttgtcgaacggaacatggtgatccccgaggggcgcgtgattgacctgggatgtggcagaggcgggtggtcctactattgcgccggactgaaaaaggtcacagaagttcggggctacaccaaagggggacctggccatgaggagcccgtgcctatgtctacatacgggtggaatatcgtgaagctcatgagcggaaaagatgtcttctatctgcccccggaaaagtgtgacacccttctgtgcgatattggcgagtccagcccttctcccacagtggaagagtcccgcaccatcagagttctcaagatggtggagccctggctgaaaaacaatcagttctgtatcaaggtcctgaacccttacatgcccacggtgattgaacacctcgagcggcttcaacgcaaacacggcgggatgctggttagaaatcctctgagccggaactctacacatgaaatgtattggatctccaatggaaccggcaacattgtggctagcgtcaatatggtgtctcgcctcctgcttaacagatttaccatgacacaccggagaccgacgatcgagaaggacgtggatctgggggccggaacccgccatgtcaacgctgaacccgagacacctaatatggacgttattggcgagcggatcaaaagaatcaaggaagaacacaacagcacctggcactacgacgatgaaaatccctataagacatgggcctaccatgggtcctatgaggtgaaagcgaccggatctgccagctccatgattaacggcgtggtcaagctcctgacaaaaccttgggacgtggttcccatggtgacccagatggctatgacggataccacaccgttcggccagcaacgcgtctttaaggaaaaagtggacacccggacacctagaagcatgcccgggacccgccgggttatgggaatcacggccgagtggctgtggagaacactcggccgcaataagaagcctcggctgtgcaccagagaggagttcaccaagaaggtgcgcaccaacgctgccatgggggccgtctttacggaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtcgagggggaaggactgcacaaactcggctatatcctgagagacatttccaagatccccgggggcgccatgtacgcggatgacaccgccggatgggacacacggatcaccgaggatgaccttcataatgaagagaaaattacacagcagatggatcctgagcacagacaactggctaacgccatctttaagctcacctatcagaataaggtggtcaaagtgcagcggcccacaccgaccggcacggttatggacattatctctcgcaaggatcagagagggagcggacaagtgggcacatacgggctgaacaccttcaccaatatggaagctcagcttattcggcagatggagggagaaggcgtcctgtccaaagccgacctcgagaaccctcatctgcccgaaaagaaaatcacacagtggctggagaccaagggggtggagcgcctcaagagaatggcgatcagcggcgatgactgcgtggttaaacccattgatgaccggtttgccaacgctctgcttgccctgaatgatatgggaaaggtgcgcaaagacatccctcaatggcagccgtctaagggctggcatgattggcagcaggtccccttctgttcccaccatttccacgaactcgtgatgaaagacgggagaaagctggttgtgccttgccggccccaagacgagcttattggacgcgctagaatcagccagggcgccgggtggtctctgcgggaaacagcttgtctcggaaaggcctatgcgcagatgtggtccctgatgtactttcaccgcagagatctgcggctcgccagcaacgctatttgctctgccgtccctgtgcattgggtccccacgtcccgcaccacatggagcatccacgcccatcaccaatggatgaccacagaggacatgctgaccgtgtggaatagagtttggattgaagataacccttggatggaggacaaaacgcccgtgaccacatgggagaatgtcccgtaccttggcaagcgggaagatcagtggtgtgggtccctgatcggcctcaccagcagagctacatgggcccagaacatccctaccgcgattcagcaagtgcgctctctgatcggaaatgaggagttccttgactatatgcccagcatgaaacggtttagaaaggaggaggaatccgagggcgctatttggtga

SEQ ID NO: 20682 - RNA, 9873 nt, synthetic construct
  misc_feature 1..9873: note = derived and/or modified CDS sequence (opt5) from DENV-3__EU726773__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagaaagacattccggaacgctcctggaactctggcaatgagtggatcacggattttgcggggaagaccgtgtggttcgtccctagcattaaagctggcaacgacatcgccaactgtcttcggaagaatggaaagaaagttattcaactgtccagaaagacatttgataccgaatatcagaaaacaaagctcaacgactgggatttcgtggtgaccacagacatctctgagatgggcgccaattttaaagctgatcgcgtcattgacccccggagatgcctgaagcccgtgatcctgaccgatgggcctgagcgggttatcctcgccggacccatgcctgtgacggcggccagcgctgcccagcgcagaggccgggtcgggcgcaacccgcagaaggaaaatgaccaatacattttcacaggacagccccttaacaatgatgaggaccacgctcattggaccgaagccaaaatgctgctggacaacatcaatacccctgagggcattatccccgctctcttcgaacctgagagagagaagtccgccgcgattgatggggaatatcggctgaaaggcgagagcagaaagacatttgtggaacttatgcgccggggagacctgcccgtttggctcgcccacaaagtggcttctgagggcatcaagtacaccgatagaaaatggtgcttcgacgggcagcgcaacaatcagatcctggaagagaacatggatgtcgagatttggacaaaggaaggagagaagaaaaagctgcggccgagatggctcgacgcccgcacgtattccgatcctcttgctctgaaagaatttaaggacttcgccgccggccggaaaagcatcgctctggatctcgtgaccgagattgggagagtcccctctcacctggcgcatcgcacaagaaatgcccttgacaacctggtgatgctccacacctccgaacatggaggcaaggcttaccggcacgccgttgaggagctgcctgaaacaatggagaccctgctccttctgggcctgatgatcctcctgacggggggagccatgctttttctgattagcggcaaggggatcggaaaaacctccatcggcctcatttgtgtgatcgcttctagcgggatgctgtggatggccgaaattcccctgcaatggatcgcgtccgccattgtgctcgagttctttatgatggtccttctgatccctgagcccgaaaagcagcgcacaccgcaggataatcaactggcttatgttgtgattggaatcctcaccctggccgctatcattgccgcgaacgagatgggccttctggaaacaaccaaaagagacctcggcatgagcaaggagcctggggtggtctctcccacgtcctacctggatgtggacctgcaccccgccagcgcttggacactctacgccgttgctaccacagtgatcacccctatgcttcggcataccattgaaaattctacagccaacgtcagcctggctgccatcgcgaaccaggccgtggtcctgatgggactcgacaaaggctggccgatttccaagatggatctgggggtgccccttctggctctcggatgctattctcaggttaatcctctgacgctgaccgccgctgtgctccttctgatcacacactacgccatcattggccccgggctgcaggccaaggcgacccgcgaggctcaaaaaagaacagccgctggaatcatgaagaaccctaccgtcgacggcattatgacgatcgatctcgaccccgtgatttatgatagcaaattcgagaagcagctgggccaggttatgcttctggtgctctgtgccgtccagctgctgctcatgcggacatcctgggccctttgcgaagctctgaccctggccaccgggcctatcacaaccctctgggagggatctccgggcaaattttggaatacaacgatcgcggtgagcatggccaacattttcagagggtcctacctggctggagccggccttgcttttagcatcatgaagtctgtggggaccggaaagcgcggcacaggctcccaaggggaaaccctgggagagaaatggaagaaaaagctcaatcagctgagccggaaagaattcgacctgtataagaaatccggcattacagaggttgatagaaccgaggccaaggaagggctcaagcgcggagagatcacgcatcacgcggtctctcggggcagcgccaaacttcagtggtttgtggaaagaaacatggtgattcccgaggggcgggtcatcgacctgggatgtggccgcggcgggtggtcctactattgcgctggactgaagaaagttaccgaagtgagaggctacacaaaggggggacctggccatgaggagcccgtgcctatgtctacctacgggtggaatattgtcaaactcatgagcggaaaggatgtgttctatctgcccccggaaaagtgtgacacacttctgtgcgatatcggcgagtccagcccttctcccaccgttgaagagtcccggacaatccgcgtgctcaaaatggtcgagccctggctgaagaacaatcagttctgtattaaagtgctgaacccttacatgcccaccgttatcgaacacctcgagagacttcaacggaagcacggcgggatgctggtgcgcaatcctctgagcagaaactctacgcatgaaatgtattggatttccaatggaacaggcaacatcgtcgccagcgtgaatatggtgtctcggctcctgcttaaccgctttaccatgacccacagacggccgacaattgagaaagacgtcgatctgggggctggaacgagacatgttaacgccgaacccgagacccctaatatggacgtgatcggcgagcgcatcaagcggattaaggaagagcacaacagcacatggcactacgacgatgaaaatccctataaaacctgggcttaccatgggtcctatgaggtgaaggccacaggatctgcgagctccatgatcaacggcgtcgtgaaactcctgaccaagccttgggacgttgtgcccatggtcacacagatggccatgaccgatacgaccccgttcggccagcaaagagtgtttaaagaaaaggttgacacacgcacccctcggagcatgcccgggacaagacgcgtgatgggaattaccgctgagtggctgtggcggacgctcggcagaaataagaaacctcgcctgtgcacacgggaggaattcaccaagaaagtcagaacaaacgccgctatgggggccgtgtttaccgaggaaaatcagtgggattccgccaaggcggctgttgaggacgaagatttctggatccttgtggaccgcgagcgggagctgcacaaactcggaaagtgtggctcttgcgtctacaacatgatggggaaaagagaaaagaagctgggcgagtttggaaaagccaagggcagccgcgccatttggtacatgtggcttggggctagatatctggaattcgaggccctcggatttctgaatgaggatcattggttctcccgggaaaactcttacagcggcgtggagggggaaggactgcacaaactcggctatatcctgcgcgacatctccaagattcccgggggcgctatgtacgccgatgacacggcgggatgggacaccagaatcacagaggatgaccttcataatgaagagaaaattacccagcagatggatcctgagcaccggcaactggccaacgctatctttaagctcacatatcagaataaggtcgtgaaagttcagagacccaccccgacaggcaccgtgatggacattatctctcggaaggatcagcgcgggagcggacaagtcggcacgtacgggctgaacacattcaccaatatggaagcccagcttatcagacagatggagggagaaggcgtgctgtccaaagctgacctcgagaaccctcacctgcccgaaaagaaaattacccagtggctggagacaaagggggtggagcggctcaagcgcatggccatcagcggcgatgactgcgttgtgaaacccattgatgacagatttgcgaacgccctgcttgctctgaatgatatgggaaaggtccggaaagacatccctcaatggcagccgtctaagggctggcatgattggcagcaggtgcccttctgttcccaccatttccacgaactcattatgaaagacgggcgcaagctggttgtgccttgcagaccccaagacgagcttatcggacgggcccgcattagccagggcgctgggtggtctctgagagaaaccgcctgtctcggaaaggcttatgcccagatgtggtccctgatgtactttcaccggcgcgatctgagactcgcgagcaacgccatctgctctgctgtccctgtgcattgggtccccacatcccggacgacctggagcatccacgcccatcaccaatggatgacaaccgaggacatgctgacagtgtggaatcgcgtttggattgaagataacccttggatggaggacaaaacccccgtgacgacctgggagaatgtcccgtaccttggcaagagagaagatcagtggtgtgggtccctgatcggcctcacaagccgggccacctgggctcagaacattcctacagccatccagcaagtgagatctctgattggaaatgaggaattccttgactatatgcccagcatgaaacgctttcggaaggaggaggaatccgagggcgcgatctggtga

SEQ ID NO: 20683 - RNA, 9873 nt, synthetic construct
  misc_feature 1..9873: note = derived and/or modified CDS sequence (opt5) from DENV-3__EU726774__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttttctttaccttcgtgcttctgctcagcgggcagatcacatggcgcgatatggctcacaccctgattatggtcggatccaatgccagcgacagaatgggcatgggggtgacgtacctggcgcttatcgctacatttaaaattcagcccttcctggccctcggatttttcctgcggaagctcacctctagagaaaacctgcttctgggcgtggggctcgccatggctacaaccctgcaactgcctgaggatatcgaacagatggccaatggaatcgctcttggcctgatggccctcaaactgaccacacagtttgagacgtatcagctctggaccgcgctgatttcccttacatgtagcaacaccatcttcacactgaccgtcgcctggcgcacggctacactcattctggccggcgtttccctgcttccggtgtgccaatctagctccatgcggaagaccgactggctgcccatgaccgtggctgccatgggggtccctcccctccctctgtttatcttctctctcaaggatacactgaaaagacgcagctggccccttaatgagggagtgatggccgttggcctggtgtccattctggcttctagcctcctgagaaacgacgtccctatggcggggccccttgtggccggaggcctgctcatcgcttgttacgttatcaccgggacatccgccgatctgacggtggaaaaggccgctgacgtcacctgggaggaagaggccgaacagacaggagtgagccataacctcatgattaccgtcgacgatgacggcacaatgcggatcaaagatgacgagaccgagaatattctgacggtgcttctgaagaccgcgctgctcatcgtttctggcatttttccgtactccatccctgctacactgcttgtgtggcacacctggcagaaacagacacaacgcagcggggtcctgtgggatgtgccctctcctcccgaaacccagaaggccgagctcgaagagggagtttatagaatcaaacagcagggcattttcgggaagacacaagtgggagtcggcgtgcagaaggagggggtgtttcatacgatgtggcacgttacccggggagccgtcctgacatacaacggcaaacgcctcgaaccgaattgggcttccgtgaagaaagacctgatcagctatggcgggggatggagactttctgcccagtggcaaaagggcgaggaagtgcaggtcattgcggtggagcctgggaaaaaccccaagaatttccagaccatgcctggaaccttccagacaacgaccggcgaaatcggggctattgccctggattttaagcccggaacatccggcagccccatcattaaccgggagggcaaagttgtggggctgtacggaaatggcgtcgtgaccaagaacgggggatatgtttccggcatcgcccaaacaaatgctgagcctgacgggccgacccccgaactcgaggaagagatgttcaaaaagcgcaacctgacgatcatggatcttcaccctggcagcggaaaaacaagaaagtacctgcccgccattgtgcgggaagctatcaagcgcagactccggaccctgattctcgcccctaccagagtcgtggcggccgagatggaggaagctctgaaaggccttcccatccgctatcagacaaccgccacaaagtctgagcataccgggcgggaaattgttgacctgatgtgccacgctacgtttacaatgagactgctcagccctgtgcgcgtcccgaattacaacctgatcatcatggatgaggcccatttcaccgaccccgcctccattgctgcgcggggatacatctctacaagagtgggcatgggggaagccgctgccatttttatgaccgccacgcctcccggaaccgctgatgccttccctcagagcaatgcgcccatccaggacgaggagcgcgacattccggaacggtcctggaactctggcaatgagtggatcacagattttgctgggaaaaccgtgtggttcgtccctagcatcaaggccggcaacgacattgccaactgtcttcgcaaaaatggaaagaaggttatccaactgtccagaaaaacatttgataccgaatatcagaagacaaaactcaacgactgggatttcgtggtgaccacggacatttctgagatgggcgctaattttaaggccgatcgggtcatcgaccccagacggtgcctgaaacccgtgattctgacagatgggcctgagcgcgttatcctcgcgggacccatgcctgtgaccgccgctagcgccgctcagagacggggccgcgtcgggagaaacccgcagaaggaaaatgaccaatacattttcaccggacagccccttaacaatgatgaggaccacgcccattggacagaagctaagatgctgctggacaacatcaatacccctgagggcatcattcccgccctcttcgaacctgagcgggagaaatccgcggccatcgatggggaatatagactgaagggcgagagccgcaaaacatttgtggaacttatgcggagaggagacctgcccgtttggctcgctcacaaggtggcctctgagggcattaaatacacggatcgcaagtggtgcttcgacgggcagcggaacaatcagatcctggaagagaacatggatgtcgagatttggaccaaagaaggagagaagaagaaactgagaccgcgctggctcgacgctcggacatattccgatcctcttgccctgaaggaatttaaagacttcgccgctggcagaaagagcatcgcgctggatctcgtgaccgagatcgggcgcgtcccctctcacctggcccatagaacacggaatgctcttgacaacctggtgatgctccacacctccgaacatggaggcaaagcctaccgccacgccgttgaggagctgcctgaaacgatggagaccctgctccttctgggcctgatgattctcctgacagggggagctatgctttttctgatcagcggcaaggggattggaaagacctccatcggcctcatttgtgtgatcgcctctagcgggatgctgtggatggcggaaatccccctgcaatggattgcctccgctatcgtgctcgagttctttatgatggtccttctgattcctgagcccgaaaaacagagaacaccgcaggataatcaactggcctatgttgtgatcggcattctcaccctggctgccatcattgcggccaacgagatgggccttctggaaacgacaaagcgggacctcggcatgagcaaagagcctggggtggtctctcccacctcctacctggatgtggacctgcaccccgctagcgcctggacactctacgctgttgccaccaccgtgatcacacctatgcttcgccatacgatcgaaaattctaccgctaacgtcagcctggccgcgattgccaaccaggctgtggtcctgatgggactcgacaagggctggccgatctccaaaatggatctgggggtgccccttctggccctcggatgctattctcaggttaatcctctgacactgaccgctgccgtgctccttctgattacacactacgccatcattggccccgggctgcaggcgaaggctaccagagaggcccaaaagcggacggctgccggaatcatgaaaaaccctacagtcgacggcatcatgaccattgatctcgaccccgtgatctatgatagcaagttcgagaaacagctgggccaggttatgcttctggtgctctgtgccgtccagctgctgctcatgagaacctcctgggctctttgcgaagccctgacactggcgaccgggcctattacaacgctctgggagggatctccgggcaagttttggaataccacaatcgccgtgagcatggctaacattttccgcgggtcctacctggccggagctggccttgcctttagcatcatgaaatctgtggggaccggaaagcggggcacaggctcccaaggggaaaccctgggagagaagtggaaaaagaaactcaatcagctgagcagaaaggagttcgacctgtataaaaagtccggcatcacggaggttgatcgcaccgaggcgaaagaagggctcaagcggggagagattacacatcacgccgtctctagaggcagcgctaaacttcagtggtttgtggaacggaacatggtgatccccgaggggcgcgtcattgacctgggatgtggcagaggcgggtggtcctactattgcgccggactgaaaaaggttaccgaagtgcggggctacacaaaagggggacctggccatgaggagcccgtgcctatgtctacctacgggtggaatatcgtcaagctcatgagcggaaaagatgtgttctatctgcccccggaaaagtgtgacacacttctgtgcgatattggcgagtccagcccttctcccaccgttgaagagtcccgcacgatcagagtgctcaagatggtcgagccctggctgaaaaacaatcagttctgtattaaggtgctgaacccttacatgcccacagttatcgaacacctcgagcggcttcaacgcaaacacggcgggatgctggtgagaaatcctctgagccggaactctacccatgaaatgtattggatctccaatggaaccggcaacattgtcgctagcgtgaatatggtgtctcgcctcctgcttaacagatttacaatgacgcaccggagaccgaccatcgagaaggacgtcgatctgggggccggaacacgccatgttaacgctgaacccgagacccctaatatggacgtgattggcgagcggatcaaaagaattaaggaagaacacaacagcacatggcactacgacgatgaaaatccctataagacctgggcctaccatgggtcctatgaggtgaaagcgacaggatctgccagctccatgatcaacggcgtcgtgaagctcctgaccaaaccttgggacgttgtgcccatggtcacgcagatggctatgaccgatacaaccccgttcggccagcaacgcgtgtttaaggaaaaagttgacacacggacccctagaagcatgcccgggacgcgccgggtgatgggaatcacagccgagtggctgtggagaaccctcggccgcaataagaagcctcggctgtgcacaagagaggagttcaccaaaaaggtccgcacgaacgctgccatgggggccgtgtttaccgaggaaaatcagtgggattccgcgaaagctgccgttgaggacgaagatttctggaaacttgtggaccgggagagagagctgcacaaactcggaaagtgtggctcttgcgtctacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtggagggggaaggactgcacaaactcggctatatcctgagagacatttccaagatccccgggggcgccatgtacgcggatgacacagccggatgggacacccggattacagaggatgaccttcataatgaagagaaaatcacccagcagatggatcctgagcacagacaactggctaacgccatctttaagctcacatatcagaataaggtcgtgaaagttcagcggcccaccccgacgggcacagtgatggacattatctctcgcaaggatcagagagggagcggacaagtcggcacctacgggctgaacaccttcacaaatatggaagctcagcttattcggcagatggagggagaaggcgtgctgtccaaagccgacctcgagaaccctcatctgcccgaaaagaaaatcacccagtggctggagacaaagggggtggagcgcctcaagagaatggcgattagcggcgatgactgcgttgtgaaacccatcgatgaccggtttgccaacgctctgcttgccctgaatgatatgggaaaggtccgcaaagacatccctcaatggcagccgtctaagggctggcatgattggcaacaggtgcccttctgttcccaccatttccacgaactcattatgaaagacgggagaaagctggttgtgccttgccggccccaagacgagcttatcggacgcgctagaattagccagggcgccgggtggtctctgcgggaaacggcttgtctcggaaaggcctatgcgcagatgtggtccctgatgtactttcaccgcagagatctgcggctcgccagcaacgctatctgctctgccgtccctgtgcattgggtccccacctcccgcacaacctggagcattcacgcccatcaccaatggatgacaaccgaggacatgctgacggtgtggaatagagtttggatcgaagataacccttggatggaggacaaaacccccgtgacaacctgggagaatgtcccgtaccttggcaagcgggaagatcagtggtgtgggtccctgattggcctcacaagcagagctacctgggcccagaacatccctacggcgatccagcaagtgcgctctctgattggaaatgaggagttccttgactatatgcccagcatgaaacggtttagaaaggaggaggaatccgagggcgctatctggtga

SEQ ID NO: 20684 - RNA, 9873 nt, synthetic construct
  misc_feature 1..9873: note = derived and/or modified CDS sequence (opt5) from DENV-3__EU687219__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacacttattgctatggatctgggggaaatgtgcgacgatacagtcacctacaaatgtccgcacatcgccgaagttgaacccgaagacattgattgctggtgtaacctcacatccacctgggtgacatatggaacctgcaatcaggccggcgagcaccggcgggacaagcgctctgtggctctggcccctcatgtcgggatgggactggatacgagaacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgaccaacgaggttcatacatggacggaacagtacaaatttcaagcggattcccccaagcggctggccaccgctatcgccggcgcttgggagaatggagtgtgtggcattagaagcacaacccgcatggaaaaccttctctggaaacagatcgccaatgagctgaactatatcctgtgggaaaataacattaagctcacagtcgtggttggggacatcattggagtgctggagcagggcaaacggacccttacgcctcagcccatggagctgaagtactcttggaaaacctgggggaaggccaagatcgtcacagctgaaacccaaaactccagcttcattatcgatggacctaatacacccgagtgcccgtctgtgtccagagcgtggaacgtgtgggaagtcgaggactatggctttggcgttttcaccacaaatatctggctcaaactgcgcgaagtgtacacccagctgtgtgaccaccggcttatgagcgccgctgtgaaggatgagagagccgtccacgccgacatggggtactggattgagtcccagaaaaacggatcttggaagctcgaaaaagctagcctgatcgaggtgaagacgtgcacatggcctaagtcccataccctgtggtctaatggcgttctcgaaagcgatatgattatccccaaatccctggccgggcctattagccagcacaactatcgccccggataccatacccaaacagcgggcccttggcaccttgggaagctggagctcgactttaattattgcgagggaaccacggtggtcatcacagaaaactgtggcacccggggcccctctctgagaacaaccacagtgtccgggaaactgatccacgagtggtgctgtcgcagctgcacccttccgcctctccggtacatgggagaagatggctgttggtatgggatggagattagacccatctctgaaaaggaggagaatatggttaaatccctggtgagcgctggatctggcaaggtcgacaacttcacgatgggggtgctgtgcctcgccattctgtttgaagaggttatgcggggaaagttcggcaaaaagcatatgatcgccggcgtgttctttaccttcgtccttctgctcagcgggcagattacatggcgcgatatggctcacaccctgatcatgattggatccaatgccagcgacagaatgggcatgggggtgacatacctggcgcttatcgctacctttaaaatccagcccttcctggccctcggatttttcctgcggaagctcacgtctagagaaaacctgcttctgggcgtggggctcgccatggctacaaccctgcaactgcctgaggatattgaacagatggccaatggaatcgctcttggcctgatggccctcaaactgattacacagtttgagacctatcagctctggaccgcgctgatctcccttacatgtagcaacacgattttcaccctgacagtcgcctggcgcaccgctacactcatcctggccggcgtttccctgcttccggtgtgccaatctagctccatgcggaagaccgactggctgcccatgacggtggctgccatgggggtccctcccctccctctgtttatcttctctctcaaggatacactgaaaagacgcagctggccccttaatgagggagtgatggccgttggcctggtgtccattctggcttctagcctcctgagaaacgacgtccctatggcggggccccttgtggccggaggcctgctcatcgcttgttacgttattaccgggacctccgccgatctgacagtggaaaaggccgctgacgtcacctgggaggaagaggccgaacagacaggagtgagccataacctcatgatcacggtcgacgatgacggcaccatgcggattaaagatgacgagacagagaatatcctgaccgtgcttctgaagacagcgctgctcatcgtttctggcatttttccgtactccatccctgctaccctgcttgtgtggcacacgtggcagaaacagacccaacgcagcggggtcctgtgggatgtgccctctcctcccgaaacacagaaggccgagctcgaagagggagtttatagaattaaacagcagggcatcttcgggaagacccaagtgggagtcggcgtgcagaaggagggggtgtttcatacaatgtggcacgttacccggggagccgtcctgacatacaacggcaaacgcctcgaaccgaattgggcttccgtgaagaaagacctgattagctatggcgggggatggagactttctgcccagtggcaaaagggcgaggaagtgcaggtcatcgcggtggagcctgggaaaaaccccaagaatttccagacgatgcctggaaccttccagacaaccaccggcgaaattggggctatcgccctggattttaagcccggaacatccggcagccccatcattaaccgggagggcaaagttgtggggctgtacggaaatggcgtcatcacgaagaacgggggatatgtgtccggcattgcccaaaccaatgctgagcctgacgggccgacacccgaactcgaggaagagatgttcaaaaagcgcaacctgaccatcatggatcttcaccctggcagcggaaaaacaagaaagtacctgcccgccattgttcgggaagctatcaagcgcagactccggaccctgatcctcgcccctacgagagtggtcgcggccgagatggaggaagctctgaaaggccttcccattcgctatcagacaaccgccaccaagtctgagcatacagggcgggaaatcgtggacctgatgtgccacgctacctttacaatgagactgctcagccctgttcgcgtgccgaattacaacctgattatcatggatgaggcccatttcaccgaccccgcctccattgctgcgcggggatacatctctacgagagtcggcatgggggaagccgctgccatctttatgacagccacccctcccggaacagctgatgccttccctcagagcaatgcgcccattcaggacgaggagcgcgacatcccggaacggtcctggaactctggcaatgagtggattaccgattttgctgggaaaacggtgtggttcgtgcctagcatcaaggccggcaacgacattgccaactgtcttcgcaaaaatggaaagaaggtcatccaactgtccagaaaaacctttgatacagaatatcagaagaccaaactcaacgactgggatttcgttgtgacaaccgacatttctgagatgggcgctaattttaaggccgatcgggtgatcgaccccagacggtgcctgaaacccgtcatcctgacagatgggcctgagcgcgtgattctcgcgggacccatgcctgttaccgccgctagcgccgctcagagacggggccgcgtggggagaaacccgcagaaggaaaatgaccaatacatcttcacgggacagccccttaacaatgatgaggaccacgcccattggacagaagctaagatgctgctggacaacattaatacccctgagggcatcattcccgccctcttcgaacctgagcgggagaaatccgcggccatcgatggggaatatagactgaagggcgagagccgcaaaacctttgtcgaacttatgcggagaggagacctgcccgtgtggctcgctcacaaggttgcctctgagggcatcaaatacacagatcgcaagtggtgcttcgacgggcagcggaacaatcagattctggaagagaacatggatgtggagatctggaccaaagaaggagagaagaagaaactgagaccgcgctggctcgacgctcggacatattccgatcctcttgccctgaaggaatttaaagacttcgccgctggcagaaagagcattgcgctggatctcgtcacggagatcgggcgcgtgccctctcacctggcccatagaacccggaatgctcttgacaacctggtcatgctccacacatccgaacatggaggcaaagcctaccgccacgccgtggaggagctgcctgaaaccatggagacactgctccttctgggcctgatgattctcctgaccgggggagctatgctttttctgatcagcggcaaggggatcggaaagacgtccattggcctcatctgtgttattgcctctagcgggatgctgtggatggcggaaatccccctgcaatggattgcctccgctatcgtgctcgagttctttatgatggtgcttctgattcctgagcccgaaaaacagagaaccccgcaggataatcaactggcctatgtcgttatcggaatcctcacactggctgccattatcgcggccaacgagatgggccttctggaaaccacaaagcgggacctcggcatgagcaaagagcctggggtggtgtctcccacctcctacctggatgtcgacctgcaccccgctagcgcctggacgctctacgctgtggccacaaccgttattacacctatgcttcgccataccatcgaaaattctaccgctaacgtgagcctggccgcgattgccaaccaggctgtcgtgctgatgggactcgacaagggctggccgatctccaaaatggatctgggggtcccccttctggccctcggatgctattctcaggtgaatcctctgacactgacggctgccgttctccttctgatcacccactacgccattatcggccccgggctgcaggcgaaggctacaagagaggcccaaaagcggaccgctgccggaattatgaaaaaccctacagtggacggcatcatgaccattgatctcgaccccgtcatctatgatagcaagttcgagaaacagctgggccaggtgatgcttctggttctctgtgccgtgcagctgctgctcatgagaacgtcctgggctctttgcgaagccctgacactggcgaccgggcctatcaccacactctgggagggatctccgggcaagttttggaataccacaattgccgtcagcatggctaacatcttccgcgggtcctacctggccggagctggccttgcctttagcattatgaaatctgtggggacgggaaagcggggcaccggctcccaaggggaaacactgggagagaagtggaaaaagaaactcaatcagctgagcagaaaggagttcgacctgtataaaaagtccggcatcaccgaggtggatcgcacagaggcgaaagaagggctcaagcggggagagattacccatcacgccgtttctagaggcagcgctaaacttcagtggtttgtcgaacggaacatggtgatccccgaggggcgcgtgattgacctgggatgtggcagaggcgggtggtcctactattgcgccggactgaaaaaggtcacggaagttcggggctacaccaaagggggacctggccatgaggagcccgtgcctatgtctacatacgggtggaatatcgtgaagctcatgagcggaaaagatgtcttctatctgcccccggaaaagtgtgacacccttctgtgcgatatcggcgagtccagcccttctcccacagtggaagagtcccgcaccattagagttctcaagatggtggagccctggctgaaaaacaatcagttctgtatcaaggtcctgaacccttacatgcccacagtgattgaacacctcgagcggcttcaacgcaaacacggcgggatgctggttagaaatcctctgagccggaactctacccatgaaatgtattggatctccaatggaacgggcaacattgtggctagcgtcaatatggtgtctcgcctcctgcttaacagatttacaatgacccaccggagaccgaccatcgagaaggacgtggatctgggggccggaacacgccatgtcaacgctgaacccgagacgcctaatatggacgttatcggcgagcggattaaaagaatcaaggaagaacacaacagcacctggcactacgacgatgaaaatccctataagacatgggcctaccatgggtcctatgaggtgaaagcgaccggatctgccagctccatgattaacggcgtggtcaagctcctgacaaaaccttgggacgtggttcccatggtgacccagatggctatgacagataccacgccgttcggccagcaacgcgtctttaaggaaaaagtggacacccggacacctagaagcatgcccgggacccgccgggttatgggaatcacagccgagtggctgtggagaaccctcggccgcaataagaagcctcggctgtgcacgagagaggagttcaccaagaaggtgcgcaccaacgctgccatgggggccgtctttacagaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtcgagggggaaggactgcacaaactcggctatatcctgagagacatctccaagattcccgggggcgccatgtacgcggatgacaccgccggatgggacacgcggatcaccgaggatgaccttcataatgaagagaaaattacacagcagatggatcctgagcacagacaactggctaacgccatctttaagctcacctatcagaataaggtggtcaaagtgcagcggcccacaccgaccggcacagttatggacattatctctcgcaaggatcagagagggagcggacaagtgggcacctacgggctgaacacgttcacaaatatggaagctcagcttatccggcagatggagggagaaggcgtcctgtccaaagccgacctcgagaaccctcatctgcccgaaaagaaaattacccagtggctggagaccaagggggtggagcgcctcaagagaatggcgatcagcggcgatgactgcgtggttaaacccattgatgaccggtttgccaacgctctgcttgccctgaatgatatgggaaaggtgcgcaaagacatccctcaatggcagccgtctaagggctggcatgattggcagcaggtccccttctgttcccaccatttccacgaactcattatgaaagacgggagaaagctggtggttccttgccggccccaagacgagcttatcggacgcgctagaattagccagggcgccgggtggtctctgcgggaaacagcttgtctcggaaaggcctatgcgcagatgtggtccctgatgtactttcaccgcagagatctgcggctcgccagcaacgctatctgctctgccgtgcctgtccattgggtgcccacctcccgcacaacgtggagcatccacgcccatcaccaatggatgaccacagaggacatgctgaccgtctggaatagagtgtggattgaagataacccttggatggaggacaaaacacccgttaccacgtgggagaatgtgccgtaccttggcaagcgggaagatcagtggtgtgggtccctgatcggcctcaccagcagagctacatgggcccagaacattcctaccgcgatccagcaagtccgctctctgattggaaatgaggagttccttgactatatgcccagcatgaaacggtttagaaaggaggaggaatccgagggcgctatctggtga

SEQ ID NO: 20685 - RNA, 9873 nt, synthetic construct
  misc_feature 1..9873: note = derived and/or modified CDS sequence (opt5) from DENV-3__EU726768__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaatatcagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcagaaggaaaatgaccaatacattttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtttggctcgcccacaaggtggcttctgagggcatcaaatacaccgatcgcaagtggtgcttcgacgggcagcggaacaatcagatcctggaagagaacatggatgtcgagatttggacaaaagaaggagagaagaagaaactgagaccgcgctggctcgacgcccggacgtattccgatcctcttgctctgaaggaatttaaagacttcgccgccggcagaaagagcatcgctctggatctcgtgaccgagattgggcgcgtcccctctcacctggcgcatagaacacggaatgcccttgacaacctggtgatgctccacacctccgaacatggaggcaaggcttaccgccacgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaaacagagaacaccgcaggataatcaactggcttatgttgtgattggaatcctcaccctggccgctatcattgccgcgaacgagatgggccttctggaaacaaccaagcgggacctcggcatgagcaaagagcctggggtggtctctcccacgtcctacctggatgtggacctgcaccccgccagcgcttggacactctacgccgttgctaccacagtgatcacccctatgcttcgccataccattgaaaattctacagccaacgtcagcctggctgccatcgcgaaccaggccgtggtcctgatgggactcgacaagggctggccgatttccaaaatggatctgggggtgccccttctggctctcggatgctattctcaggttaatcctctgacgctgaccgccgctgtgctccttctgatcacacactacgccatcattggccccgggctgcaggccaaggcgaccagagaggctcaaaagcggacagccgctggaatcatgaaaaaccctaccgtcgacggcattatgacgatcgatctcgaccccgtgatttatgatagcaagttcgagaaacagctgggccaggttatgcttctggtgctctgtgccgtccagctgctgctcatgagaacatcctgggccctttgcgaagctctgaccctggccaccgggcctatcacaaccctctgggagggatctccgggcaagttttggaatacaacgatcgcggtgagcatggccaacattttccgcgggtcctacctggctggagccggccttgcttttagcatcatgaaatctgtggggaccggaaagcggggcacaggctcccaaggggaaaccctgggagagaagtggaaaaagaaactcaatcagctgagcagaaaggagttcgacctgtataaaaagtccggcattacagaggttgatcgcaccgaggccaaagaagggctcaagcggggagagatcacgcatcacgcggtctctagaggcagcgccaaacttcagtggtttgtggaacggaacatggtgattcccgaggggcgcgtcatcgacctgggatgtggcagaggcgggtggtcctactattgcgctggactgaaaaaggttaccgaagtgcggggctacacaaaagggggacctggccatgaggagcccgtgcctatgtctacctacgggtggaatattgtcaagctcatgagcggaaaagatgtgttctatctgcccccggaaaagtgtgacacacttctgtgcgatatcggcgagtccagcccttctcccaccgttgaagagtcccgcacaatcagagtgctcaagatggtcgagccctggctgaaaaacaatcagttctgtattaaggtgctgaacccttacatgcccaccgttatcgaacacctcgagcggcttcaacgcaaacacggcgggatgctggtgagaaatcctctgagccggaactctacgcatgaaatgtattggatttccaatggaacaggcaacatcgtcgccagcgtgaatatggtgtctcgcctcctgcttaacagatttaccatgacccaccggagaccgacaattgagaaggacgtcgatctgggggctggaacgcgccatgttaacgccgaacccgagacccctaatatggacgtgatcggcgagcggatcaaaagaattaaggaagaacacaacagcacatggcactacgacgatgaaaatccctataagacctgggcttaccatgggtcctatgaggtgaaagccacaggatctgcgagctccatgatcaacggcgtcgtgaagctcctgaccaaaccttgggacgttgtgcccatggtcacacagatggccatgaccgatacgaccccgttcggccagcaacgcgtgtttaaggaaaaagttgacacacggacccctagaagcatgcccgggacacgccgggtgatgggaattaccgctgagtggctgtggagaacgctcggccgcaataagaagcctcggctgtgcacaagagaggagttcaccaaaaaggtccgcacaaacgccgctatgggggccgtgtttaccgaggaaaatcagtgggattccgccaaagcggctgttgaggacgaagatttctggatccttgtggaccgggagagagagctgcacaagctcggaaaatgtggctcttgcgtctacaacatgatggggaagcgcgagaaaaagctgggcgagtttggaaaggccaaaggcagcagagccatttggtacatgtggcttggggctcggtatctggagttcgaggccctcggatttctgaatgaggatcattggttctcccgcgaaaactcttacagcggcgtggagggggaaggactgcacaagctcggctatatcctgagagacatctccaaaattcccgggggcgctatgtacgccgatgacacggcgggatgggacacccggatcacagaggatgaccttcataatgaagagaagattacccagcagatggatcctgagcacagacaactggccaacgctatctttaaactcacatatcagaataaggtcgtgaaggttcagcggcccaccccgacaggcaccgtgatggacattatctctcgcaaagatcagagagggagcggacaagtcggcacgtacgggctgaacacattcaccaatatggaagcccagcttatccggcagatggagggagaaggcgtgctgtccaaggctgacctcgagaaccctcatctgcccgagaaaaagattacccagtggctggagacaaaaggggtggagcgcctcaagagaatggccatcagcggcgatgactgcgttgtgaagcccattgatgaccggtttgcgaacgccctgcttgctctgaatgatatgggaaaagtccgcaaggacatccctcaatggcagccgtctaaaggctggcatgattggcaacaggtgcccttctgttcccaccatttccacgaactcattatgaaggacgggagaaaactggttgtgccttgccggccccaagacgagcttatcggacgcgccagaattagccagggcgctgggtggtctctgcgggaaaccgcctgtctcggaaaggcttatgcccagatgtggtccctgatgtactttcaccgcagagatctgcggctcgcgagcaacgccatctgctctgctgtccctgtgcattgggtccccacatcccgcacgacctggagcatccacgcccatcaccaatggatgacaaccgaggacatgctgacagtgtggaatagagtttggattgaagataacccttggatggaggacaagacccccgtgacgacctgggagaatgtcccgtaccttggcaaacgggaagatcagtggtgtgggtccctgatcggcctcacaagcagagccacctgggctcagaacattcctacagccatccagcaagtgcgctctctgattggaaatgaggagttccttgactatatgcccagcatgaagcggtttagaaaagaggaggaatccgagggcgcgatctggtga

SEQ ID NO: 20686 - RNA, 9873 nt, synthetic construct
  misc_feature 1..9873: note = derived and/or modified CDS sequence (opt5) from DENV-3__EU687226__SS-prME
  source 1..9873: mol_type = other RNA
accagcctgtgcctcatgatgatcctgcccgccgctcttgccttccacctgacctcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccgtgtctgaaaaggaggagaatatggttaaatccctggtgagcgctggatctggcaaggtcgacaacttcaccatgggggtgctgtgcctcgccatcctgtttgaagaggttatgcggggaaagttcggcaaaaagcatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaaaatccagcccttcctggccctcggatttttcctgcggaagctcacatctagagaaaacctgcttctgggcgtggggctcgccatggctaccacactgcaactgcctgaggatatcgaacagatggccaatggaattgctcttggcctgatggccctcaaactgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaagacggactggctgcccatgacagtggctgccatgggggtccctcccctccctctgtttatcttctctctcaaggataccctgaaaagacgcagctggccccttaatgagggagtgatggccgttggcctggtgtccatcctggcttctagcctcctgagaaacgacgtccctatggcggggccccttgtggccggaggcctgctcattgcttgttacgttatcaccgggacatccgccgatctgaccgtggaaaaggccgctgacgtcacatgggaggaagaggccgaacagacgggagtgagccataacctcatgattaccgtcgacgatgacggcacaatgcggatcaaagatgacgagaccgagaatattctgacagtgcttctgaagaccgcgctgctcatcgtttctggcatctttccgtactccattcctgctacgctgcttgtgtggcacacctggcataaacagacacagcgcagcggggtcccctgggatgtgccttctcccccggaaacccaaaaggccgagctggaagagggagtttatagaatcaaacagcagggcattttcgggaagacacaggtgggagtcggcgtgcaaaaggagggggtgtttcactccatgtggcacgttacccggggagccgtcctcacatacaacggcaaacgcctggaacctaattgggctagcgtgaagaaagacctcatctcttatggcgggggatggagactgtccgcccagtggcagaagggcgaggaagtgcaagtcattgcggtggagcccgggaaaaaccctaagaatttccagacgatgcccggaaccttccagacaaccaccggcgaaatcggggctattgcccttgattttaagcccggaacaagcggctcccctatcatcaaccgggagggcaaagttgtggggctgtacggaaatggcgtcgtgacgaagaacgggggatatgttagcggcattgcccagaccaatgctgagccggacgggcccacacctgaactggaggaagagatgttcaaaaagcgcaacctcaccatcatggatctgcatcccggctctggaaaaacaagaaagtaccttcctgccattgtgcgggaagctatcaagcgcagactgcggaccctcattctggcccccacgagagtcgtggcggccgagatggaggaagctctcaaaggcctgcctatccgctatcaaacaaccgccaccaagagcgagcacacagggcgggaaatcgttgaccttatgtgccatgctacctttacaatgagactgctgtccccggtgcgcgtccccaattacaacctcattatcatggatgaggcccacttcaccgaccctgcctctattgctgcgcggggatacatcagcacgagagtgggcatgggggaagccgctgccatttttatgacagccacaccccctggaacagctgatgccttcccccagtccaatgcgccgatccaggacgaggagcgcgacatccctgaacggtcttggaacagcggcaatgagtggattaccgattttgctgggaaaacggtgtggttcgtcccctccatcaaggccggcaacgacattgccaactgtctgcgcaaaaatggaaagaaggttatccagctttctagaaaaacctttgatacagaatatcaaaagaccaaactgaacgactgggatttcgtggtgacaaccgacattagcgagatgggcgctaattttaaggccgatcgggtcatcgaccccagacggtgcctcaaacctgtgattctgacagatgggcccgagcgcgttatcctggcgggacctatgccggtgaccgccgcttccgccgctcagagacggggccgcgtcgggagaaacccccagaaggaaaatgaccagtacatcttcacgggacaacctctcaacaatgatgaggaccatgcccactggacagaagctaagatgcttctggacaacattaatacccccgagggcatcattcctgccctgttcgaacccgagcgggagaaaagcgcggccatcgatggggaatatagactcaagggcgagtctcgcaaaacctttgtggaactgatgcggagaggagaccttccggtttggctggctcacaaggtggcctccgagggcattaaatacacagatcgcaagtggtgcttcgacgggcagcggaacaatcagatcctcgaagagaacatggatgtcgagatctggaccaaagaaggagagaagaagaaactgagacctcgctggctggacgctcggacatatagcgatcccctcgcccttaaggaatttaaagacttcgccgctggcagaaagtctattgcgctggatctggtgacggagatcgggcgcgtcccttcccatctcgcccacagaacccggaatgctctggacaaccttgtgatgctgcatacaagcgaacacggaggcaaagcctaccgccacgccgttgaggagctccccgaaaccatggagacactgctgctccttggcctgatgattctgctcaccgggggagctatgctgtttcttatctccggcaaggggattggaaagacgtctatcggcctgatctgtgtgattgccagctccgggatgctctggatggcggaaatccctctgcagtggattgccagcgctatcgtgctggagttctttatgatggtcctccttattcccgagccggaaaaacaaagaacccctcaggataatcagctggcctatgttgtgatcggcattctgacactcgctgccatcatcgcggccaacgagatgggcctgcttgaaaccacaaagcgggacctgggcatgtctaaagagcccggggtggtctcccccaccagctacctcgatgtggacctgcatcctgcttctgcctggacgctgtacgctgttgccacaaccgtgattacaccgatgctccgccacaccatcgaaaatagcaccgctaacgtctcccttgccgcgattgccaaccaagctgtggtcctgatgggactggacaagggctggcccatctctaaaatggatctcggggtgcctctgcttgccctgggatgctatagccaggttaatcccctcacactgacggctgccgtgctgctccttattacccattacgccatcatcggccctgggctgcaggcgaaggctacaagagaggcccagaagcggaccgctgccggaattatgaaaaaccccacagtcgacggcatcatgaccattgatctggaccctgtgatctatgattccaagttcgagaaacaactcggccaggttatgctgcttgtgctgtgtgccgtccagctcctgctgatgagaacgtcttgggctctctgcgaagcccttacactggcgaccgggccgattaccacactgtgggagggaagccccggcaagttttggaataccacaatcgccgtgtccatggctaacatcttccgcgggagctacctcgccggagctggcctggccttttctattatgaaatccgtggggacgggaaagcggggcaccggcagccagggggaaacacttggagagaagtggaaaaagaaactgaatcaactctccagaaaggagttcgacctgtataaaaagtctggcatcaccgaggttgatcgcacagaggcgaaagaagggctgaagcggggagagattacccaccatgccgtcagcagaggctccgctaagctccagtggtttgtggaacggaacatggtgatccctgaggggcgcgtcattgaccttggatgtggcagaggcgggtggtcttactattgcgccggactgaaaaaggttacggaagtgcggggctacaccaaagggggacccggccacgaggagcctgtgcccatgagcacatacgggtggaatatcgtcaagctgatgtccggaaaagatgtgttctatctcccgcctgaaaagtgtgacaccctgctttgcgatattggcgagagctctccctcccccacagttgaagagagccgcaccatcagagtgctgaagatggtcgagccttggctcaaaaacaatcagttctgtatcaaggtgctgaacccctacatgcctacagttattgaacacctggagcggctccagcgcaaacatggcgggatgcttgtgagaaatccgctgtctcggaactccacccacgaaatgtattggatcagcaatggaacgggcaacattgtcgcttctgtgaatatggtgagccgcctgctcctgaacagatttacaatgacccatcggagacccaccatcgagaaggacgtcgatcttggggccggaacacgccacgttaacgctgaacctgagacgcccaatatggacgtgattggcgagcggatcaaaagaatcaaggaagaacacaactccacctggcattacgacgatgaaaatccttataagacatgggcctaccacgggtcttatgaggtgaaagcgaccggaagcgcctccagcatgattaacggcgtcgtgaagctgctcacaaaaccctgggacgttgtgccgatggtcacccaaatggctatgacagataccacgcctttcggccagcagcgcgtgtttaaggaaaaagttgacacccggacacccagatccatgcctgggacccgccgggtgatgggaatcacagccgagtggctgtggagaaccctgggccgcaataagaagccccggctctgcacgagagaggagttcaccaaaaaggtccgcaccaacgctgccatgggggccgtgtttacagaggaaaatcaatgggattctgcgaaagctgccgttgaggacgaagatttctggaagctggtggaccgggagagagagcttcataaactgggaaagtgtggcagctgcgtctacaacatgatggggaaacgcgaaaagaagctcggcgagtttggaaaagccaagggctccagagctatttggtacatgtggctgggggcccggtatcttgagttcgaggctctgggatttctcaatgaggatcactggttctctcgcgaaaacagctactccggcgtggagggggaaggactgcataaactgggctatatcctcagagacatttctaagatccctgggggcgccatgtacgcggatgacaccgccggatgggacacgcggatcaccgaggatgacctgcacaatgaagagaaaattacacagcagatggatcccgagcacagacagcttgctaacgccatctttaagctgacctatcaaaataaggtcgtgaaagttcagcggccgacacctaccggcacagtgatggacattatcagccgcaaggatcagagagggtccggacaggtcggcacctacgggctcaacacgttcacaaatatggaagctcaactgattcggcagatggagggagaaggcgtgcttagcaaagccgacctggagaacccccatctccccgaaaagaaaatcacccagtggctggagaccaagggggtggagcgcctgaagagaatggcgatctctggcgatgactgcgttgtgaaacctattgatgaccggtttgccaacgctctcctggcccttaatgatatgggaaaggtccgcaaagacatcccgcagtggcaaccctccaagggctggcacgattggcaacaggtgcctttctgtagccatcacttccacgaactgattatgaaagacgggagaaagctcgttgtgccctgccggcctcaggacgagctgatcggacgcgctagaatttctcaaggcgccgggtggtcccttcgggaaacagcttgtctgggaaaggcctatgcgcagatgtggagcctcatgtactttcatcgcagagatctgcggctggcctctaacgctatctgctccgccgtccccgtgcactgggtccctaccagccgcacaacgtggtccattcatgcccaccatcagtggatgaccacagaggacatgctcaccgtgtggaatagagtttggatcgaagataacccctggatggaggacaaaacaccggtgaccacgtgggagaatgtcccttacctgggcaagcgggaagatcaatggtgtgggagccttatcggcctgacctctagagctacatgggcccagaacattcccaccgcgatccaacaggtgcgcagcctcattggaaatgaggagttcctggactatatgccttccatgaaacggtttagaaaggaggaggaatctgagggcgctatctggtga

SEQ ID NO: 20687 - RNA, 9876 nt, synthetic construct
  misc_feature 1..9876: note = derived and/or modified CDS sequence (opt5) from DENV-3__EU687233__SS-prME
  source 1..9876: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcacaaaaaaggaggaacccgtgaacattgaggccgaacctccgttcggcgagtccaatatcgtgattgggatcggcgataacgccctgaaaatcaattggtataagaagggatctagcattggcaaaatgtttgaagctaccgcccggggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgctgaaacacaaaactccagcttcattatcgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacatgcacctggcctaagtcccataccctgtggtctaatggcgtgctcgaaagcgatatgattatccccaaatccctggcggggcctattagccagcacaactatcgccccggataccatacacaaaccgctggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgccggatctggcaaggtggacaacttcaccatgggggtcctgtgcctcgccattctgtttgaagaggtgatgcggggaaagttcggcaaaaagcatatgatcgctggcgttttctttacattcgtgcttctgctcagcgggcagattacctggcgcgatatggcccacacactgatcatgattggatccaatgcgagcgacagaatgggcatgggggtcacctacctggctcttatcgccacgtttaaaatccagcccttcctggccctcggatttttcctgcggaagctcacatctagagaaaacctgcttctgggcgtggggctcgctatggccaccacactgcaactgcctgaggatattgaacagatggctaatggaatcgcccttggcctgatggcgctcaaactgattacccagtttgagacctatcagctctggacagccctgatctcccttacgtgtagcaacaccattttcacactgaccgtggcttggcgcacagccaccctcatcctggctggcgtctccctgcttccggtttgccaatctagctccatgcggaagtctgactggctgcccatgacggtggccgccatgggggtgcctcccctccctctgtttatcttcagcctcaaggatacactgaaaagacgctcctggccccttaatgagggagtcatggctgtgggcctggtttctattctggcgagctccctcctgagaaacgacgtgcctatggccgggccccttgtcgctggaggcctgctcatcgcctgttacgtgattaccgggaccagcgccgatctgacagttgaaaaggctgccgacgtgacctgggaggaagaggcggaacagacaggagtctctcataacctcatgatcacggtggacgatgacggcaccatgcggattaaagatgacgagacagagaatatcctgaccgtccttctgaagacagctctgctcatcgtgtccggcatttttccgtacagcatccctgccaccctgcttgtttggcacacgtggcagaaacagacccgcagatctggggtgctgtgggatgtcccctcccctcccgaaacacaaaaggccgagctcgaagagggagtgtatcggattaaacagcagggcatcttcgggaagacccaggttggagtgggcgtccaaaaggagggggtgtttcatacaatgtggcacgtgacccgcggagctgttctgacatacaacggcaaaagactcgaaccgaattgggccagcgtcaagaaagacctgatttcttatggcgggggatggcggctttccgcgcagtggcagaagggcgaggaagtgcaagtgatcgctgtcgagcctgggaaaaaccccaagaatttccagacgatgcctggaaccttccagacaaccaccggcgaaattggggccatcgccctggattttaagcccggaacaagcggctcccccatcattaaccgcgagggcaaagtggttgggctgtacggaaatggcgtggtcacgaagaacgggggatatgtgagcggcatcgctcagaccaatgccgagcctgacgggccgacacccgaactcgaggaagagatgttcaaaaagagaaacctgaccattatggatcttcaccctggctctggaaaaacacggaagtacctgcccgctatcgttcgcgaagccattaagagacggctcagaaccctgatcctcgcgcctacgcgcgtggtcgccgctgagatggaggaagccctgaaaggccttcccatccggtatcaaacaaccgctaccaagagcgagcatacagggagagaaattgtggacctgatgtgccacgccacctttacaatgcgcctgctctcccctgttcgggtgccgaattacaacctgatcattatggatgaggcccatttcaccgaccccgcttctatcgcggccagaggatacattagcacgcgcgtcggcatgggggaagctgccgccatctttatgacagctacccctcccggaacagccgatgcgttccctcagtccaatgctcccatccaggacgaggagcgggacattccggaaagatcttggaacagcggcaatgagtggatcaccgattttgccgggaaaacggtgtggttcgtgccttccattaaggccggcaacgacatcgctaactgtcttcgcaaaaatggaaagaaggtcattcagctgtctcggaaaacctttgatacagaatatcaaaagaccaaactcaacgactgggatttcgttgtgacaaccgacatcagcgagatgggcgccaattttaaggcggatagagtgattgacccccggcgctgcctgaaacccgtcatcctgacagatgggcctgagagagtgatcctcgccggacccatgcctgttaccgctgcctccgctgcccagcggcgcggcagagtggggcggaacccgcagaaggaaaatgaccagtacattttcacgggacaaccccttaacaatgatgaggaccacgctcattggacagaagccaagatgctgctggacaacatcaatacccctgagggcattatccccgcgctcttcgaacctgagagagagaaaagcgccgctattgatggggaatatcgcctgaagggcgagtctcggaaaacctttgtcgaacttatgagacgcggagacctgcccgtgtggctcgcccacaaggttgcttccgagggcatcaaatacacagatcggaagtggtgcttcgacgggcagagaaacaatcagatcctggaagagaacatggatgtggagatttggaccaaagaaggagagaagaagaaactgcgcccgcggtggctcgacgccagaacatatagcgatcctcttgccctgaaggaatttaaagacttcgctgcgggccgcaagtctatcgccctggatctcgtcacggagattgggagagtgccctcccacctggctcatcggacccgcaatgcccttgacaacctggtcatgctccacacaagcgaacatggaggcaaagcctacagacacgctgtggaggagctgcctgaaaccatggagacactgctccttctgggcctgatgatcctcctgaccgggggagccatgctttttctgatttccggcaaggggatcggaaagacgtctatcggcctcatttgtgttatcgcgagctccgggatgctgtggatggccgaaattcccctgcagtggatcgctagcgccattgtgctcgagttctttatgatggtgcttctgatccctgagcccgaaaaacaacggaccccgcaggataatcagctggcttatgtcgttattggaatcctcacactggccgcgatcattgccgctaacgagatgggccttctggaaaccacaaagcgcgacctcggcatgtctaaagagcctggggtggtgtcccccaccagctacctggatgtcgacctgcaccccgcctctgcttggacgctctacgccgtggctacaaccgttatcacacctatgcttagacataccattgaaaatagcaccgccaacgtgtccctggcggccatcgctaaccaagccgtcgtgctgatgggactcgacaagggctggccgatttctaaaatggatctgggggtcccccttctggctctcggatgctatagccaggtgaatcctctgacactgacggccgccgttctccttctgatcacccactacgcgatcattggccccgggctgcaggctaaggccacacgggaggctcagaagagaaccgccgccggaatcatgaaaaaccctacagtggacggcattatgaccatcgatctcgaccccgtcatttatgattccaagttcgagaaacaactgggccaggtgatgcttctggttctctgtgctgtgcagctgctgctcatgcgcacgtcttgggccctttgcgaagcgctgacactggccaccgggcctatcaccacactctgggagggaagcccgggcaagttttggaataccacaatcgctgtctccatggccaacattttccgggggagctacctggctggagccggccttgcgttttctatcatgaaatccgtggggacgggaaagagaggcaccggcagccagggggaaacactgggagagaagtggaaaaagaaactcaatcaactgtcccgcaaggaattcgacctgtataaaaagtctggcattaccgaggtggatcggacagaggccaaagaagggctcaagagaggagagatcacccatcacgctgttagccggggctccgccaagcttcagtggtttgtcgaacgcaacatggtgattcccgaggggagagtgatcgacctgggatgtggccggggcgggtggtcttactattgcgctggactgaaaaaggtcacggaagttcgcggctacaccaaagggggacctggccatgaggagcccgtgcctatgagcacatacgggtggaatattgtgaagctcatgtccggaaaagatgtcttctatctgcccccggaaaagtgtgacacccttctgtgcgatatcggcgagagctctccttcccccacagtggaagagagcagaaccatccgggttctcaagatggtggagccctggctgaaaaacaatcagttctgtattaaggtcctgaacccttacatgcccacagtgatcgaacacctcgagcgccttcagagaaaacacggcgggatgctggttcggaatcctctgtctcgcaactccacccatgaaatgtattggattagcaatggaacgggcaacatcgtggcctctgtcaatatggtgagcagactcctgcttaaccggtttacaatgacccacagacgcccgaccattgagaaggacgtggatctgggggctggaacacggcatgtcaacgccgaacccgagacgcctaatatggacgttatcggcgagagaatcaaacgcattaaggaagagcacaactccacctggcactacgacgatgaaaatccctataagacatgggcgtaccatgggtcttatgaggtgaaagccaccggaagcgcttccagcatgatcaacggcgtggtcaagctcctgacaaaaccttgggacgtggttcccatggtgacccaaatggccatgacagataccacgccgttcggccagcagcgggtctttaaggaaaaagtggacaccagaacacctcgctccatgcccgggacccggagagttatgggaattacagctgagtggctgtggcgcaccctcggccggaataagaagcctagactgtgcacgcgcgaggaattcacaaaaaaggtgcggaccaacgccgccatgggggcggtctttacagaggaaaatcaatgggattctgctaaagccgccgtggaggacgaagatttctggaagcttgttgacagagagcgcgagctgcacaaactcggaaagtgtggcagctgcgtgtacaacatgatggggaaaagagaaaagaagctgggcgagtttggaaaagctaagggctcccgggccatctggtacatgtggcttggggctcgctatctggaattcgaggccctcggatttctgaatgaggatcattggttctctagagaaaacagctactccggcgtcgagggggaaggactgcacaaactcggctatattctgcgggacatctctaagatccccgggggcgcgatgtacgccgatgacaccgctggatgggacacgagaattaccgaggatgaccttcataatgaagagaaaatcacacagcagatggatcctgagcaccggcagctggccaacgctatttttaagctcacctatcaaaataaggtggtcaaagtgcagcgccccacaccgaccggcacagttatggacatcattagcagaaaggatcagcgggggtccggacaggtgggcacctacgggctgaacacgtgccacagcaatatggaagcccaacttatccgccagatggagggagaaggcgtcctgtctaaagcggacctcgagaaccctcatctgtccgaaaagaaaatcacacagtggctggagaccaagggggtggagagactcaagcggatggccattagcggcgatgactgtgtggttaaacccatcgatgaccgcttcgctaacgccctgcttgctctgaatgatatgggaaaggtgagaaaagacattccccagtggcaaccttctaagggctggcacgattggcagcaggtcccgttttgctcccatcacttccacgaactcatcatgaaagacgggcggaagctggtggttccctgtcgccctcaggacgagcttattggaagagcccggatcagccaaggcgctgggtggtctctgcgcgaaaccgcctgcctcggaaaggcgtatgcccagatgtggtccctgatgtacttccatagacgggatctgcgcctcgctagcaacgccatttgttccgccgtgcccgtccactgggtgcctacaagcagaaccacatggtctatccatgctcaccatcagtggatgacgaccgaggacatgctgacagtctggaatcgggtgtggatcgaagataacccctggatggaggacaaaacccctgttacaacctgggagaatgtgccctaccttggcaagagagaagatcaatggtgcgggagcctgattggcctcacgtcccgcgccacctgggcgcagaacatcccgacagctattcagcaggtccggtctctgatcggaaatgaggaatttcttgactatatgcctagcatgaaaagattccgcaaggaggaggaatccgagggcgccatttggtga

SEQ ID NO: 20688 - RNA, 9873 nt, synthetic construct
  misc_feature 1..9873: note = derived and/or modified CDS sequence (opt5) from DENV-3__EU687234__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaagtgcctttcagcaccgaggacggccaagggaaggcccattccggaagactgattacagcgaaccccgtcgtgaccaaaaaggaggaacccgtgaatatcgaggctgaacctccgttcggcgagtctaacattgttatcgggattggcgataatgccctgaaaatcaactggtataagaagggaagctccatcggcaaaatgtttgaagccacggctagaggggccagacgcatggctattcttggagacacagcctgggatttcggcagcgtcgggggagtgctcaattctctgggcaagatggtgcaccagatctttgggtccgcgtacaccgccctgttcagcggcgtctcttgggtgatgaaaattggaatcggcgttctcctgacctggattgggcttaacagcaagaatacatccatgtcttttagctgcatcgtgattggaatcatcaccctgtatctcggcgctgtcgtgcaggccgacatggggtgtgttattaactggaaaggaaaggagctgaagtgcggctccgggatcttcgtgacaaatgaggtccatacgtggaccgaacagtacaaatttcaagctgatagccccaagcggctggccacagcgattgccggcgcttgggagaacggagtgtgtggcatcagatctaccacacgcatggaaaatcttctctggaaacagattgccaacgagctgaattatatcctgtgggaaaacaatatcaagctcaccgttgtggtcggggacattatcggagtgctggagcagggcaaacggacgcttacccctcagcccatggagctgaagtactcctggaaaacatgggggaaggctaagattgtgaccgccgaaacacaaaacagctctttcatcattgatggacctaacacccccgagtgcccgtccgccagcagagcttggaatgtctgggaagttgaggactatggctttggcgtgttcacaaccaacatctggctcaaactgcgcgaagtgtacacgcagctgtgtgaccaccggcttatgtccgcggccgtcaaggatgagagagctgtgcacgccgacatggggtactggatcgagtctcagaaaaatggaagctggaagctcgaaaaagcctccctgattgaggttaagacatgcacctggcctaagtctcataccctgtggagcaacggcgtgctcgaatccgatatgatcattcccaaaagcctggctgggcctatctctcagcacaattatcgccccggataccatacacaaaccgccggcccttggcaccttgggaagctggagctcgactttaactattgcgagggaacgacagtcgtgattaccgaaaattgtggcacacggggcccctccctgagaaccacaaccgttagcgggaaactgatccacgagtggtgctgtcgctcttgcacgcttccgcctctccggtacatgggagaagatggctgttggtatgggatggagatcagacccatttccgaaaaggaggagaacatggtgaaaagcctggtctctgcgggaagcggcaaggtggacaatttcaccatgggggttctgtgcctcgctatcctgtttgaagaggtgatgcggggaaagttcggcaaaaagcatatgattgccggcgtcttctttacattcgtgcttctgctctccgggcagatcacctggcgcgatatggcccacacactgattatgatcggaagcaacgcttctgacagaatgggcatgggggtgacctacctggcccttattgcgacgtttaaaatccagcccttcctggctctcggatttttcctgcggaagctcacatccagagaaaatctgcttctgggcgtcgggctcgccatggccaccacactgcaactgcctgaggatatcgaacagatggctaacggaattgcccttggcctgatggctctcaaactgatcacccagtttgagacctatcagctctggacagccctgattagccttacgtgttccaataccatcttcacactgaccgttgcgtggcgcacagccaccctcattctggctggcgtgtctctgcttccggtgtgccaaagctcctctatgcggaagacggactggctgcccatgacagtcgccgctatgggggtgcctcccctccctctgtttatcttcagcctcaaggataccctgaaaagacgctcctggccccttaacgagggagttatggccgtgggcctggtctctatcctggccagctccctcctgagaaatgacgtgcctatggctgggccccttgttgcgggaggcctgctcattgcctgttacgtgatcaccgggacaagcgctgatctgaccgtcgaaaaggccgccgacgtgacatgggaggaagaggctgaacagacgggagtctctcataacctcatgattaccgtggacgatgacggcacaatgcggatcaaagatgacgagaccgagaacattctgacagttcttctgaagaccgccctgctcatcgtgtccggcatctttccgtacagcattcctgcgacgctgcttgtctggcacacctggcagaaacagacacaacgctctggggtgctgtgggatgttccctcccctcccgaaacccagaaggctgagctcgaagagggagtgtatagaatcaaacagcagggcattttcgggaagacacaagtcggagtgggcgtgcagaaggagggggtttttcataccatgtggcacgtcacacggggagccgtgctgacgtacaatggcaaacgcctcgaaccgaactgggccagcgtgaagaaagacctgatctcttatggcgggggatggagactttccgctcagtggcaaaagggcgaggaagtccaggtgattgccgttgagcctgggaaaaatcccaagaacttccagaccatgcctggaacattccagaccaccacaggcgaaatcggggcgattgctctggattttaagcccggaacgagcggctcccccatcatcaatcgggagggcaaagtggtcgggctgtacggaaacggcgtggttaccaagaatgggggatatgtgagcggcattgcccaaacaaacgccgagcctgacgggccgacccccgaactcgaggaagagatgttcaaaaagcgcaatctgacaatcatggatcttcaccctggctctggaaaaaccagaaagtacctgcccgctattgtccgggaagccatcaagcgcagactccggacgctgattctcgctcctacaagagtggttgccgcggagatggaggaagccctgaaaggccttcccatccgctatcagaccaccgctacaaagagcgagcataccgggcgggaaatcgtggacctgatgtgccacgccacatttaccatgagactgctctcccctgtccgcgtgccgaactacaatctgattatcatggatgaggctcatttcacggaccccgcctctattgccgctcggggatacatcagcacaagagtgggcatgggggaagcggccgctatttttatgaccgccacacctcccggaaccgccgatgctttccctcagtccaacgcccccatccaggacgaggagcgcgacatcccggaacggtcttggaatagcggcaacgagtggattacggattttgcggggaaaaccgtctggttcgttccttccatcaaggctggcaatgacattgccaactgtcttcgcaaaaacggaaagaaggtgatccaactgtctagaaaaacatttgataccgaatatcagaagacaaaactcaatgactgggatttcgtggtcaccacagacattagcgagatgggcgccaactttaaggctgatcgggtgatcgaccccagacggtgcctgaaacccgttattctgaccgatgggcctgagcgcgtgatcctcgccggacccatgcctgtcacggcggcctccgctgcccagagacggggccgcgtggggagaaatccgcagaaggaaaacgaccaatacatcttcacaggacagccccttaataacgatgaggaccacgctcattggaccgaagccaagatgctgctggacaatattaacacccctgagggcatcattcccgctctcttcgaacctgagcgggagaaaagcgccgcgatcgatggggaatatagactgaagggcgagtctcgcaaaacatttgttgaacttatgcggagaggagacctgcccgtgtggctcgcccacaaggtcgcttccgagggcattaaatacaccgatcgcaagtggtgcttcgacgggcagcggaataaccagatcctggaagagaatatggatgtggagatctggacaaaagaaggagagaagaagaaactgagaccgcgctggctcgacgcccggacgtatagcgatcctcttgctctgaaggaatttaaagacttcgccgccggcagaaagtctattgctctggatctcgtcaccgagatcgggcgcgtgccctcccacctggcgcatagaacacggaacgcccttgacaatctggttatgctccacaccagcgaacatggaggccgcgcttacagacacgccgtggaggagctgcctgaaacaatggagaccctgctccttctgggcctgatgattctcctgacagggggagccatgctttttctgatctccggcaaagggattggaaagacctctatcggcctcatctgtgtgattgctagctccgggatgctgtggatggccgaaatccccctgcaatggattgcgagcgccatcgtcctcgagttctttatgatggttcttctgattcctgagcccgaaaagcagcggacaccgcaggataaccaactggcttatgtggtgatcggcattctcaccctggccgctatcatcgccgcgaatgagatgggccttctggaaacaaccaaacgcgacctcggcatgtctaaggagcctggggtcgtgtcccccacgagctacctggatgttgacctgcaccccgcctctgcttggacactctacgccgtggctaccacagtcattacccctatgcttagacataccatcgaaaacagcacagccaatgtgtccctggctgccattgcgaaccaggccgtcgtgctgatgggactcgacaaaggctggccgatctctaagatggatctgggggttccccttctggctctcggatgctatagccaggtgaaccctctgacgctgaccgccgctgtcctccttctgattacacactacgccatcatcggccccgggctgcaggccaaagcgacccgggaggctcaaaagagaacagccgctggaattatgaagaatcctaccgtggacggcatcatgacgattgatctcgaccccgttatctatgattccaaattcgagaagcagctgggccaggtgatgcttctggtcctctgtgccgtgcagctgctgctcatgcgcacatcttgggccctttgcgaagctctgaccctggccaccgggcctattacaaccctctgggagggaagcccgggcaaattttggaacacaacgatcgcggtgtccatggccaatatcttccgggggagctacctggctggagccggccttgctttttctattatgaagtccgttgggaccggaaaaagaggcacaggcagccaaggggaaaccctgggagagaagtggaagaaaaagctcaaccagctgtcccgcaaagagttcgacctgtataagaaatctggcatcacagaggtcgatcggaccgaggccaaggaagggctcaaaagaggagagattacgcatcacgcggtgagccggggctccgccaaacttcagtggtttgtggaacgcaatatggtcatccccgaggggagagttattgacctgggatgtggccggggcgggtggtcttactattgcgctggactgaagaaagtgaccgaagtgcgcggctacacaaaagggggacctggccatgaggagcccgtccctatgagcacctacgggtggaacatcgtgaaactcatgtccggaaaggatgttttctatctgcccccggaaaaatgtgacacacttctgtgcgatattggcgagagctctccttcccccaccgtggaagagagcagaacaatccgggtcctcaagatggtggagccctggctgaagaataaccagttctgtatcaaagttctgaatccttacatgcccaccgtgattgaacacctcgagcgccttcaaagaaagcacggcgggatgctggtccggaaccctctgtctcgcaattccacgcatgaaatgtattggatcagcaacggaacaggcaatattgtggcctctgtgaacatggtcagcagactcctgcttaatcggtttaccatgacccacagacgcccgacaatcgagaaagacgttgatctgggggctggaacgcggcatgtgaacgccgaacccgagacccctaacatggacgtgattggcgagagaatcaagcgcatcaaagaagaacacaattccacatggcactacgacgatgaaaacccctataagacctgggcttaccatgggtcttatgaggtcaaggccacaggaagcgcgtccagcatgattaatggcgtggttaaactcctgaccaagccttgggacgtggtccccatggtgacacagatggccatgaccgatacgaccccgttcggccagcaacgggtttttaaagaaaaggtggacacaagaacccctcgctccatgcccgggacacggagagtcatgggaatcaccgctgagtggctgtggcgcacgctcggccggaacaaaaagcctagactgtgcacacgcgaggagttcaccaagaaagtgcggacaaatgccgctatgggggccgtttttaccgaggaaaaccagtgggattctgccaaggcggctgtggaggacgaagatttctggattcttgtcgacagagagcgcgagctgcacaaactcggaaagtgtggcagctgcgtgtacaatatgatggggaaaagagaaaagaaactgggcgagtttggaaaggccaagggctcccgggccatctggtacatgtggcttggggctcgctatctggagttcgaggccctcggatttctgaacgaggatcattggttctctagagaaaatagctactccggcgtcgagggggaaggactgcacaaactcggctatattctgcgggacatctctaagatccccgggggcgctatgtacgccgatgacacggcgggatgggacaccagaattacagaggatgaccttcataacgaagagaaaatcacccagcagatggatcctgagcaccggcaactggccagcgctatttttaagctcacatatcagaataaagtggttaaggtgcagcgccccaccccgacaggcaccgtcatggacatcatttccagaaaggatcagcgggggagcggacaagtgggcacgtacgggctgaacacattcaccaatatggaagcccagcttatccgccagatggagggagaaggcgtgctgtctaaagctgacctcgagaaccctcatctgcccgaaaagaaaatcacccagtggctggagacaaagggggttgagagactcaaacggatggccatttccggcgatgactgcgtggtcaagcccatcgatgaccgctttgcgaatgccctgcttgctctgaacgatatgggaaaggtgagaaaagacattcctcaatggcagccgagcaagggctggcatgattggcagcaggttcccttctgttctcaccatttccacgaactcatcatgaaagacgggcggaagctggtggtcccttgccgcccccaagacgagcttattggacgggcccggatctcccagggcgctgggtggagcctgcgcgaaaccgcctgtctcggaaaggcttatgcccagatgtggtctctgatgtactttcacagacgggatctgcgcctcgcgtccaacgccatttgcagcgctgtgcctgtccattgggtgcccacatccagaacgacctggagcatccacgcccatcaccaatggatgacaaccgaggacatgctgacagtttggaatcgggtgtggatcgaagataacccttggatggaggacaagacccccgtcacgacctgggagaatgtgccgtaccttggcaagagagaagatcagtggtgtgggtctctgattggcctcacaagccgcgccacctgggctcagaacatccctacagccattcagcaagttcggtccctgatcggaaatgaggagttccttgactatatgccctctatgaaaagatttcgcaaggaggaggaaagcgagggcgcgatttggtga

SEQ ID NO: 20689 - RNA, 9873 nt, synthetic construct
  misc_feature 1..9873: note = derived and/or modified CDS sequence (opt5) from DENV-3__EU687196__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtcacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttatcttcacctttgtgcttctgctcagcgggcagattacatggcgcgatgtcgctcacaccctgatcatgattggatccaatgccagcgacagaatgggcatgggggtgacgtacctggcgcttatcgctacattcaaaatccagccctttctggccctcggattctttctgcggaagctcacctctagagaaaacctgcttctgggcgtggggctcgccatggctacaaccctgcaactgcctgaggatattgaacagatggccaatggaatcgctcttggcctgatggccctcaaactgaccacacagttcgagacgtatcagctctggaccgcgctgatttcccttacatgtagcaacaccatctttacactgaccgtcgcctggcgcacggctacactcattctggccggcgtttccctgcttccggtgtgccaatctagctccatgcggaagaccgactggctgcccatgaccgtggctgccatgggggtccctcccctccctctgttcatcttttctctcaaggatacactgaaaagacgcagctggccccttaatgagggagtgatggccgttggcctggtgtccatcctggcttctagcctcctgagaaacgacgtccctatggcggggccccttgtggccggaggcctgctcattgcttgttacgttatcaccgggacatccgccgatctgacggtggaaaaggccgctgacgtcacctgggaggaagaggccgaacagacaggagtgagccataacctcatgattaccgtcgacgatgacggcacaatgcggatcaaagatgacgagaccgagaatattctgacggtgcttctgaagaccgcgctgctcatcgtttctggcatcttcccgtactccattcctgctacactgcttgtgtggcacacctggcagaaacagacacaacgcagcggggtcctgtgggatgtgccctctcctcccgaaacccagaaggccgagctcgaagagggagtttatagaatcaaacagcagggcatttttgggaagacacaagtgggagtcggcgtgcagaaggagggggtgttccatacgatgtggcacgttacccggggagccgtcctgacatacaacggcaaacgcctcgaaccgaattgggcttccgtgaagaaagacctgatcagctatggcgggggatggagactttctgcccagtggcaaaagggcgaggaagtgcaggtcattgcggtggagcctgggaaaaaccccaagaattttcagaccatgcctggaatcttccagaccacaacgggcgaaattggggctatcgccctggatttcaagcccggaacctccggcagccccatcattaaccgggagggcaaagttgtggggctgtacggaaatggcgtcgtgacaaagaacgggggatatgtttccggcatcgcccaaaccaatgctgagcctgacgggccgacacccgaactcgaggaagagatgtttaaaaagcgcaacctgaccattatggatcttcaccctggcagcggaaaaacgagaaagtacctgcccgccatcgtgcgggaagctattaagcgcagactccggacactgatcctcgcccctaccagagtcgtggcggccgagatggaggaagctctgaaaggccttcccatccgctatcagaccacagccaccaagtctgagcatacagggcgggaaattgttgacctgatgtgccacgctaccttcacgatgagactgctcagccctgtgcgcgtcccgaattacaacctgatcattatggatgaggcccattttacagaccccgcctccatcgctgcgcggggatacatttctaccagagtgggcatgggggaagccgctgccatcttcatgacagccacccctcccggaacggctgatgcctttcctcagagcaatgcgcccatccaggacgaggagcgcgacattccggaacggtcctggaactctggcaatgagtggatcaccgatttcgctgggaaaacagtgtggtttgtccctagcattaaggccggcaacgacatcgccaactgtcttcgcaaaaatggaaagaaggttattcaactgtccagaaaaaccttcgatacagaatatcagaagaccaaactcaacgactgggattttgtggtgacaaccgacatctctgagatgggcgctaatttcaaggccgatcgggtcattgaccccagacggtgcctgaaacccgtgatcctgacggatgggcctgagcgcgttatcctcgcgggacccatgcctgtgacagccgctagcgccgctcagagacggggccgcgtcgggagaaacccgcagaaggaaaatgaccaatacatttttaccggacagccccttaacaatgatgaggaccacgcccattggaccgaagctaagatgctgctggacaacatcaatacacctgagggcattatccccgccctcttcgaacctgagcgggagaaatccgcggccattgatggggaatatagactgaagggcgagagccgcaaaaccttcgtggaacttatgcggagaggagacctgcccgtttggctcgctcacaaggtggcctctgagggcatcaaatacacagatcgcaagtggtgctttgacgggcagcggaacaatcagatcctggaagagaacatggatgtcgagatttggacgaaagaaggagagaagaagaaactgagaccgcgctggctcgacgctcggacctattccgatcctcttgccctgaaggagttcaaagactttgccgctggcagaaagagcatcgcgctggatctcgtgacagagattgggcgcgtcccctctcacctggcccatagaacccggaatgctcttgacaacctggtgatgctccacatgtccgaacatggaggcaaagcctaccgccacgccgttgaggagctgcctgaaacaatggagaccctgctccttctgggcctgatgatcctcctgacagggggagctatgcttttcctgattagcggcaaggggatcggaaagacctccatcggcctcatttgtgtgatcgcctctagcgggatgctgtggatggcggaaattcccctgcaatggatcgcctccgctattgtgctcgagtttttcatgatggtccttctgatccctgagcccgaaaaacagagaacaccgcaggataatcaactggcctatgttgtgattggaatcctcaccctggctgccatcattgcggccaacgagatgggccttctggaaacaaccaagcgggacctcggcatgagcaaagagcctggggtggtctctcccacgtcctacctggatgtggacctgcaccccgctagcgcctggacactctacgctgttgccaccacagtgatcacccctatgcttcgccataccattgaaaattctacagctaacgtcagcctggccgcgatcgccaaccaggctgtggtcctgatgggactcgacaagggctggccgatttccaaaatggatctgggggtgccccttctggccctcggatgctattctcaggttaatcctctgacgctgaccgctgccgtgctccttctgatcacacactacgccatcattggccccgggctgcaggcgaaggctaccagagaggcccaaaagcggacagctgccggaatcatgaaaaaccctaccgtcgacggcattatgacgatcgatctcgaccccgtgatttatgatagcaagtttgagaaacagctgggccaggttatgcttctggtgctctgtgccgtccagctgctgctcatgagaacatcctgggctctttgcgaagccctgaccctggcgaccgggcctatcacaaccctctgggagggatctccgggcaagttctggaatacaacgatcgccgtgagcatggctaacatttttcgcgggtcctacctggccggagctggccttgccttcagcatcatgaaatctgtggggaccggaaagcggggcacaggctcccaaggggaaaccctgggagagaagtggaaaaagaaactcaatcagctgagcagaaaggaatttgacctgtataaaaagtccggcattacagaggttgatcgcaccgaggcgaaagaagggctcaagcggggagagatcacgcatcacgccgtctctagaggcagcgctaaacttcagtggttcgtggaacggaacatggtgattcccgaggggcgcgtcatcgacctgggatgtggcagaggcgggtggtcctactattgcgccggactgaaaaaggttaccgaagtgcggggctacacaaaagggggacctggccatgaggagcccgtgcctatgtctacctacgggtggaatattgtcaagctcatgagcggaaaagatgtgttttatctgcccccggaaaagtgtgacacacttctgtgcgatatcggcgagtccagcccttctcccaccgttgaagagtcccgcacagtgagagtcctcaagatggtggagccctggctgaaaaacaatcagttctgtatcaaggttctgaacccttacatgcccaccgtgattgaacacctcgagcggcttcaacgcaaacacggcgggatgctggtcagaaatcctctgagccggaactctacgcatgaaatgtattggatctccaatggaacaggcaacattgtggctagcgtgaatatggtctctcgcctcctgcttaacagattcaccatgacccaccggagaccgacaatcgagaaggacgttgatctgggggccggaacgcgccatgtgaacgctgaacccgagacccctaatatggacgtgattggcgagcggatcaaaagaatcaaggaagaacacattagcacatggcactacgacgatgaaaacccctataagacctgggcctaccatgggtcctatgaggtcaaagcgacaggatctgccagctccatgatcaatggcgtggttaagctcctgaccaaaccttgggacgtggtccccatggtgacacagatggctatgaccgatacgaccccgtttggccagcaacgcgttttcaaggaaaaagtggacacacggacccctagaagcatgcccgggacacgccgggtcatgggaattaccgccgagtggctgtggagaacgctcggccgcaacaagaagcctcggctgtgcacaagagaggaatttaccaaaaaggtgcgcacaaatgctgccatgggggccgttttcaccgaggaaaaccagtgggattccgcgaaagctgccgtggaggacgaagatttttggaaacttgtcgaccgggagagagagctgcacaaactcggaaagtgtggctcttgcgtgtacaatatgatggggaaacgcgaaaagaagctgggcgagttcggaaaagccaagggcagcagagctatctggtacatgtggcttggggcccggtatctggaatttgaggctctcggattcctgaacgaggatcattggttttcccgcgaaaattcttacagcggcgtcgagggggaaggactgcacaaactcggctatattctgagagacatctccaagatccccgggggcgccatgtacgcggatgacacggccggatgggacacccggattacagaggatgaccttcataacgaagagaaaatcacccagcagatggatcctgagcacagacaactggctaatgccattttcaagctcacatatcagaacaaggtggttaaagtgcagcggcccaccccgacaggcaccgtcatggacatcatttctcgcaaggatcagagagggagcggacaagtgggcacgtacgggctgaatacatttaccaacatggaagctcagcttatccggcagatggagggagaaggcgtgctgtccaaagccgacctcgagaatcctcatctgcccgaaaagaaaatcacccagtggctggagacaaagggggttgagcgcctcaagagaatggcgattagcggcgatgactgcgtggtcaaacccatcgatgaccggttcgccaacgctctgcttgccctgaacgatatgggaaaggtgcgcaaagacattcctcaatggcagccgtctaagggctggcatgattggcagcaggttcccttttgttcccaccatttccacgaactcatcatgaaagacgggagaaagctggtggtcccttgccggccccaagacgagcttattggacgcgctagaatcagccagggcgccgggtggtctttccgggaaaccgcttgtctgggaaaggcctatgcgcagatgtggtccctcatgtactttcaccgcagagatctgcggctggccagcaatgctatttgctctgccgtgcctgtccattgggtgcccacatcccgcacgacctggagcatccacgcccatcaccaatggatgacaaccgaggacatgctcacagtttggaacagagtgtggatcgaagataatccttggatggaggacaaaacccccgtcacgacctgggagaacgtgccgtacctgggcaagcgggaagatcagtggtgtgggtcccttattggcctgacaagcagagctacctgggcccagaatatccctacagcgattcagcaagttcgctctctcatcggaaacgaggagttcctggactatatgcccagcatgaaacggtttagaaaggaggaggaatccgagggcgctatttggtga

SEQ ID NO: 20690 - RNA, 9873 nt, synthetic construct
  misc_feature 1..9873: note = derived and/or modified CDS sequence (opt5) from DENV-3__EU854298__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgaacgcttctagagcgtggaatgtgtgggaagtggaggactatggctttggcgtcttcacaaccaacatctggctcaaactgcgcgaagttcacacgcagctgtgtgaccaccggcttatgtccgccgctgtgaaggatgagagagccgtgcatgccgacatggggtactggattgagagccagaaaaatggatcctggaagctcgaaaaggcttctctgatcgaggtcaagacatgcacctggcctaagagccacaccctgtggtccaacggcgtgctcgaatctgatatgattatccccaaaagcctggccgggcctatttcccagcataattaccgccccggatatcacacacaaaccgcgggcccttggcaccttgggaagctggagctcgactttaactactgcgagggaacgacagttgtgatcaccgaaaattgtggcacacggggccccagcctgagaaccacaaccgtctctgggaaactgatccatgagtggtgctgtcgctcctgcacgcttccgcctctccggtatatgggagaagatggctgttggtacgggatggagattagacccatcagcgaaaaggaggagaacatggtgaaatctctggtttccgctggaagcggcaaggtggacaatttcaccatgggggtcctgtgcctcgccattctgtttgaagaggtgatgcggggaaagttcggcaaaaagcacatgatcgccggcgttttctttacattcgtgcttctgctctctgggcagattacctggcgcgatatggctcatacactgatcatgattggaagcaacgcctccgacagaatgggcatgggggtcacctatctggcgcttatcgctacgtttaaaatccagcccttcctggccctcggatttttcctgcggaagctcacaagcagagaaaatctgcttctgggcgtggggctcgccatggctaccacactgcaactgcctgaggatattgaacagatggccaacggaatcgctcttggcctgatggccctcaaactgattacccagtttgagacctaccagctctggacagcgctgatctctcttacgtgttccaataccattttcacactgaccgtggcctggcgcacagctaccctcatcctggccggcgtcagcctgcttccggtttgccaatcctctagcatgcggaagacggactggctgcccatgacagtggctgccatgggggtgcctcccctccctctgtttatcttctccctcaaggataccctgaaaagacgctcttggccccttaacgagggagtcatggccgtgggcctggttagcattctggcttcctctctcctgagaaacgacgtgcctatggcggggccccttgtcgccggaggcctgctcatcgcttgttatgtgattaccgggacaagcgccgatctgaccgttgaaaaggccgctgacgtgacatgggaggaagaggccgaacagacgggagtctcccacaatctcatgatcaccgtggacgatgacggcacaatgcggattaaagatgacgagaccgagaacatcctgacagtccttctgaagaccgcgctgctcatcgtgagcggcatttttccgtactctatccctgctacgctgcttgtttggcatacctggcagaaacagacacaacgctccggggtgctgtgggatgtccccagccctcccgaaacccagaaggccgagctcgaagagggagtgtacagaattaaacagcagggcatcttcgggaagacacaagttggagtgggcgtccagaaggagggggtgtttcacaccatgtggcacgtgacacggggagccgttctggcttataatggcaaacgcctcgaaccgaactgggcctctgtcaagaaagacctgatttcctacggcgggggatggagacttagcgcgcagtggcaaaagggcgaggaagtccaggtgatcgctgtcgagcctgggaaaaatcccaagaacttccagacgattcctggaaccttccagacaaccaccggcgaaatcggggccatcgccctggattttaagcccggaacatctggctcccccattatcaatcgggagggcaaagtggttgggctgtatggaaacggcgtggtcacgaagaatgggggatacgtgagcggcattgctcaaaccaacgccgagcctgacgggccgacacccgaactcgaggaagagatgttcaaaaagcgcaatctgaccatcatggatcttcatcctggctccggaaaaacaagaaagtatctgcccgctattgttcgggaagccatcaagcgcagactccggaccctgatcctcgcgcctacgagagtggtcgccgctgagatggaggaagccctgaaaggccttcccattcgctaccagacaaccgctaccaagagcgagcacacagggcgggaaatcgtggacctgatgtgccatgccacctttacaatgagactgctctctcctgttcgcgtgccgaactataatctgattatcatggatgaggcccacttcaccgaccccgctagcattgcggcccggggatacatctccacgagagtcggcatgggggaagctgccgccatctttatgacagctacccctcccggaacagccgatgcgttccctcagtctaacgctcccattcaggacgaggagcgcgacatcccggaacggagctggaactccggcaacgagtggattaccgattttgccgggaaaacggtgtggttcgtgccttctatcaaggccggcaacgacattgctaattgtcttcgcaaaaacggaaagaaggtcatccaactgagcagaaaaacctttgatacagaataccagaagaccaaactcaatgactgggatttcgttgtgacaaccgacatttccgagatgggcgccaactttaaggcggatcgggtgatcgaccccagacggtgcctgaaacccgtcatcctgacagatgggcctgagcgcgtgattctcgccggacccatgcctgttaccgctgcctctgctgcccagagacggggccgcgtggggagaaatccgcagaaggaaaacgaccaatatatcttcacgggacagccccttaataacgatgaggaccatgctcactggacagaagccaagatgctgctggacaatattaacacccctgagggcatcattcccgccctcttcgaacctgagcgggagaaaagcgccgctatcgatggggaatacagactgaagggcgagtcccgcaaaacctttgtcgaacttatgcggagaggagacctgcccgtgtggctcgcccacaaggttgctagcgagggcatcaaatatacagatcgcaagtggtgcttcgacgggcagcggaataaccagattctggaagagaatatggatgtggagatctggaccaaagaaggagagagaaagaagctgcgcccgcggtggctcgacgccagaacatactctgatcctcttgccctgaaagaatttaaggacttcgctgcgggccgcaaatccattgccctggatctcgtcacggagatcgggagagtgcccagccatctggctcaccggacccgcaacgcccttgacaatctggtcatgctccatacatctgaacacggaggcaaggcctatagacacgctgtggaggagctgcctgaaaccatggagacactgctccttctgggcctgatgattctcctgaccgggggagccatgctttttctgatctccggcaaagggatcggaaagacgagcattggcctcatctgtgttattgcgtcctctgggatgctgtggatggccgaaatccccctgcaatggattgctagcgccatcgtgctcgagttctttatgatggtgcttctgattcctgagcccgaaaagcagcggaccccgcaggataaccaactggcttacgtcgttatcggaatcctcacactggccgcgattatcgccgctaatgagatgggccttctggaaaccacaaaacgcgacctcggcatgtccaaggagcctggggtggtgagccccacctcttatctggatgtcgacctgcatcccgcctccgcttggacgctctacgccgtggctacaaccgttattacacctatgcttagacacaccatcgaaaacagcaccgccaacgtgtctctggcggccattgctaatcaggccgtcgtgctgatgggactcgacaaaggctggccgatcagcaagatggatctgggggtcccccttctggctctcggatgctactcccaggtgaaccctctgacactgacggccgccgttctccttctgatcacccattatgcgattatcggccccgggctgcaggctaaagccacacgggaggctcaaaagagaaccgccgccggaattatgaagaatcctacagtggacggcatcatgaccattgatctcgaccccgtcatctacgattctaaattcgagaagcagctgggccaggtgatgcttctggttctctgtgctgtgcagctgctgctcatgcgcacgagctgggccctttgcgaagcgctgacactggccaccgggcctatcaccacactctgggagggatccccgggcaaattttggaacaccacaattgctgtctctatggccaatatcttccgggggagctatctggctggagccggccttgcgttttccattatgaaaagcgtggggacgggaaaaagaggcaccggctctcaaggggaaacactgggagagaagtggaagaaaaagctcaaccagctgtcccgcaaagagttcgacctgtacaagaaaagcggcatcaccgaggtggatcggacagaggccaaggaagggctcaaaagaggagagattacccaccatgctgtttcccggggctctgccaaacttcagtggtttgtcgaacgcaatatggtgatccccgaggggagagtgattgacctgggatgtggccggggcgggtggagctattactgcgctggactgaagaaagtcacggaagttcgcggctataccaaagggggacctggccacgaggagcccgtgcctatgtccacatacgggtggaacatcgtgaaactcatgtctggaaaggatgtcttctacctgcccccggaaaaatgtgacacccttctgtgcgatatcggcgagagctcccctagccccacagtggaagagtctagaaccattcgggttctcaagatggtggagccctggctgaagaataaccagttctgtatcaaagtcctgaatccttatatgcccacagtgattgaacacctcgagcgccttcaaagaaagcatggcgggatgctggttcggaaccctctgtcccgcaatagcacccacgaaatgtactggatctctaacggaacgggcaatattgtggcctccgtcaacatggtgagcagactcctgcttaaccggtttacaatgacccatagacgcccgaccatcgagaaagacgtggatctgggggctggaacacggcacgtcaatgccgaacccgagacgcctaacatggacgttatcggcgagagaattaagcgcatcaaagaagaacacaattctacctggcattatgacgatgaaaacccctacaagacatgggcgtatcacgggagctacgaggtgaaggccaccggatccgcttctagcatgattaatggcgtggtcaaactcctgacaaagccttgggacgtggttcccatggtgacccagatggccatgacagataccacgccgttcggccagcaacgggtctttaaagaaaaggtggacaccagaacacctcgctccatgcccgggacccggagagttatgggaatcacagctgagtggctgtggcgcaccctcggccggaacaaaaagcctagactgtgcacgcgcgaggagttcacaaagaaagtgcggaccaatgccgccatgggggcggtctttacagaggaaaaccagtgggatagcgctaaggccgccgtggaggacgaagatttctggaaacttgttgacagagagcgcgagctgcataagctcggaaaatgtggctcctgcgtgtataatatgatggggaagagagagaagaagctgggcgagtttggaaaggctaaaggctctcgggccatttggtacatgtggcttggggctcgctacctggagttcgaggccctcggatttctgaacgaggatcactggttcagcagagaaaattcctattctggcgtcgagggggaaggactgcataagctcggctacatcctgcgggacatcagcaaaattcccgggggcgcgatgtatgccgatgacaccgctggatgggacacgagaatcaccgaggatgaccttcacaacgaagagaagattacacagcagatggatcctgagcaccggcaactggccaatgctatctttaaactcacctaccagaacaaggtggtcaaggtgcagcgccccacaccgaccggcacagttatggacattatctccagaaaagatcagcgggggtctggacaagtgggcacctatgggctgaatacgttcacaaacatggaagtccagcttatccgccagatggagggagaaggcgtgctgagcaaggccgacctcgagaaccctcatctgcccgagaagaagattacccagtggctggagaccaaaggggtggagagactcaagcggatggcgatctccggcgatgactgcgttgtgaagcccattgatgaccgctttgccaatgctctgcttgccctgaacgatatgggaaaagtcagaaaggacatccctcaatggcagccgagcaaaggctggcacgattggcaacaggtgcccttctgttctcatcacttccacgaactcattatgaaggacgggcggaaactggttgtgccttgccgcccccaagacgagcttatcggacgggctcggatttcccagggcgccgggtggagcctgcgcgaaacagcttgtctcggaaaggcctacgcgcagatgtggtctctgatgtattttcatagacgggatctgcgcctcgcctccaatgctatctgcagcgccgtccctgtgcactgggtccccacctctagaacaacgtggtccatccatgcccaccatcaatggatgaccacagaggacatgctgaccgtgtggaaccgggtttggattgaagataatccttggatggaggacaagacacccgtgaccacgtgggagaacgtcccgtaccttggcaaaagagaagatcagtggtgtgggagcctgatcggcctcacctcccgcgctacatgggcccagaatattcctaccgcgatccaccaggtgcggagcctgattggaaacgaggagttccttgactacatgccctctatgaagagatttcgcaaagaggaggaactggagggcgctatctggtga

SEQ ID NO: 20691 - RNA, 9873 nt, synthetic construct
  misc_feature 1..9873: note = derived and/or modified CDS sequence (opt5) from DENV-3__FJ373306__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacgtggggacgtccctcacacagaaggtcgtgatcttcattctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacagctggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaagtccctttcagcaccgaggacggccaagggaaggcccataacggaagactgatcacagcgaatcccgtggtgaccaaaaaggaggaacccgttaacattgaggctgaacctccgttcggcgagtccaatatcgtcattgggatcggcgataacgccctgaaaattaattggtataagaagggatctagcatcggcaaaatgtttgaagccacggctagaggggccagacgcatggctatccttggagacacagcctgggatttcggctccgtcgggggagtgctcaacagcctgggcaagatggtccaccagatttttgggtctgcgtacaccgccctgttctccggcgtgagctgggttatgaaaatcggaattggcgtgctcctgacctggatcgggcttaattctaagaacacaagcatgtccttttcttgcattgtcatcggaattatcaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagctgattcccccaagcggctggccacagcgatcgccggcgcttgggagaatggagtttgtggcattagaagcaccacacgcatggaaaaccttctctggaaacagatcgccaatgagctgaactatattctgtgggaaaataacatcaagctcaccgtggtcgtgggggacatcattggagtgctggagcagggcaaacggacgcttacccctcagcccatggagctgaagtactcttggaaaacatgggggaaggctaagatcgtcaccgccgaaacacaaaactccagcttcattatcgatggacctaatacccccgagtgcccgtctgcctccagagcttggaacgtttgggaagtggaggactatggctttggcgtgttcagcacaaatatttggctcaaactgcgcgaagtctacacccagctgtgtgaccaccggcttatgtccgcggccgtgaaggatgagagagctgttcacgccgacatggggtactggatcgagtctcagaaaaacggaagctggaagctcgaaaaagcctccctgatcgaggtgaagacgtgcacatggcctaagtctcataccctgtggagcaatggcgtcctcgaatccgatatgattatccccaaaagcctggctgggcctatttctcagcacaactatcgccccggataccatacccaaacagccggcccttggcaccttgggaagctggagctcgactttaattattgcgagggaaccacggtggttatcacagaaaactgtggcacccggggcccctccctgagaacaaccacagtgagcgggaaactgattcacgagtggtgctgtcgctcttgcacccttccgcctctccggtacatgggagaagatggctgttggtatgggatggagatcagacccatctccgaaaaggaggagaatatggtcaaaagcctggtgtctgcgggaagcggcaaggttgacaacttcacgatgggggtgctgtgcctcgctattctgtttgaagaggtcatgcggggaaagttcggcaaaaagcatatgatcgccggcgtgttctttaccttcgtgcttctgctctccgggcagattacatggcgcgatatggcccacaccctgatcatgattggaagcaatgcttctgacagaatgggcatgggggtcacatacctggcccttatcgcgacctttaaaattcagcccttcctggctctcggatttttcctgcggaagctcacgtccagagaaaacctgcttctgggcgttgggctcgccatggccacaaccctgcaactgcctgaggatatcgaacagatggctaatggaatcgcccttggcctgatggctctcaaactgattacacagtttgagacctatcagctctggaccgccctgatcagccttacatgttccaacacgattttcaccctgacagtggcgtggcgcaccgccacactcatcctggctggcgtgtctctgcttccggtctgccaaagctcctctatgcggaagaccgactggctgcccatgacggtggccgctatgggggttcctcccctccctctgtttattttcagcctcaaggatacactgaaaagacgctcctggccccttaatgagggagtgatggccgtcggcctggtgtctatcctggccagctccctcctgagaaacgacgttcctatggctgggccccttgtggcgggaggcctgctcatcgcctgttacgtcattaccgggaccagcgctgatctgacagtggaaaaggccgccgacgtcacctgggaggaagaggctgaacagacaggagtgtctcataacctcatgatcacggttgacgatgacggcaccatgcggattaaagatgacgagacagagaatatcctgaccgtgcttctgaagacagccctgctcattgtctccggcatctttccgtacagcatccctgcgaccctgcttgtgtggcacacgtggcagaaacagacccaacgctctggggttctgtgggatgtgccctcccctcccgaaacacagaaggctgagctcgaagagggagtctatagaattaaacagcagggcatcttcgggaagacccaagtgggagtgggcgttcagaaggagggggtctttcatacaatgtggcacgtgacccggggagccgtgctgacatacaacggcaaacgcctcgaaccgaattgggccagcgtcaagaaagacctgatttcttatggcgggggatggagactttccgctcagtggcaaaagggcgaggaagtgcaggttatcgccgtggagcctgggaaaaaccccaagaatttccagacgatgcctggaaccttccagacaaccaccggcgaaattggggcgatcgctctggattttaagcccggaacaagcggctcccccattatcaaccgggagggcaaagtcgtggggctgtacggaaatggcgttgtgacgaagaacgggggatatgtcagcggcatcgcccaaaccaatgccgagcctgacgggccgacacccgaactcgaggaagagatgttcaaaaagcgcaacctgaccattatggatcttcaccctggctctggaaaaacaagaaagtacctgcccgctatcgtgcgggaagccattaagcgcagactccggaccctgatcctcgctcctacgagagttgtggccgcggagatggaggaagccctgaaaggccttcccattcgctatcagacaaccgctaccaagagcgagcatacagggcgggaaatcgtcgacctgatgtgccacgccacctttacaatgagactgctctcccctgtgcgcgtgccgaattacaacctgatcattatggatgaggctcatttcaccgaccccgcctctatcgccgctcggggatacattagcacgagagtcggcatgggggaagcggccgctatctttatgacagccacccctcccggaacagccgatgctttccctcagtccaatgcccccattcaggacgaggagcgcgacatcccggaacggtcttggaacagcggcaatgagtggatcaccgattttgcggggaaaacggtttggttcgtgccttccattaaggctggcaacgacatcgccaactgtcttcgcaaaaatggaaagaaggtgattcaactgtctagaaaaacctttgatacagaatatcagaagaccaaactcaacgactgggatttcgtcgtgacaaccgacatcagcgagatgggcgccaattttaaggctgatcgggttattgaccccagacggtgcctgaaacccgtgatcctgacagatgggcctgagcgcgtcattctcgccggacccatgcctgtgaccgcggcctccgctgcccagagacggggccgcgttgggagaaacccgcagaaggaaaatgaccaatacatcttcacgggacagccccttaacaatgatgaggaccacgctcattggacagaagccaagatgctgctggacaacatcaatacccctgagggcattatccccgctctcttcgaacctgagcgggagaaaagcgccgcgattgatggggaatatagactgaagggcgagtctcgcaaaacctttgtggaacttatgcggagaggagacctgcccgtctggctcgcccacaaggtggcttccgagggcatcaaatacacagatcgcaagtggtgcttcgacgggcagcggaacaatcagattctggaagagaacatggatgtcgagatctggaccaaagaaggagagaagaagaaactgagaccgcgctggctcgacgcccggacatatagcgatcctcttgctctgaaggaatttaaagacttcgccgccggcagaaagtctatcgctctggatctcgtgacggagattgggcgcgttccctcccacctggcgcatagaacccggaatgcccttgacaacctggtgatgctccacacaagcgaacatggaggcaaggcttaccgccacgccgtggaggagctgcctgaaaccatggagacactgctccttctgggcctgatgatcctcctgaccgggggagccatgctttttctgatttccggcaaggggatcggaaagacgtctattggcctcatctgtgtcatcgctagctccgggatgctgtggatggccgaaattcccctgcaatggatcgcgagcgccattgttctcgagttctttatgatggtgcttctgatccctgagcccgaaaaacagagaaccccgcaggataatcaactggcttatgtggtcattggaatcctcacactggccgctattatcgccgcgaacgagatgggccttctggaaaccacaaagcgggacctcggcatgtctaaagagcctggggtggtttcccccaccagctacctggatgtggacctgcaccccgcctctgcttggacgctctacgccgtcgctacaaccgtgatcacacctatgcttcgccataccattgaaaatagcaccgccaacgtctccctggctgccatcgcgaaccaggccgtggttctgatgggactcgacaagggctggccgatttctaaaatggatctgggggtgccccttctggctctcggatgctatagccaggtcaatcctctgacactgacggccgctgtgctccttctgatcacccactacgccattatcggccccgggctgcaggccaaggcgacaagagaggctcaaaagcggaccgccgctggaatcatgaaaaaccctacagttgacggcattatgaccatcgatctcgaccccgtgatttatgattccaagttcgagaaacagctgggccaggtcatgcttctggtgctctgtgccgtgcagctgctgctcatgagaacgtcttgggccctttgcgaagctctgacactggccaccgggcctatcaccacactctgggagggaagcccgggcaagttttggaataccacaattgcggtttccatggccaacatcttccgcgggagctacctggctggagccggccttgctttttctatcatgaaatccgtcgggacgggaaagcggggcaccggcagccaaggggaaacactgggagagaagtggaaaaagaaactcaatcagctgtccagaaaggagttcgacctgtataaaaagtctggcattaccgaggtggatcgcacagaggccaaagaagggctcaagcggggagagatcacccatcacgcggtgagcagaggctccgccaaacttcagtggtttgtcgaacggaacatggttattcccgaggggcgcgtgatcgacctgggatgtggcagaggcgggtggtcttactattgcgctggactgaaaaaggtgacggaagtccggggctacaccaaagggggacctggccatgaggagcccgtgcctatgagcacatacgggtggaatattgttaagctcatgtccggaaaagatgtgttctatctgcccccggaaaagtgtgacacccttctgtgcgatatcggcgagagctctccttcccccacagtcgaagagagccgcaccattagagtgctcaagatggttgagccctggctgaaaaacaatcagttctgtatcaaggtgctgaacccttacatgcccacagtcatcgaacacctcgagcggcttcaacgcaaacacggcgggatgctggtgagaaatcctctgtctcggaactccacccatgaaatgtattggattagcaatggaacgggcaacatcgtggcctctgtcaatatggttagccgcctcctgcttaacagatttacaatgacccaccggagaccgaccattgagaaggacgtggatctgggggctggaacacgccatgtgaacgccgaacccgagacgcctaatatggacgtcatcggcgagcggattaaaagaatcaaggaagaacacaactccacctggcactacgacgatgaaaatccctataagacatgggcttaccatgggtcttatgaggtgaaagccaccggaagcgcgtccagcatgatcaacggcgttgtgaagctcctgacaaaaccttgggacgtcgtgcccatggttacccagatggccatgacagataccacgccgttcggccagcaacgcgtgtttaaggaaaaagtcgacacccggacacctagatccatgcccgggacccgccgggtgatgggaattacagctgagtggctgtggagaaccctcggccgcaataagaagcctcggctgtgcacgagagaggagttcaccaaaaaggttcgcaccaacgccgctatgggggccgtgtttacagaggaaaatcagtgggattctgccaaagcggctgtcgaggacgaagatttctggatccttgtggaccgggagagagagctgcacaagctcggaaaatgtggcagctgcgtctacaacatgatggggaagcgcgagaaaaagctgggcgagtttggaaaggccaaaggctccagagccatttggtacatgtggcttggggctcggtatctggagttcgaggccctcggatttctgaatgaggatcattggttctctcgcgaaaacagctactccggcgtggagggggaaggactgcacaagctcggctatatcctgagagacatttctaaaatccccgggggcgctatgtacgccgatgacaccgcgggatgggacacgcggatcaccgaggatgaccttcataatgaagagaagattacacagcagatggatcctgagcacagacaactggccaacgctatctttaaactcacctatcagaataaggttgtgaaggtccagcggcccacaccgaccggcacagtgatggacattatcagccgcaaagatcagagagggtccggacaagtgggcacctacgggctgaacacgttcacaaatatggaagcccagcttattcggcagatggagggagaaggcgttctgagcaaggctgacctcgagaaccctcatctgcccgagaaaaagatcacccagtggctggagaccaaaggggtggagcgcctcaagagaatggccatctctggcgatgactgcgtcgtgaagcccattgatgaccggtttgcgaacgccctgcttgctctgaatgatatgggaaaagttcgcaaggacatccctcaatggcagccgtccaaaggctggcatgattggcaacaggtgcccttctgtagccaccatttccacgaactcattatgaaggacgggagaaaactggtcgtgccttgccggccccaagacgagcttatcggacgcgccagaatttctcagggcgctgggtggtccctgcgggaaacagcctgtctcggaaaggcttatgcccagatgtggagcctgatgtactttcaccgcagagatctgcggctcgcgtctaacgccatctgctccgctgtccctgtgcattgggttcccaccagccgcacaacgtggtccattcacgcccatcaccaatggatgaccacagaggacatgctgaccgtgtggaatagagtctggatcgaagataacccttggatggaggacaagacacccgtgaccacgtgggagaatgttccgtaccttggcaaacgggaagatcagtggtgtgggagcctgatcggcctcacctctagagccacatgggctcagaacattcctaccgccatccagcaagtgcgcagcctgattggaaatgaggagttccttgactatatgccctccatgaagcggtttagaaaagaggaggaatctgagggcgcgatctggtga

SEQ ID NO: 20692 - RNA, 9873 nt, synthetic construct
  misc_feature 1..9873: note = derived and/or modified CDS sequence (opt5) from DENV-3__EU687197__SS-prME
  source 1..9873: mol_type = other RNA
accagcctgtgcctcatgatgatcctgcccgccgctcttgccttccacctgacatcccgggacggagaacctcggatgattgtggggaagaatgaacgcggaaagtctctcctgtttaagacggcgagcggcatcaatatgtgtacccttattgctatggatctgggggaaatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcgtgaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgaacgcttctagagcgtggaatgtgtgggaagtcgaggactatggctttggcgttttcacaaccaacatctggctcaaactgcgcgaagtgtacacgcagctgtgtgaccaccggcttatgtccgccgctgtgaaggatgagagagccgtccacgccgacatggggtactggatcgagagccagaaaaatggatcctggaagctcgaaaaggcttctctgattgaggtgaagacatgcacctggcctaagagccataccctgtggtccaacggcgttctcgaatctgatatgatcattcccaaaagcctggccgggcctatctcccagcacaattatcgccccggataccatacacaaaccgcgggcccttggcaccttgggaagctggagctcgactttaactattgcgagggaacgacagtggtcattaccgaaaattgtggcacacggggccccagcctgagaaccacaaccgtgtctgggaaactgatccacgagtggtgctgtcgctcctgcacgcttccgcctctccggtacatgggagaagatggctgttggtatgggatggagatcagacccattagcgaaaaggaggagaacatggttaaatctctggtgtccgctggaagcggcaaggtcgacaatttcaccatgggggtgctgtgcctcgccatcctgtttgaagaggttatgcggggaaagttcggcaaaaagcatatgattgccggcgtgttctttacattcgtccttctgctctctgggcagatcacctggcgcgatatggctcacacactgattatgatcggaagcaacgcctccgacagaatgggcatgggggtgacctacctggcgcttattgctacgtttaaaatccagcccttcctggccctcggatttttcctgcggaagctcacaagcagagaaaatctgcttctgggcgtggggctcgccatggctaccacactgcaactgcctgaggatatcgaacagatggccaacggaattgctcttggcctgatggccctcaaactgatcacccagtttgagacctatcagctctggacagcgctgatttctcttacgtgttccaataccatcttcacactgaccgtcgcctggcgcacagctaccctcattctggccggcgttagcctgcttccggtgtgccaatcctctagcatgcggaagacggactggctgcccatgacagtggctgccatgggggtccctcccctccctctgtttatcttctccctcaaggataccctgaaaagacgctcttggccccttaacgagggagtgatggccgttggcctggtgagcatcctggcttcctctctcctgagaaacgacgtccctatggcggggccccttgtggccggaggcctgctcattgcttgttacgttatcaccgggacaagcgccgatctgaccgtggaaaaggccgctgacgtcacatgggaggaagaggccgaacagacgggagtgtcccataatctcatgattaccgtcgacgatgacggcacaatgcggatcaaagatgacgagaccgagaacattctgacagtgcttctgaagaccgcgctgctcatcgttagcggcatctttccgtactctattcctgctacgctgcttgtgtggcacacctggcagaaacagacacaacgctccggggtcctgtgggatgtgcccagccctcccgaaacccagaaggccgagctcgaagagggagtttatagaatcaaacagcagggcattttcgggaagacacaagtgggagtcggcgtgcagaaggagggggtgtttcataccatgtggcacgttacacggggagccgtcctggcttacaatggcaaacgcctcgaaccgaactgggcctctgtgaagaaagacctgatctcctatggcgggggatggagacttagcgcgcagtggcaaaagggcgaggaagtgcaggtcattgctgtggagcctgggaaaaatcccaagaacttccagacgatgcctggaaccttccagacaaccaccggcgaaatcggggccattgccctggattttaagcccggaacatctggctcccccatcatcaatcgggagggcaaagttgtggggctgtacggaaacggcgtcgtgacgaagaatgggggatatgttagcggcattgctcaaaccaacgccgagcctgacgggccgacacccgaactcgaggaagagatgttcaaaaagcgcaatctgaccatcatggatcttcaccctggctccggaaaaacaagaaagtacctgcccgctattgtgcgggaagccatcaagcgcagactccggaccctgattctcgcgcctacgagagtcgtggccgctgagatggaggaagccctgaaaggccttcccatccgctatcagacaaccgctaccaagagcgagcatacagggcgggaaatcgttgacctgatgtgccacgccacctttacaatgagactgctctctcctgtgcgcgtcccgaactacaatctgattatcatggatgaggcccatttcaccgaccccgctagcattgcggcccggggatacatctccacgagagtgggcatgggggaagctgccgccatttttatgacagctacccctcccggaacagccgatgcgttccctcagtctaacgctcccatccaggacgaggagcgcgacatcccggaacggagctggaactccggcaacgagtggattaccgattttgccgggagaacggtgtggttcgtcccttctatcaaagccggcaacgacattgctaattgtcttcgcaagaacggcaaaaaggttatccaactgagccggaagacctttgatacagaatatcagaaaaccaagctcaatgactgggatttcgtggtgacaaccgacatttccgagatgggagccaactttaaagcggatagagtcatcgacccccggcgctgcctgaagcccgtgattctgacagatgggcctgagagagttatcctcgccggacccatgcctgtgaccgctgcctctgctgcccagcggcgcggcagagtcgggcggaatccgcagaaagaaaacgaccaatacatcttcacgggacagccccttaataacgatgaggaccacgctcattggacagaagccaagatgctgctggacaatattaacacccctgagggcatcattcccgccctcttcgaacctgagagagagaaaagcgccgctatcgatggggaatatcgcctgaaaggcgaatcccggaagacctttgtggaacttatgagacgcggagacctgcccgtttggctcgcccacaaagtggctagcgagggcattaagtacacagatcggaaatggtgcttcgacgggcagagaaataaccagatcctggaagagaatatggatgtcgagatctggaccaaggaaggagagcgcaaaaagctgcggccgagatggctcgacgcccgcacatattctgatcctcttgccctgaaggaatttaaagacttcgctgcgggcagaaagtccattgccctggatctcgtgacggagatcgggcgggtccccagccacctggctcatcgcaccagaaacgcccttgacaatctggtgatgctccacacatctgaacatggaggcaaagcctaccggcacgctgttgaggagctgcctgaaaccatggagacactgctccttctgggcctgatgattctcctgaccgggggagccatgctttttctgatctccggcaaggggattggaaaaacgagcatcggcctcatctgtgtgattgcgtcctctgggatgctgtggatggccgaaatccccctgcaatggattgctagcgccatcgtgctcgagttctttatgatggtccttctgattcctgagcccgaaaagcagcgcaccccgcaggataaccaactggcttatgttgtgatcggcattctcacactggccgcgatcatcgccgctaatgagatgggccttctggaaaccacaaagagagacctcggcatgtccaaagagcctggggtggtcagccccacctcttacctggatgtggacctgcaccccgcctccgcttggacgctctacgccgttgctacaaccgtgattacacctatgcttcggcataccatcgaaaacagcaccgccaacgtctctctggcggccattgctaatcaggccgtggtcctgatgggactcgacaagggctggccgatcagcaaaatggatctgggggtgccccttctggctctcggatgctattcccaggttaaccctctgacactgacggccgccgtgctccttctgattacccactacgcgatcatcggccccgggctgcaggctaaggccacaagagaggctcaaaaacgcaccgccgccggaattatgaagaatcctacagtcgacggcatcatgaccattgatctcgaccccgtgatctatgattctaagttcgagaaacagctgggccaggttatgcttctggtgctctgtgctgtccagctgctgctcatgcggacgagctgggccctttgcgaagcgctgacactggccaccgggcctattaccacactctgggagggatccccgggcaagttttggaacaccacaatcgctgtgtctatggccaatatcttcagagggagctacctggctggagccggccttgcgttttccattatgaaaagcgtggggacgggaaagcgcggcaccggctctcaaggggaaacactgggagagaaatggaagaagaaactcaaccagctgtcccggaaggagttcgacctgtataaaaagagcggcatcaccgaggttgatagaacagaggccaaagaagggctcaagcggggagagattacccatcacgctgtctcccgcggctctgccaaacttcagtggtttgtggaaagaaatatggtgatccccgaggggcgggtcattgacctgggatgtggccgcggcgggtggagctactattgcgctggactgaagaaggttacggaagtgagaggctacaccaaagggggacctggccatgaggagcccgtgcctatgtccacatacgggtggaacatcgtcaagctcatgtctggaaaagatgtgttctatctgcccccggaaaagtgtgacacccttctgtgcgatattggcgagagctcccctagccccacagttgaagagtctcggaccatccgcgtgctcaaaatggtcgagccctggctgaagaataaccagttctgtatcaaggtgctgaatccttacatgcccacagttattgaacacctcgagagacttcaacggaaacacggcgggatgctggtgcgcaaccctctgtccagaaatagcacccatgaaatgtattggatctctaacggaacgggcaatattgtcgcctccgtgaacatggtgagccggctcctgcttaacagatttacaatgacccaccgccggccgaccatcgagaaggacgtcgatctgggggctggaacaagacatgttaatgccgaacccgagacgcctaacatggacgtgattggcgagcgcatcaaacggatcaaggaagaacacaattctacctggcactacgacgatgaaaacccctataaaacatgggcgtaccatgggagctatgaggtgaaggccaccggatccgcttctagcatgattaatggcgtcgtgaagctcctgacaaaaccttgggacgttgtgcccatggtcacccagatggccatgacagataccacgccgttcggccagcaaagagtgtttaaggaaaaagttgacacccgcacacctcggtccatgcccgggaccagacgcgtgatgggaatcacagctgagtggctgtggcggaccctcggcagaaacaagaaacctcgcctgtgcacgcgggaggagttcacaaagaaggtcagaaccaatgccgccatgggggcggtgtttacagaggaaaaccagtgggatagcgctaaagccgccgttgaggacgaagatttctggaaacttgtggaccgcgagagagagctgcacaaactcggaaagtgtggctcctgcgtctacaatatgatggggaaacgggaaaagaaactgggcgagtttggaaaggctaagggctctcgcgccatttggtacatgtggcttggggctagatatctggagttcgaggccctcggatttctgaacgaggatcattggttcagccgggaaaattcctactctggcgtggagggggaaggactgcacaaactcggctatatcctgagagacattagcaagatccccgggggcgcgatgtacgccgatgacaccgctggatgggacacgcggatcaccgaggatgaccttcataacgaagagaaaattacacagcagatggatcctgagcaccgccaactggccaatgctatctttaagctcacctatcagaacaaagtcgtgaaggttcagagacccacaccgaccggcacagtgatggacattatctcccggaaggatcagcgcgggtctggacaagtcggcacctacgggctgaatacgttcacaaacatggaagtgcagcttattagacagatggagggagaaggcgtgctgagcaaagccgacctcgagaaccctcatctgcccgaaaagaaaatcacccagtggctggagaccaagggggttgagcggctcaaacgcatggcgatctccggcgatgactgcgtggtcaagcccattgatgacagatttgccaatgctctgcttgccctgaacgatatgggaaaggtgcggaaagacatccctcaatggcagccgagcaagggctggcatgattggcagcaggttcccttctgttctcaccatttccacgaactcattatgaaagacgggcgcaagctggtggtcccttgcagaccccaagacgagcttatcggacgggctcgcatttcccagggcgccgggtggagcctgagagaaacagcttgtctcggaaaagcctatgcgcagatgtggtctctgatgtactttcaccggcgcgatctgagactcgcctccaatgctatctgcagcgccgtgcctgtccattgggtgcccacctctcggacaacgtggtccattcacgcccatcaccaatggatgaccacagaggacatgctgaccgtttggaacagagtgtggatcgaagataatccttggatggaggacaagacacccgtcaccacgtgggagaacgtgccgtaccttggcaagcgcgaagatcagtggtgtgggagcctgatcggcctcacctcccgggctacatgggcccagaatattcctaccgcgatccatcaggttagaagcctgattggaaacgaggagttccttgactatatgccctctatgaaacgctttcggaaggaggaggaactggagggcgctatctggtga

SEQ ID NO: 20693 - RNA, 9873 nt, synthetic construct
  misc_feature 1..9873: note = derived and/or modified CDS sequence (opt5) from DENV-3__EU687198__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcacaaaaaaggaggaacccgtgaacattgaggccgaacctccgttcggcgagtccaatatcgtgattggggttggcgataacgccctgaaaatcaattggtataagaagggatctagcatcggcaaaatgtttgaagctaccgcccggggggctagacgcatggccattcttggagacacggcgtgggatttcggctccgtcgggggagtgctcaacagcctgggcaagatggtgcaccagatctttgggtctgcctacacagctctgttctccggcgtcagctgggtgatgaaaattggaatcggcgttctcctgacctggattgggcttaattctaagaacaccagcatgtccttttcttgcatcgccattggaatcatcacactgtatctcggcgctgtggtccaggccgacaccgggtgtgtgattaattggaaaggaaaggagctgaagtgcggcagcgggatcttcgttacaaacgaggtgcatacgtggaccgaacagtacaaatttcaagcggattcccccaagcggctggccacagctattgccggcgcttgggagaatggagtctgtggcatcagaagcaccacacgcatggaaaaccttctctggaaacagattgccaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgctgaaacacaaaactccagcttcatcattgatggacctaatacccccgagtgcccgtctgcgtccagagcctggaacgtgtgggaagtcgaggactatggctttggcgttttcacaaccaatatctggctcaaactgcgcgaagtgtacacgcagctgtgtgaccaccggcttatgagcgctgccgtgaaggatgagagagccgtccacgctgacatggggtactggatcgagtcccagaaaaacggatcttggaagctcgaaaaagccagcctgattgaggtgaagacatgcacctggcctaagtcccataccctgtggtctaatggcgttctcgaaagcgatatgatcattcccaaatccctggcggggcctatcagccagcacaactatcgccccggataccatacacaaaccgctggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgccggatctggcaaggtcgacaacttcaccatgggggtgctgtgcctcgccatcctgtttgaagaggttatgcggggaaagttcggcaaaaagcatatgattgctggcgtgttctttacattcgtccttctgctcagcgggcagatcacctggcgcgatatggcccacacactgattatgatcggatccaatgcgagcgacagaatgggcatgggggtgacctacctggctcttattgccacgtttaaaatccagcccttcctggccctcggatttttcctgcggaagctcacatctagagaaaacctgcttctgggcgtggggctcgctatggccaccacactgcaactgcctgaggatatcgaacagatggctaatggaattgcccttggcctgatggcgctcaaactgatcacccagtttgagacctatcagctctggacagccctgatttcccttacgtgtagcaacaccatcttcacactgaccgtcgcttggcgcacagccaccctcattctggctggcgtttccctgcttccggtgtgccaatctagctccatgcggaagtctgactggctgcccatgacggtggccgccatgggggtccctcccctccctctgtttatcttcagcctcaaggatacactgaaaagacgctcctggccccttaatgagggagtgatggctgttggcctggtgtctatcctggcgagctccctcctgagaaacgacgtccctatggccgggccccttgtggctggaggcctgctcattgcctgttacgttatcaccgggaccagcgccgatctgacagtggaaaaggctgccgacgtcacctgggaggaagaggcggaacagacaggagtgtctcataacctcatgattacggtcgacgatgacggcaccatgcggatcaaagatgacgagacagagaatattctgaccgtgcttctgaagacagctctgctcatcgtttccggcatctttccgtacagcattcctgccaccctgcttgtgtggcacacgtggcagaaacagacccgcagatctggggtcctgtgggatgtgccctcccctcccgaaacacaaaaggccgagctcgaagagggagtttatcggatcaaacagcagggcattttcgggaagacccaggtgggagtcggcgtgcaaaaggagggggtgtttcatacaatgtggcacgttacccgcggagctgtcctgacatacaacggcaaaagactcgaaccgaattgggccagcgtgaagaaagacctgatctcttatggcgggggatggcggctttccgcgcagtggcagaagggcgaggaagtgcaagtcattgctgtggagcctgggaaaaaccccaagaatttccagacgatgcctggaaccttccagacaaccaccggcgaaatcggggccattgccctggattttaagcccggaacaagcggctcccccatcatcaaccgcgagggcaaagttgtggggctgtacggaaatggcgtcgtgacgaagaacgggggatatgttagcggcattgctcagaccaatgccgagcctgacgggccgacacccgaactcgaggaagagatgttcaaaaagagaaacctgaccatcatggatcttcaccctggctctggaaaaacacggaagtacctgcccgctattgtgcgcgaagccatcaagagacggctcagaaccctgattctcgcgcctacgcgcgtcgtggccgctgagatggaggaagccctgaaaggccttcccatccggtatcaaacaaccgctaccaagagcgagcatacagggagagaaatcgttgacctgatgtgccacgccacctttacaatgcgcctgctctcccctgtgcgggtcccgaattacaacctgattatcatggatgaggcccatttcaccgaccccgcttctattgcggccagaggatacatcagcacgcgcgtgggcatgggggaagctgccgccatttttatgacagctacccctcccggaacagccgatgcgttccctcagtccaatgctcccatccaggacgaggagcgggacatcccggaaagatcttggaacagcggcaatgagtggattaccgattttgccgggaaaacggtgtggttcgtcccttccatcaaggccggcaacgacattgctaactgtcttcgcaaaaatggaaagaaggttatccagctgtctcggaaaacctttgatacagaatatcaaaagaccagactcaacgactgggatttcgtggtgacaaccgacattagcgagatgggcgccaattttaaagcggatcgggtcatcgacccccgcagatgcctgaagcccgtgattctgacagatgggcctgagcgggttatcctcgccggacccatgcctgtgaccgctgcctccgctgcccagcgcagaggccgggtcgggagaaacccgcagaaagaaaatgaccagtacatcttcacgggacaaccccttaacaatgatgaggaccacgctcattggacagaagccaagatgctgctggacaacattaatacccctgagggcatcattcccgcgctcttcgaacctgagcgcgagaagagcgccgctatcgatggggaatatcggctgaaaggcgagtctagaaagacctttgtggaacttatgcgccggggagacctgcccgtttggctcgcccacaaagtggcttccgagggcattaagtacacagatagaaaatggtgcttcgacgggcagcgcaacaatcagatcctggaagagaacatggatgtcgagatctggaccaaggaaggagagaaaaagaagctgcggccgagatggctcgacgcccgcacatatagcgatcctcttgccctgaaagaatttaaggacttcgctgcgggcagaaaatctattgccctggatctcgtgacggagatcgggcgggtcccctcccacctggctcatcgcaccagaaatgcccttgacaacctggtgatgctccacacaagcgaacatggaggcaaggcctaccggcacgctgttgaggagctgcctgaaaccatggagacactgctccttctgggcctgatgattctcctgaccgggggagccatgctttttctgatctccggcaaagggattggaaagacgtctatcggcctcatctgtgtgattgcgagctccgggatgctgtggatggccgaaatccccctgcagtggattgctagcgccatcgtgctcgagttctttatgatggtccttctgattcctgagcccgaaaagcaacgcaccccgcaggataatcagctggcttatgttgtgatcggaattctcacactggccgcgatcatcgccgctaacgagatgggccttctggaaaccacaaaaagagacctcggcatgtctaaggagcctggggtggtctcccccaccagctacctggatgtggacctgcaccccgcctctgcttggacgctctacgccgttgctacaaccgtgattacacctatgcttcggcataccatcgaaaatagcaccgccaacgtctccctggcggccattgctaaccaagccgtggtcctgatgggactcgacaaaggctggccgatctctaagatggatctgggggtgccccttctggctctcggatgctatagccaggttaatcctctgacactgacggccgccgtgctccttctgattacccactacgcgatcatcggccccgggctgcaggctaaagccacaagagaggctcagaagcgcaccgccgccggaattatgaagaaccctacagtcgacggcatcatgaccattgatctcgaccccgtgatctatgattccaaattcgagaagcaactgggccaggttatgcttctggtgctctgtgctgtccagctgctgctcatgcggacgtcttgggccctttgcgaagcgctgacactggccaccgggcctattaccacactctgggagggaagcccgggcaaattttggaataccacaatcgctgtgtccatggccaacatcttcagagggagctacctggctggagccggccttgcgttttctattatgaagtccgtggggacgggaaaacgcggcaccggcagccagggggaaacactgggagagaagtggaagaaaaagctcaatcaactgtcccggaaagaattcgacctgtataagaaatctggcatcaccgaggttgatagaacagaggccaaggaagggctcaaacggggagagattacccatcacgctgtcagccgcggctccgccaagcttcagtggtttgtggaaagaaacatggtgatccccgaggggcgggtcattgacctgggatgtggccgcggcgggtggtcttactattgcgctggactgaagaaagttacggaagtgagaggctacaccaaggggggacctggccatgaggagcccgtgcctatgagcacatacgggtggaatatcgtcaaactcatgtccggaaaggatgtgttctatctgcccccggaaaaatgtgacacccttctgtgcgatattggcgagagctctccttcccccacagttgaagagagccggaccatccgcgtgctcaagatggtcgagccctggctgaagaacaatcagttctgtatcaaagtgctgaacccttacatgcccacagttattgaacacctcgagagacttcagcggaagcacggcgggatgctggtgcgcaatcctctgtctagaaactccacccatgaaatgtattggatcagcaatggaacgggcaacattgtcgcctctgtgaatatggtgagccggctcctgcttaacagatttacaatgacccaccgccggccgaccatcgagaaagacgtcgatctgggggctggaacaagacatgttaacgccgaacccgagacgcctaatatggacgtgattggcgagcgcatcaagcggatcaaagaagagcacaactccacctggcactacgacgatgaaaatccctataagacatgggcgtaccatgggtcttatgaggtgaaggccaccggaagcgcttccagcatgattaacggcgtcgtgaaactcctgacaaagccttgggacgttgtgcccatggtcacccaaatggccatgacagataccacgccgttcggccagcagagagtgtttaaagaaaaggttgacacccgcacacctcggtccatgcccgggaccagacgcgtgatgggaatcacagctgagtggctgtggcggaccctcggcagaaataaaaagcctcgcctgtgcacgcgggaggaattcacaaagaaagtcagaaccaacgccgccatgggggcggtgtttacagaggaaaatcaatgggattctgctaaggccgccgttgaggacgaagatttctggaaacttgtggaccgcgagagagagctgcacaagctcggaaaatgtggcagctgcgtctacaacatgatggggaagcgggaaaaaaagctgggcgagtttggaaaggctaaaggctcccgcgccatttggtacatgtggcttggggctagatatctggaattcgaggccctcggatttctgaatgaggatcattggttctctcgggaaaacagctactccggcgtggagggggaaggactgcacaagctcggctatatcctgagagacatttctaaaatccccgggggcgcgatgtacgccgatgacaccgctggatgggacacgcggatcaccgaggatgaccttcataatgaagagaagattacacagcagatggatcctgagcaccgccagctggccaacgctatctttaaactcacctatcaaaataaggtcgtgaaggttcagagacccacaccgaccggcacagtgatggacattatcagccggaaagatcagcgcgggtccggacaggtcggcacctacgggctgaacacgttcacaaatatggaagcccaacttattagacagatggagggagaaggcgtgctgagcaaggcggacctcgagaaccctcacctgtctgaaaaaaagatcacccagtggctggagaccaaaggggtggagcggctcaagcgcatggccatctccggcgatgactgcgttgtgaagcccattgatgacagatttgctaacgccctgcttgctctgaatgatatgggaaaagtccggaaggacatcccccagtggcaacctagcaaaggctggcatgattggcagcaggtgccgttctgttctcaccatttccacgaactcattatgaaggacgggcgcaaactggttgtgccctgcagacctcaggacgagcttatcggacgggcccgcatttcccaaggcgctgggtggagcctgagagaaacagcctgtctcggaaaggcgtatgcccagatgtggtctctgatgtactttcaccggcgcgatctgagactcgcttccaacgccatctgcagcgccgtccccgtgcattgggtccctacctcccggacaacgtggagcattcacgctcatcaccagtggatgaccacagaggacatgctgaccgtgtggaatagagtttggatcgaagataacccctggatggaggacaagacacctgtgaccacgtgggagaatgtcccctaccttggcaaacgcgaagatcaatggtgtgggtctctgatcggcctcaccagccgggccacatgggcgcagaacattccgaccgctatccagcaggtgagatccctgattggaaatgaggaattccttgactatatgccttctatgaagcgctttcggaaagaggaggaaagcgagggcgccatctggtga

SEQ ID NO: 20694 - RNA, 9873 nt, synthetic construct
  misc_feature 1..9873: note = derived and/or modified CDS sequence (opt5) from DENV-3__EU726769__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatggtggccggcgtcttctttacattcgtgcttctgctcagcgggcagatcacctggcgcgatatggcccacacactgattatggtgggatccaatgctagcgacagaatgggcatgggggtcacctacctggcccttatcgcgacgtttaaaattcagcccttcctggctctcggatttttcctgcggaagctcacatctagagaaaacctgcttctgggcgttgggctcgccatggccaccacactgcaactgcctgaggatatcgaacagatggctaatggaatcgcccttggcctgatggctctcaaactgattacccagtttgagacctatcagctctggacagccctgatctcccttacgtgtagcaacaccattttcacactgaccgtggcgtggcgcacagccaccctcatcctggctggcgtgtccctgcttccggtctgccaatctagctccatgcggaagacggactggctgcccatgacagtggccgctatgggggttcctcccctccctctgtttattttctctctcaaggataccctgaaaagacgcagctggccccttaatgagggagtgatggccgtcggcctggtgtccatcctggcctctagcctcctgagaaacgacgttcctatggctgggccccttgtggcgggaggcctgctcatcgcctgttacgtcattaccgggacatccgctgatctgaccgtggaaaaggccgccgacgtcacatgggaggaagaggctgaacagacgggagtgagccataacctcatgatcaccgttgacgatgacggcacaatgcggattaaagatgacgagaccgagaatatcctgacagtgcttctgaagaccgccctgctcattgtctctggcatctttccgtactccatccctgcgacgctgcttgtgtggcacacctggcagaaacagacacaacgcagcggggttctgtgggatgtgccctctcctcccgaaacccagaaggctgagctcgaagagggagtctatagaattaaacagcagggcatcttcgggaagacacaagtgggagtgggcgttcagaaggagggggtctttcataccatgtggcacgtgacacggggagccgtgctgacgtacaacggcaaacgcctcgaaccgaattgggcctccgtcaagaaagacctgattagctatggcgggggatggagactttctgctcagtggcaaaagggcgaggaagtgcaggttatcgccgtggagcctgggaaaaaccccaagaatttccagaccatgcctggaacattccagaccaccacaggcgaaattggggcgatcgctctggattttaagcccggaacgtccggcagccccattatcaaccgggagggcaaagtcgtggggctgtacggaaatggcgttgtgaccaagaacgggggatatgtctccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagttgtggccgcggagatggaggaagccctgaaaggccttcccattcgctatcagaccaccgctacaaagtctgagcataccgggcgggaaatcgtcgacctgatgtgccacgccacatttaccatgagactgctcagccctgtgcgcgtgccgaattacaacctgatcattatggatgaggctcatttcacggaccccgcctccatcgccgctcggggatacatttctacaagagtcggcatgggggaagcggccgctatctttatgaccgccacacctcccggaaccgccgatgctttccctcagagcaatgcccccattcaggacgaggagcgcgacatcccggaacggtcctggaactctggcaatgagtggatcacggattttgcggggaaaaccgtttggttcgtgcctagcattaaggctggcaacgacatcgccaactgtcttcgcaaaaatggaaagaaggtgattcaactgtccagaaaaacatttgataccgaatatcagaagacaaaactcaacgactgggatttcgtcgtgaccacagacatctctgagatgggcgccaattttaaggctgatcgggttattgaccccagacggtgcctgaaacccgtgatcctgaccgatgggcctgagcgcgtcattctcgccggacccatgcctgtgacggcggccagcgctgcccagagacggggccgcgttgggagaaacccgcagaaggaaaatgaccaatacatcttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtctggctcgcccacaaggtggcttctgagggcatcaaatacaccgatcgcaagtggtgcttcgacgggcagcggaacaatcagattctggaagagaacatggatgtcgagatctggacaaaagaaggagagaagaagaaactgagaccgcgctggctcgacgcccggacgtattccgatcctcttgctctgaaggaatttaaagacttcgccgccggcagaaagagcatcgctctggatctcgtgaccgagattgggcgcgttccctctcacctggcgcatagaacacggaatgcccttgacaacctggtgatgctccacacctccgaacatggaggcaaggcttaccgccacgccgtggaggagctgcctgaaacaatggagaccctgctccttctgggcctgatgatcctcctgacagggggagccatgctttttctgattagcggcaaggggatcggaaagacctccattggcctcatctgtgtcatcgcttctagcgggatgctgtggattgccgaaatccccctgcaatggattgcgtccgccatcgttctcgagttctttatgatggtgcttctgattcctgagcccgaaaaacagagaacaccgcaggataatcaactggcttatgtggtcatcggcattctcaccctggccgctatcatcgccgcgaacgagatgggccttctggaaacaaccaagcgggacctcggcatgagcaaagagcctggggtggtttctcccacgtcctacctggatgtggacctgcaccccgccagcgcttggacactctacgccgtcgctaccacagtgattacccctatgcttcgccataccatcgaaaattctacagccaacgtcagcctggctgccattgcgaaccaggccgtggttctgatgggactcgacaagggctggccgatctccaaaatggatctgggggtgccccttctggctctcggatgctattctcaggtcaatcctctgacgctgaccgccgctgtgctccttctgattacacactacgccatcatcggccccgggctgcaggccaaggcgaccagagaggctcaaaagcggacagccgctggaattatgaaaaaccctaccgttgacggcatcatgacgattgatctcgaccccgtgatctatgatagcaagttcgagaaacagctgggccaggtcatgcttctggtgctctgtgccgtgcagctgctgctcatgagaacatcctgggccctttgcgaagctctgaccctggccaccgggcctattacaaccctctgggagggatctccgggcaagttttggaatacaacgatcgcggttagcatggccaacatcttccgcgggtcctacctggctggagccggccttgcttttagcattatgaaatctgtcgggaccggaaagcggggcacaggctcccaaggggaaaccctgggagagaagtggaaaaagaaactcaatcagctgagcagaaaggagttcgacctgtataaaaagtccggcatcacagaggtggatcgcaccgaggccaaagaagggctcaagcggggagagattacgcatcacgcggtgtctagaggcagcgccaaacttcagtggtttgtcgaacggaacatggttatccccgaggggcgcgtgattgacctgggatgtggcagaggcgggtggtcctactattgcgctggactgaaaaaggtgaccgaagtccggggctacacaaaagggggacctggccatgaggagcccgtgcctatgtctacctacgggtggaatatcgttaagctcatgagcggaaaagatgtgttctatctgcccccggaaaagtgtgacacacttctgtgcgatattggcgagtccagcccttctcccaccgtcgaagagtcccgcacaatcagagtgctcaagatggttgagccctggctgaaaaacaatcagttctgtatcaaggtgctgaacccttacatgcccaccgtcattgaacacctcgagcggcttcaacgcaaacacggcgggatgctggtgagaaatcctctgagccggaactctacgcatgaaatgtattggatctccaatggaacaggcaacattgtggccagcgtcaatatggtttctcgcctcctgcttaacagatttaccatgacctaccggagaccgacaatcgagaaggacgtggatctgggggctggaacgcgccacgtgaacgccgaacccgagacccctaatatggacgtcattggcgagcggatcaaaagaatcaaggaagaacataacagcacatggcactatgacgatgaaaatccctacaagacctgggcttatcacgggtcctacgaggtgaaagccacaggatctgcgagctccatgattaacggcgttgtgaagctcctgaccaaaccttgggacgtcgtgcccatggttacacagatggccatgaccgatacgaccccgttcggccagcaacgcgtgtttaaggaaaaagtcgacacacggacccctagaagcatgcccgggacacgccgggtgatgggaatcaccgctgagtggctgtggagaacgctcggccgcaataagaagcctcggctgtgcacaagagaggagttcaccaaaaaggttcgcacaaacgccgctatgggggccgtgtttaccgaggaaaatcagtgggattccgccaaagcggctgtcgaggacgaagatttctggattcttgtggaccgggagagagagctgcataaggtcggaaaatgtggctcttgcgtgtacaacatgatggggaagcgcgagaaaaagctcggcgagtttggaaaggccaaaggcagcagagccatctggtatatgtggctgggggctcggtaccttgagttcgaggccctgggatttctcaatgaggatcactggttctcccgcgaaaactcttatagcggcgttgagggggaaggactgcataagctgggctacattctcagagacatctccaaaatccccgggggcgctatgtatgccgatgacacggcgggatgggacacccggattacagaggatgacctgcacaatgaagagaagatcacccagcagatggatcctgagcatagacaacttgccaacgctatttttaaactgacataccagaataaggtggtcaaggtgcagcggcccaccccgacaggcaccgtgatggacatcatttctcgcaaagatcagagagggagcggacaagttggcacgtatgggctcaacacattcaccaatatggaagcccagctgatccggcagatggagggagaaggcgtgctttccaaggctgacctggagaaccctcacctccccgagaaaaagatcacccagtggctggagacaaaaggggtcgagcgcctgaagagaatggccattagcggcgatgactgcgtggttaagcccatcgatgaccggtttgcgaacgccctcctggctcttaatgatatgggaaaagtgcgcaaggacattcctcaatggcagccgtctaaaggctggcacgattggcagcaggtccccttctgttcccatcacttccatgaactgatcatgaaggacgggagaaaactcgtggtcccttgccggccccaagacgagctgattggacgcgccagaatcagccagggcgctgggtggtctcttcgggaaaccgcctgtctgggaaaggcttacgcccagatgtggtccctcatgtactttcaccgcagagatctgcggctggcgagcaacgccatttgctctgctgtgcctgttcactgggtgcccacatcccgcacgacctggagcatccatgcccaccatcaatggatgacaaccgaggacatgctcacagtctggaatagagtgtggatcgaagataacccttggatggaggacaagacccccgttacgacctgggagaatgtgccgtatctgggcaaacgggaagatcagtggtgtgggtcccttattggcctgacaagcagagccacctgggctcagaacatccctacagccattcagcaagtccgctctctcatcggaaatgaggagttcctggactacatgcccagcatgaagcggtttagaaaagaggaggaatccgagggcgcgatttggtga

SEQ ID NO: 20695 - RNA, 9873 nt, synthetic construct
  misc_feature 1..9873: note = derived and/or modified CDS sequence (opt5) from DENV-3__EU687239__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcacaaaaaaggaggaacccgtgaacattgaggccgaacctccgttcggcgagtccaatatcgtgattggggttggcgataacgccctgaaaatcaattggtataagaagggatctagcatcggcaaaatgtttgaagctaccgcccggggggctagacgcatggccattcttggagacacggcgtgggatttcggctccgtcgggggagtgctcaacagcctgggcaagatggtgcaccagatctttgggtctgcctacacagctctgttctccggcgtcagctgggtgatgaaaattggaatcggcgttctcctgacctggattgggcttaattctaagaacaccagcatgtccttttcttgcatcgccattggaatcatcacactgtatctcggcgctgtggtccaggccgacaccgggtgtgtgattaattggaaaggaaaggagctgaagtgcggcagcgggatcttcgttacaaacgaggtgcatacgtggaccgaacagtacaaatttcaagcggattcccccaagcggctggccacagctattgccggcgcttgggagaatggagtctgtggcatcagaagcaccacacgcatggaaaaccttctctggaaacagattgccaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgctgaaacacaaaactccagcttcatcattgatggacctaatacccccgagtgcccgtctgcgtccagagcctggaacgtgtgggaagtcgaggactatggctttggcgttttcacaaccaatatctggctcaaactgcgcgaagtgtacacgcagctgtgtgaccaccggcttatgagcgctgccgtgaaggatgagagagccgtccacgctgacatggggtactggatcgagtcccagaaaaacggatcttggaagctcgaaaaagccagcctgattgaggtgaagacatgcacctggcctaagtcccataccctgtggtctaatggcgttctcgaaagcgatatgatcattcccaaatccctggcggggcctatcagccagcacaactatcgccccggataccatacacaaaccgctggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgccggatctggcaaggtcgacaacttcaccatgggggtgctgtgcctcgccatcctgtttgaagaggttatgcggggaaagttcggcaaaaagcatatgattgctggcgtgttctttacattcgtccttctgctcagcgggcagatcacctggcgcgatatggcccacacactgattatgatcggatccaatgcgagcgacagaatgggcatgggggtgacctacctggctcttattgccacgtttaaaatccagcccttcctggccctcggatttttcctgcggaagctcacatctagagaaaacctgcttctgggcgtggggctcgctatggccaccacactgcaactgcctgaggatatcgaacagatggctaatggaattgcccttggcctgatggcgctcaaactgatcacccagtttgagacctatcagctctggacagccctgatttcccttacgtgtagcaacaccatcttcacactgaccgtcgcttggcgcacagccaccctcattctggctggcgtttccctgcttccggtgtgccaatctagctccatgcggaagtctgactggctgcccatgacggtggccgccatgggggtccctcccctccctctgtttatcttcagcctcaaggatacactgaaaagacgctcctggccccttaatgagggagtgatggctgttggcctggtgtctatcctggcgagctccctcctgagaaacgacgtccctatggccgggccccttgtggctggaggcctgctcattgcctgttacgttatcaccgggaccagcgccgatctgacagtggaaaaggctgccgacgtcacctgggaggaagaggcggaacagacaggagtgtctcataacctcatgattacggtcgacgatgacggcaccatgcggatcaaagatgacgagacagagaatattctgaccgtgcttctgaagacagctctgctcatcgtttccggcatctttccgtacagcattcctgccaccctgcttgtgtggcacacgtggcagaaacagacccgcagatctggggtcctgtgggatgtgccctcccctcccgaaacacaaaaggccgagctcgaagagggagtttatcggatcaaacagcagggcattttcgggaagacccaggtgggagtcggcgtgcaaaaggagggggtgtttcatacaatgtggcacgttacccgcggagctgtcctgacatacaacggcaaaagactcgaaccgaattgggccagcgtgaagaaagacctgatctcttatggcgggggatggcggctttccgcgcagtggcagaagggcgaggaagtgcaagtcattgctgtggagcctgggaaaaaccccaagaatttccagacgatgcctggaaccttccagacaaccaccggcgaaatcggggccgttgccctggattttaagcccggaacaagcggctcccccattatcaaccgcgagggcaaagtggtcgggctgtacggaaatggcgtggttacgaagaacgggggatatgtgagcggcatcgctcagaccaatgccgagcctgacgggccgacacccgaactcgaggaagagatgttcaaaaagagaaacctgaccattatggatcttcaccctggctctggaaaaacacggaagtacctgcccgctatcgtccgcgaagccattaagagacggctcagaaccctgatcctcgcgcctacgcgcgtggttgccgctgagatggaggaagccctgaaaggccttcccattcggtatcaaacaaccgctaccaagagcgagcatacagggagagaaatcgtggacctgatgtgccacgccacctttacaatgcgcctgctctcccctgtccgggtgccgaattacaacctgatcattatggatgaggcccatttcaccgaccccgcttctatcgcggccagaggatacattagcacgcgcgtgggcatgggggaagctgccgccatctttatgacagctacccctcccggaacagccgatgcgttccctcagtccaatgctcccattcaggacgaggagcgggacatcccggaaagatcttggaacagcggcaatgagtggatcaccgattttgccgggaaaacggtctggttcgttccttccattaaggccggcaacgacatcgctaactgtcttcgcaaaaatggaaagaaggtgattcagctgtctcggaaaacctttgatacagaatatcaaaagaccaaactcaacgactgggatttcgtggtcacaaccgacatcagcgagatgggcgccaattttaaggcggatagagtgattgacccccggcgctgcctgaaacccgttatcctgacagatgggcctgagagagtgattctcgccggacccatgcctgtcaccgctgcctccgctgcccagcggcgcggcagagtggggcggaacccgcagaaggaaaatgaccagtacatcttcacgggacaaccccttaacaatgatgaggaccacgctcattggacagaagccaagatgctgctggacaacatcaatacccctgagggcattatccccgcgctcttcgaacctgagagagagaaaagcgccgctattgatggggaatatcgcctgaagggcgagtctcggaaaacctttgttgaacttatgagacgcggagacctgcccgtgtggctcgcccacaaggtcgcttccgagggcatcaaatacacagatcggaagtggtgcttcgacgggcagagaaacaatcagattctggaagagaacatggatgtggagatctggaccaaagaaggagagaagaagaaactgcgcccgcggtggctcgacgccagaacatatagcgatcctcttgccctgaaggaatttaaagacttcgctgcgggccgcaagtctatcgccctggatctcgtcacggagattgggagagtgccctcccacctggctcatcggacccgcaatgcccttgacaacctggttatgctccacacaagcgaacatggaggcaaagcctacagacacgctgtggaggagctgcctgaaaccatggagacactgctccttctgggcctgatgatcctcctgaccgggggagccatgctttttctgatttccggcaaggggatcggaaagacgtctattggcctcatctgtgtgatcgcgagctccgggatgctgtggatggccgaaattcccctgcagtggatcgctagcgccattgtcctcgagttctttatgatggttcttctgatccctgagcccgaaaaacaacggaccccgcaggataatcagctggcttatgtggtgattggaatcctcacactggccgcgattatcgccgctaacgagatgggccttctggaaaccacaaagcgcgacctcggcatgtctaaagagcctggggtcgtgtcccccaccagctacctggatgttgacctgcaccccgcctctgcttggacgctctacgccgtggctacaaccgtcatcacacctatgcttagacataccattgaaaatagcaccgccaacgtgtccctggcggccatcgctaaccaagccgtcgtgctgatgggactcgacaagggctggccgatttctaaaatggatctgggggttccccttctggctctcggatgctatagccaggtgaatcctctgacactgacggccgccgtcctccttctgatcacccactacgcgattatcggccccgggctgcaggctaaggccacacgggaggctcagaagagaaccgccgccggaatcatgaaaaaccctacagtggacggcattatgaccatcgatctcgaccccgttatttatgattccaagttcgagaaacaactgggccaggtgatgcttctggtcctctgtgctgtgcagctgctgctcatgcgcacgtcttgggccctttgcgaagcgctgacactggccaccgggcctatcaccacactctgggagggaagcccgggcaagttttggaataccacaattgctgtgtccatggccaacatcttccgggggagctacctggctggagccggccttgcgttttctatcatgaaatccgttgggacgggaaagagaggcaccggcagccagggggaaacactgggagagaagtggaaaaagaaactcaatcaactgtcccgcaaggaattcgacctgtataaaaagtctggcattaccgaggtcgatcggacagaggccaaagaagggctcaagagaggagagatcacccatcacgctgtgagccggggctccgccaagcttcagtggtttgtggaacgcaacatggtcattcccgaggggagagttatcgacctgggatgtggccggggcgggtggtcttactattgcgctggactgaaaaaggtgacggaagtgcgcggctacaccaaagggggacctggccatgaggagcccgtccctatgagcacatacgggtggaatattgtgaagctcatgtccggaaaagatgttttctatctgcccccggaaaagtgtgacacccttctgtgcgatatcggcgagagctctccttcccccacagtggaagagagcagaaccattcgggtcctcaagatggtggagccctggctgaaaaacaatcagttctgtatcaaggttctgaacccttacatgcccacagtgatcgaacacctcgagcgccttcagagaaaacacggcgggatgctggtccggaatcctctgtctcgcaactccacccatgaaatgtattggattagcaatggaacgggcaacatcgtggcctctgtgaatatggtcagcagactcctgcttaaccggtttacaatgacccacagacgcccgaccattgagaaggacgttgatctgggggctggaacacggcatgtgaacgccgaacccgagacgcctaatatggacgtgatcggcgagagaattaaacgcatcaaggaagagcacaactccacctggcactacgacgatgaaaatccctataagacatgggcgtaccatgggtcttatgaggtcaaagccaccggaagcgcttccagcatgatcaacggcgtggttaagctcctgacaaaaccttgggacgtggtccccatggtgacccaaatggccatgacagataccacgccgttcggccagcagcgggtttttaaggaaaaagtggacaccagaacacctcgctccatgcccgggacccggagagtcatgggaattacagctgagtggctgtggcgcaccctcggccggaataagaagcctagactgtgcacgcgcgaggaattcacaaaaaaggtgcggaccaacgccgccatgggggcggtttttacagaggaaaatcaatgggattctgctaaagccgccgtggaggacgaagatttctggaagcttgtcgacagagagcgcgagctgcacaaactcggaaagtgtggcagctgcgtgtacaacatgatggggaaaagagaaaagaagctgggcgagtttggaaaagctaagggctcccgggccatctggtacatgtggcttggggctcgctatctggaattcgaggccctcggatttctgaatgaggatcattggttctctagagaaaacagctactccggcgtcgagggggaaggactgcacaaactcggctatattctgcgggacatctctaagattcccgggggcgcgatgtacgccgatgacaccgctggatgggacacgagaatcaccgaggatgaccttcataatgaagagaaaatcacacagcagatggatcctgagcaccggcagctggccaacgctatttttaagctcacctatcaaaataaggtggttaaagtgcagcgccccacaccgaccggcacagtcatggacatcattagcagaaaggatcagcgggggtccggacaggtgggcacctacgggctgaacacgttcacaaatatggaagcccaacttatccgccagatggagggagaaggcgtgctgagcaaagcggacctcgagaaccctcacctgtctgaaaagaaaattacccagtggctggagaccaagggggttgagagactcaagcggatggccatctccggcgatgactgcgtggtcaaacccatcgatgaccgctttgctaacgccctgcttgctctgaatgatatgggaaaggtgagaaaagacattccccagtggcaacctagcaagggctggcatgattggcagcaggttccgttctgttctcaccatttccacgaactcatcatgaaagacgggcggaagctggtggtcccctgccgccctcaggacgagcttattggaagagcccggatctcccaaggcgctgggtggagcctgcgcgaaacagcctgtctcggaaaggcgtatgcccagatgtggtctctgatgtactttcacagacgggatctgcgcctcgcttccaacgccatttgcagcgccgtgcccgtccattgggtgcctacctccagaacaacgtggagcatccacgctcatcaccagtggatgaccacagaggacatgctgaccgtttggaatcgggtgtggattgaagataacccctggatggaggacaaaacacctgtcaccacgtgggagaatgtgccctaccttggcaagagagaagatcaatggtgtgggtctctgatcggcctcaccagccgcgccacatgggcgcagaacatcccgaccgctattcagcaggttcggtccctgatcggaaatgaggaattccttgactatatgccttctatgaaaagatttcgcaaggaggaggaaagcgagggcgtgatttggtga

SEQ ID NO: 20696 - RNA, 9873 nt, synthetic construct
  misc_feature 1..9873: note = derived and/or modified CDS sequence (opt5) from DENV-3__FJ182004__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgacaaaaaaggaggaacccgtcaacattgaggccgaacctccgttcggcgagtccaatatcgtgattgggatcggcgataacgctctgaaaatcaattggtataagaagggatctagcattggcaaaatgtttgaagccaccgctcggggggccagacgcatggcgatccttggagacacggcctgggatttcggctccgtggggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacaccgggtgtgtgatcaattggaaaggaaaggagctgaagtgcggcagcgggattttcgtcacaaacgaggtgcatacgtggaccgaacagtacaaatttcaagccgattcccccaagcggctggctacagccatcgctggcgcctgggagaatggagtttgtggcattagaagcaccacacgcatggaaaaccttctctggaaacaggtggccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggctaagattgtcaccgcggaaacacaaaactccagcttcatcattgatggacctaatacccccgagtgcccgtctgcctccagagcttggaacgtgtgggaagtggaggactatggctttggcgtcttcacaaccaatatctggctcaaactgcgcgaagtttacacgcagctgtgtgaccaccggcttatgagcgccgccgtgaaggatgagagagctgtgcacgccgacatggggtactggatcgagtcccagaaaaacggatcttggaagctcgaaaaagcgagcctgattgaggtcaagacatgcacctggcctaagtcccataccctgtggtctaatggcgtgctcgaaagcgatatgatcattcccaaatccctggctgggcctatcagccagcacaactatcgccccggataccatacacaaaccgccggcccttggcaccttgggaagctggagctcgactttaattattgcgagggaacgacagttgtgattaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagatcagacccatttctgaaaaggaggagaatatggtgaaatccctggttagcgccggatctggcaaggtggacaacttcaccatgggggtcctgtgcctcgctatcctgtttgaagaggtgatgcggggaaagttcggcaaaaagcatatgattgccggcgttttctttacattcgtgcttctgctcagcgggcagatcacctggcgcgatatggcgcacacactgattatgatcggatccaatgctagcgacagaatgggcatgggggtcacctacctggcccttattgccacgtttaaaatccagcccttcctggctctcggatttttcctgcggaagctcacatctagagaaaacctgcttctgggcgtggggctcgccatggctaccacactgcaactgcctgaggatatcgaacagatggccaatggaattgcgcttggcctgatggccctcaaactgatcacccagtttgagacctatcagctctggacagctctgatttcccttacgtgtagcaacaccatcttcacactgaccgtggcctggcgcacagctaccctcattctggccggcgtctccctgcttccggtttgccaatctagctccatgcggaagtctgactggctgcccatgacggtggccgctatgggggtgcctcccctccctctgtttatcttcagcctcaaggatacactgaaaagacgctcctggccccttaatgagggagtcatggcggtgggcctggtttctatcctggccagctccctcctgagaaacgacgtgcctatggctgggccccttgtcgccggaggcctgctcattgcctgttacgtgatcaccgggaccagcgctgatctgacagttgaaaaggccgcggacgtgacctgggaggaagaggctgaacagacaggagtctctcataacctcatgattacggtggacgatgacggcaccatgcggatcaaagatgacgagacagagaatattctgaccgtccttctgaagacagccctgctcatcgtgtccggcatctttccgtacagcattcctgccaccctgcttgtttggcacacgtggcagaaacagacccgcagatctggggtgctgtgggatgtcccctcccctcccgaaacacaaaaggctgagctcgaagagggagtgtatcggatcaaacagcagggcattttcgggaagacccaggttggagtgggcgtccaaaaggagggggtgtttcatacaatgtggcacgtgacccgcggagccgttctgacatacaacggcaaaagactcgaaccgaattgggcgagcgtcaagaaagacctgatctcttatggcgggggatggcggctttccgctcagtggcagaagggcgaggaagtgcaagtgattgccgtcgagcctgggaaaaaccccaagaatttccagacgatgcctggaaccttccagacaaccaccggcgaaatcggggccattgctctggattttaagcccggaacaagcggctcccccatcatcaaccgcgagggcaaagtggttgggctgtacggaaatggcgtggtcacgaagaacgggggatatgtgagcggcattgcccagaccaatgctgagcctgacgggccgacacccgaactcgaggaagagatgttcaaaaagagaaacctgaccatcatggatcttcaccctggctctggaaaaacacggaagtacctgcccgccattgttcgcgaagcgatcaagagacggctcagaaccctgattctcgcccctacgcgcgtggtcgctgccgagatggaggaagctctgaaaggccttcccatccggtatcaaacaaccgccaccaagagcgagcatacagggagagaaatcgtggacctgatgtgccacgccacctttacaatgcgcctgctctcccctgttcgggtgccgaattacaacctgattatcatggatgaggctcatttcaccgaccccgcgtctattgccgctagaggatacatcagcacgcgcgtcggcatgggggaagccgccgctatttttatgacagccacccctcccggaacagcggatgctttccctcagtccaatgcccccatccaggacgaggagcgggacatcccggaaagatcttggaacagcggcaatgagtggattaccgattttgccgggaaaacggtgtggttcgtgccttccatcaaggctggcaacgacattgccaactgtcttcgcaaaaatggaaagaaggtcatccagctgtctcggaaaacctttgatacagaatatcaaaagaccaaactcaacgactgggatttcgttgtgacaaccgacattagcgagatgggcgcgaattttaaggccgatagagtgatcgacccccggcgctgcctgaaacccgtcattctgacagatgggcctgagagagtgatcctcgctggacccatgcctgttaccgccgcttccgccgctcagcggcgcggcagagtggggcggaacccgcagaaggaaaatgaccagtacatcttcacgggacaaccccttaacaatgatgaggaccacgcccattggacagaagcgaagatgctgctggacaacattaatacccctgagggcatcattcccgccctcttcgaacctgagagagagaaaagcgctgccatcgatggggaatatcgcctgaagggcgagtctcggaaaacctttgtcgaacttatgagacgcggagacctgcccgtgtggctcgctcacaaggttgcctccgagggcattaaatacacagatcggaagtggtgcttcgacgggcagagaaacaatcagatcctggaagagaacatggatgtggagatctggaccaaagaaggagagaagaagaaactgcgcccgcggtggctcgacgccagaacatatagcgatcctcttgctctgaaggaatttaaagacttcgcggccggccgcaagtctattgctctggatctcgtcacggagatcgggagagtgccctcccacctggcccatcggacccgcaatgcccttgacaacctggtcatgctccacacaagcgaacatggaggcaaagcttacagacacgccgtggaggagctgcctgaaaccatggagacactgctccttctgggcctgatgattctcctgaccgggggagcgatgctttttctgatctccggcaaggggattggaaagacgtctatcggcctcatctgtgttattgccagctccgggatgctgtggatggctgaaatccccctgcagtggattgccagcgctatcgtgctcgagttctttatgatggtgcttctgattcctgagcccgaaaaacaacggaccccgcaggataatcagctggcctatgtcgttatcggaattctcacactggcggccatcatcgctgccaacgagatgggccttctggaaaccacaaagcgcgacctcggcatgtctaaagagcctggggtggtgtcccccaccagctacctggatgtcgacctgcaccccgcttctgcctggacgctctacgctgtggccacaaccgttattacacctatgcttagacataccatcgaaaatagcaccgcgaacgtgtccctggccgctattgccaaccaagctgtcgtgctgatgggactcgacaagggctggccgatctctaaaatggatctgggggtcccccttctggccctcggatgctatagccaggtgaatcctctgacactgacggccgcggttctccttctgattacccactacgctatcatcggccccgggctgcaggccaaggctacacgggaggcccagaagagaaccgccgctggaattatgaaaaaccctacagtggacggcatcatgaccattgatctcgaccccgtcatctatgattccaagttcgagaaacaactgggccaggtgatgcttctggttctctgtgccgtgcagctgctgctcatgcgcacgtcttgggcgctttgcgaagccctgacactggctaccgggcctattaccacactctgggagggaagcccgggcaagttttggaataccacaatcgccgtctccatggctaacatcttccgggggagctacctggccggagcgggccttgccttttctattatgaaatccgtggggacgggaaagagaggcaccggcagccagggggaaacactgggagagaagtggaaaaagaaactcaatcaactgtcccgcaaggaattcgacctgtataaaaagtctggcatcaccgaggtggatcggacagaggctaaagaagggctcaagagaggagagattacccatcacgccgttagccggggctccgctaagcttcagtggtttgtcgaacgcaacatggtgatccccgaggggagagtgattgacctgggatgtggccggggcgggtggtcttactattgcgccggactgaaaaaggtcacggaagttcgcggctacaccaaagggggacctggccatgaggagcccgtgcctatgagcacatacgggtggaatatcgtgaagctcatgtccggaaaagatgtcttctatctgcccccggaaaagtgtgacacccttctgtgcgatattggcgagagctctccttcccccacagtggaagagagcagaaccatccgggttctcaagatggtggagccctggctgaaaaacaatcagttctgtatcaaggtcctgaacccttacatgcccacagtgattgaacacctcgagcgccttcagagaaaacacggcgggatgctggttcggaatcctctgtctcgcaactccacccatgaaatgtattggatcagcaatggaacgggcaacattgtggcttctgtcaatatggtgagcagactcctgcttaaccggtttacaatgacccacagacgcccgaccatcgagaaggacgtggatctgggggccggaacacggcatgtcaacgcggaacccgagacgcctaatatggacgttattggcgagagaatcaaacgcatcaaggaagagcacaactccacctggcactacgacgatgaaaatccctataagacatgggcctaccatgggtcttatgaggtgaaagctaccggaagcgcctccagcatgattaacggcgtggtcaagctcctgacaaaaccttgggacgtggttcccatggtgacccaaatggctatgacagataccacgccgttcggccagcagcgggtctttaaggaaaaagtggacaccagaacacctcgctccatgcccgggacccggagagttatgggaatcacagccgagtggctgtggcgcaccctcggccggaataagaagcctagactgtgcacgcgcgaggaattcacaaaaaaggtgcggaccaacgccgcgatgggggctgtctttacagaggaaaatcaatgggattctgccaaagccgctgtggaggacgaagatttctggaagcttgttgacagagagcgcgagctgcacaaactcggaaagtgtggcagctgcgtgtacaacatgatggggaaaagagaaaagaagctgggcgagtttggaaaagccaagggctcccgggctatttggtacatgtggcttggggcccgctatctggaattcgaggcgctcggatttctgaatgaggatcattggttctctagagaaaacagctactccggcgtcgagggggaaggactgcacaaactcggctatatcctgcgggacatttctaagatccccgggggcgccatgtacgctgatgacaccgccggatgggacacgagaatcaccgaggatgaccttcataatgaagagaaaattacacagcagatggatcctgagcaccggcagctggctaacgccatctttaagctcacctatcaaaataaggtggtcaaagtgcagcgccccacaccgaccggcacagttatggacattatcagcagaaaggatcagcgggggtccggacaggtgggcacctacgggctgaacacgttcacaaatatggaagcgcaacttattcgccagatggagggagaaggcgtcctgaccaaagccgacctcgagaaccctcacctgagcgaaaagaaaatcacccagtggctggagacaaagggggtggagagactcaagcggatggctatctctggcgatgactgcgtggttaaacccattgatgaccgctttgccaacgctctgcttgccctgaatgatatgggaaaggtgagaaaagacatcccccagtggcaaccttccaagggctggcatgattggcagcaggtcccgttctgtagccaccatttccacgaactcattatgaaagacgggcggaagctggtggttccctgccgccctcaggacgagcttatcggaagagctcggatttctcaaggcgccgggtggtccctgcgcgaaaccgcgtgtctcggaaaggcctatgctcagatgtggagcctgatgtactttcacagacgggatctgcgcctcgcctctaacgccatctgctccgctgtgcccgtccattgggtgcctacaagcagaacgacctggtccattcacgcccatcaccagtggatgacaaccgaggacatgctgacagtctggaatcgggtgtggatcgaagataacccctggatggaggacaaaacccctgttacgacctgggagaatgtgccctaccttggcaagagagaagatcaatggtgtgggagcctgatcggcctcacatctcgcgcgacctgggctcagaacattccgacagccatccagcaggtccggagcctgattggaaatgaggaattccttgactatatgccttccatgaaaagatttcgcaaggaggaggaatctgagggcgccatctggtga

SEQ ID NO: 20697 - RNA, 9873 nt, synthetic construct
  misc_feature 1..9873: note = derived and/or modified CDS sequence (opt5) from DENV-3__FJ024465__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacacttattgctatggatctgggggaaatgtgcgacgatacagtgacctacaaatgtccgcatatcgccgaagttgaacccgaagacattgattgctggtgtaacctcacatccacctgggtgacatatggaacctgcaatcaggccggcgagcaccggcgggacaagcgctctgtggctctggcccctcatgtcgggatgggactggatacgagaacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaagaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgctgaaacacaaaactccagcttcattatcgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacatgcacctggcctaagtcccataccctgtggtctaatggcgtgctcgaaagcgatatgattatccccaaatccctggcggggcctattagccagcacaactatcgccccggataccatacacaaaccgctggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgccggatctggcaaggtggacaacttcaccatgggggtcctgtgcctcgccattctgtttgaagaggtgatgcggggaaagttcggcaaaaagcatatgatcgctggcgttttctttacattcgtgcttctgctcagcgggcagattacctggcgcgatatggcccacacactgatcatgattggatccaatgcgagcgacagaatgggcatgggggtcacctacctggctcttatcgccacgtttaaaatccagcccttcctggccctcggatttttcctgcggaagctcacatctagagaaaacctgcttctgggcgtggggctcgctatggccaccacactgcaactgcctgaggatattgaacagatggctaatggaatcgcccttggcctgatggcgctcaaactgattacccagtttgagacctatcagctctggacagccctgatctcccttacgtgtagcaacaccattttcacactgaccgtggcttggcgcacagccaccctcatcctggctggcgtctccctgcttccggtttgccaatctagctccatgcggaagtctgactggctgcccatgacggtggccgccatgggggtgcctcccctccctctgtttatcttcagcctcaaggatacactgaaaagacgctcctggccccttaatgagggagtcatggctgtgggcctggtttctattctggcgagctccctcctgagaaacgacgtgcctatggccgggccccttgtcgctggaggcctgctcatcgcctgttacgtgattaccgggaccagcgccgatctggctgttgaaaaggccgcggacgtgacatgggaggaagaggctgaacagaccggagtctctcataacctcatgatcacagtggacgatgacggcacgatgcggattaaagatgacgagaccgagaatatcctgacagtccttctgaagaccgccctgctcatcgtgtccggcatttttccgtacagcatccctgccacactgcttgtttggcacacctggcagaaacagacgcaacgctctggggtgctgtgggatgtcccctcccctcccgaaacccagaaggctgagctcgaagagggagtgtatagaattaaacagcagggcatcttcgggaagacacaagttggagtgggcgtccagaaggagggggtgtttcataccatgtggcacgtgacacggggagccgttctgacctacaacggcaaacgcctcgaaccgaattgggcgagcgtcaagaaagacctgatttcttatggcgggggatggagactttccgctcagtggcaaaagggcgaggaagtccaggtgatcgccgtcgagcctgggaaaaaccccaagaatttccagacaatgcctggaacgttccagaccacaaccggcgaaattggggccatcgctctggattttaagcccggaaccagcggctcccccatcattaaccgggagggcaaagtggttgggctgtacggaaatggcgtggtcacaaagaacgggggatatgtgagcggcatcgcccaaacgaatgctgagcctgacgggccgacccccgaactcgaggaagagatgttcaaaaagcgcaacctgacaattatggatcttcaccctggctctggaaaaaccagaaagtacctgcccgccatcgttcgggaagcgattaagcgcagactccggacactgatcctcgcccctaccagagtggtcgctgccgagatggaggaagctctgaaaggccttcccatccgctatcagacgacagccaccaagagcgagcataccgggcgggaaattgtggacctgatgtgccacgccacatttaccatgagactgctctcccctgttcgcgtgccgaattacaacctgatcattatggatgaggctcatttcacagaccccgcgtctatcgccgctcggggatacattagcaccagagtcggcatgggggaagccgccgctatctttatgacggccacacctcccggaaccgcggatgctttccctcagtccaatgcccccatccaggacgaggagcgcgacattccggaacggtcttggaacagcggcaatgagtggatcacagattttgccgggaaaaccgtgtggttcgtgccttccattaaggctggcaacgacatcgccaactgtcttcgcaaaaatggaaagaaggtcattcaactgtctagaaaaacgtttgataccgaatatcagaagacaaaactcaacgactgggatttcgttgtgaccacagacatcagcgagatgggcgcgaattttaaggccgatcgggtgattgaccccagacggtgcctgaaacccgtcatcctgaccgatgggcctgagcgcgtgatcctcgctggacccatgcctgttacagccgcttccgccgctcagagacggggccgcgtggggagaaacccgcagaaggaaaatgaccaatacattttcaccggacagccccttaacaatgatgaggaccacgcccattggacggaagcgaagatgctgctggacaacatcaatacacctgagggcattatccccgccctcttcgaacctgagcgggagaaaagcgctgccattgatggggaatatagactgaagggcgagtctcgcaaaacctttgtcgaacttatgcggagaggagacctgcccgtgtggctcgctcacaaggttgcctccgagggcatcaaatacaccgatcgcaagtggtgcttcgacgggcagcggaacaatcagatcctggaagagaacatggatgtggagatttggacaaaagaaggagagaagaagaaactgagaccgcgctggctcgacgcccggacctatagcgatcctcttgctctgaaggaatttaaagacttcgcggccggcagaaagtctatcgctctggatctcgtcacagagattgggcgcgtgccctcccacctggcccatagaacgcggaatgcccttgacaacctggtcatgctccacaccagcgaacatggaggcaaggcttaccgccacgccgtggaggagctgcctgaaacaatggagaccctgctccttctgggcctgatgatcctcctgacagggggagcgatgctttttctgatttccggcaaggggatcggaaagacctctatcggcctcatttgtgttatcgccagctccgggatgctgtggatggctgaaattcccctgcaatggatcgccagcgctattgtgctcgagttctttatgatggtgcttctgatccctgagcccgaaaaacagagaacgccgcaggataatcaactggcctatgtcgttattggaatcctcaccctggcggccatcattgctgccaacgagatgggccttctggaaacaaccaagcgggacctcggcatgtctaaagagcctggggtggtgtcccccacaagctacctggatgtcgacctgcaccccgcttctgcctggaccctctacgctgtggccacgacagttatcacccctatgcttcgccatacaattgaaaatagcaccgcgaacgtgtccctggccgctatcgccaaccaggctgtcgtgctgatgggactcgacaagggctggccgatttctaaaatggatctgggggtcccccttctggccctcggatgctatagccaggtgaatcctctgaccctgacagccgcggttctccttctgatcacgcactacgctatcattggccccgggctgcaggccaaggctaccagagaggcccaaaagcggacagccgctggaatcatgaaaaaccctaccgtggacggcattatgacaatcgatctcgaccccgtcatttatgattccaagttcgagaaacagctgggccaggtgatgcttctggttctctgtgccgtgcagctgctgctcatgagaacctcttgggcgctttgcgaagccctgacgctggctacagggcctatcaccaccctctgggagggaagcccgggcaagttttggaatacaaccatcgccgtctccatggctaacattttccgcgggagctacctggccggagcgggccttgccttttctatcatgaaatccgtggggacaggaaagcggggcacgggcagccaaggggaaaccctgggagagaagtggaaaaagaaactcaatcagctgtccagaaaggagttcgacctgtataaaaagtctggcattacagaggtggatcgcaccgaggctaaagaagggctcaagcggggagagatcacacatcacgccgttagcagaggctccgctaaacttcagtggtttgtcgaacggaacatggtgattcccgaggggcgcgtgatcgacctgggatgtggcagaggcgggtggtcttactattgcgccggactgaaaaaggtcaccgaagttcggggctacacgaaagggggacctggccatgaggagcccgtgcctatgagcacctacgggtggaatattgtgaagctcatgtccggaaaagatgtcttctatctgcccccggaaaagtgtgacacacttctgtgcgatatcggcgagagctctccttcccccaccgtggaagagagccgcacaatcagagttctcaagatggtggagccctggctgaaaaacaatcagttctgtattaaggtcctgaacccttacatgcccaccgtgatcgaacacctcgagcggcttcaacgcaaacacggcgggatgctggttagaaatcctctgtctcggaactccacacatgaaatgtattggattagcaatggaaccggcaacatcgtggcttctgtcaatatggtgagccgcctcctgcttaacagatttacgatgacacaccggagaccgaccattgagaaggacgtggatctgggggccggaacccgccatgtcaacgcggaacccgagacacctaatatggacgttatcggcgagcggatcaaaagaattaaggaagaacacaactccacgtggcactacgacgatgaaaatccctataagacctgggcctaccatgggtcttatgaggtgaaagctacaggaagcgcctccagcatgatcaacggcgtggtcaagctcctgaccaaaccttgggacgtggttcccacagtgacccagatggctatgacagataccacgccgttcggccagcaacgcgtctttaaggaaaaagtggacacccggacacctagatccatgcccgggacccgccgggttatgggaattacagccgagtggctgtggagaaccctcggccgcaataagaagcctcggctgtgcacgagagaggagttcaccaagaaggtgcgcaccaacgccgcgatgggggctgtctttacagaggaaaatcagtgggattctgccaaagccgctgtggaggacgaagatttctggaaacttgttgaccgggagagagagctgcacaaactcggaaagtgtggcagctgcgtgtacaacatgatggggaaacgcgaaaagaagctgggcgagtttggaaaagccaagggctccagagctatctggtacatgtggcttggggcccggtatctggagttcgaggcgctcggatttctgaatgaggatcattggttctctcgcgaaaacagctactccggcgtcgagggggaaggactgcacaaactcggctatattctgagagacatctctaagatccccgggggcgccatgtacgctgatgacaccgccggatgggacacgcggattaccgaggatgaccttcataatgaagagaaaatcacacagcagatggatcctgagcacagacaactggctaacgccatttttaagctcacctatcagaataaggtggtcaaagtgcagcggcccacaccgaccggcacagttatggacatcattagccgcaaggatcagagagggtccggacaagtgggcacctacgggctgaacacgttcacaaatatggaagcgcagcttatccggcagatggagggagaaggcgtcctgagcaaagccgacctcgagaactctcacctgtccgaaaagaaaatcacccagtggctggagaccaagggggtggagcgcctcaagagaatggctattagcggcgatgactgcgtggttaaacctatcgatgaccggtttgccaacgctctgcttgccctgaatgatatgggaaaggtgcgcaaagacattccccaatggcagccctctaagggctggcatgattggcagcaggtccctttctgttcccaccatttccacgaactcatcatgaaagacgggagaaagctggtggttccgtgccggccccaagacgagcttattggacgcgctagaatcagccagggcgccgggtggtctctgcgggaaacagcgtgtctcggaaaggcctatgctcagatgtggtccctgatgtactttcaccgcagagatctgcggctcgccagcaacgccatttgctccgctgtgcctgtccattgggtgcccaccagccgcacaacgtggtctatccacgcccatcaccaatggatgaccacagaggacatgctgaccgtctggaatagagtgtggatcgaagataacccttggatggaggacaaaacacccgttaccacgtgggagaatgtgccttaccttggcaagcgggaagatcagtggtgtgggagcctgattggcctcacctccagagcgacatgggctcagaacatccccaccgccattcagcaagtccgctctctgatcggaaatgaggagttccttgactatatgccgagcatgaaacggtttagaaaggaggaggaatccgagggcgccatttggtga

SEQ ID NO: 20698 - RNA, 9873 nt, synthetic construct
  misc_feature 1..9873: note = derived and/or modified CDS sequence (opt5) from DENV-3__FJ024466__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcgccgaagttgagcccgaagacattgattgctggtgtaacctcacatccacctgggtgacatatggaacctgcaatcaggccggcgagcaccggcgggacaagcgctctgtggctctggcccctcatgtcgggatgggactggatacgagaacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgaccaagaaggaggaacccgtcaacattgaggccgaacctccgttcggcgagtccaatatcgtgattgggatcggcgataacgctctgaaaatcaattggtataagaagggatctagcattggcaaaatgtttgaagccaccgctagaggggccagacgcatggcgatccttggagacacggcctgggatttcggctccgtcgggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacaccgggtgtgtgatcaattggaaaggaaaggagctgaagtgcggcagcgggattttcgtcacaaacgaggtgcatacgtggaccgaacagtaccggtttcaagccgattcccccaaaagactggctacagccatcgctggcgcctgggagaatggagtttgtggcattcgcagcaccacacggatggaaaaccttctctggaagcagatcgccaatgagctgaactatatcctgtgggaaaataacattaaactcaccgtggtcgtgggggacatcattggagttctggagcagggcaagagaacgcttacccctcagcccatggagctgaaatactcttggaagacatgggggaaagctaagatcgtgaccgcggaaacacaaaactccagcttcattatcgatggacctaatacccccgagtgcccgtctgcctcccgcgcttggaacgtctgggaagtggaggactatggctttggcgtgttcacaaccaatatctggctcaagctgcgggaagtctacacgcagctgtgtgaccacagacttatgagcgccgccgttaaagatgagcgcgctgtgcacgccgacatggggtactggattgagtcccagaagaacggatcttggaaactcgaaaaggcgagcctgatcgaggtgaaaacatgcacctggcctaagtcccataccctgtggtctaatggcgtcctcgaaagcgatatgattatccccaagtccctggctgggcctattagccagcacaactatcggcccggataccatacacaaaccgccggcccttggcaccttgggaaactggagctcgactttaattattgcgagggaacgacagtggttatcaccgataactgtggcacaagaggcccctctctgcgcaccacaaccgtgtccgggaagctgatccacgaatggtgctgtcggagctgcacgcttccgcctctcagatacatgggagaggacggctgttggtatgggatggaaattcggcccatctctgagaaagaagagaatatggtcaagtccctggtgagcgccggatctggcaaagttgataacttcaccatgggggtgctgtgcctcgctattctgtttgaggaagtcatgcgcggaaagttcggcaagaaacatatgatcgccggcgtgttctttacattcgttcttctgctcagcgggcagattacctggagagacatggcgcacacactgatcatgattggatccaatgctagcgatcggatgggcatgggggtgacctacctggcccttatcgccacgtttaagatccagcccttcctggctctcggatttttcctgagaaaactcacatctcgcgagaacctgcttctgggcgtcgggctcgccatggctaccacactgcaactgcctgaagacattgagcagatggccaatggaatcgcgcttggcctgatggccctcaagctgattacccagtttgaaacctatcagctctggacagctctgatctcccttacgtgtagcaacaccattttcacactgaccgtggcctggcggacagctaccctcatcctggccggcgtgtccctgcttccggtctgccaatctagctccatgagaaaatctgattggctgcccatgacggttgccgctatgggggtgcctcccctccctctgtttatcttcagcctcaaggacacactgaagcgcagatcctggccccttaatgagggagtgatggcggtcggcctggtgtctattctggccagctccctcctgcggaacgatgttcctatggctgggccccttgtggccggaggcctgctcatcgcctgttacgtcattaccgggaccagcgctgacctgacagtggagaaagccgcggacgttacctgggaagaggaagctgagcagacaggagtgtctcataacctcatgatcacggtcgatgacgatggcaccatgcgcattaaggacgatgaaacagagaatatcctgaccgtgcttctgaaaacagccctgctcatcgtctccggcatttttccgtacagcatccctgccaccctgcttgtgtggcacacgtggcagaagcagaccagacggtctggggttctgtgggacgtgccctcccctcccgagacacaaaaagctgaactcgaggaaggagtctatcgcattaagcagcagggcatcttcgggaaaacccaggtgggagttggcgtgcaaaaggagggggtctttcatacaatgtggcacgtgaccagaggagccgtgctgacatacaacggcaagcggctcgagccgaattgggcgagcgttaaaaaggatctgatttcttatggcgggggatggcgcctttccgctcagtggcagaaaggcgaagaggtccaagtgatcgccgtggaacctgggaagaaccccaaaaatttccagacgatgcctggaaccttccagacaaccaccggcgagattggggccatcgctctggactttaagcccggaacaagcggctcccccatcattaacagagaaggcaaggtcgtggggctgtacggaaatggcgttgtgacgaaaaacgggggatatgtcagcggcatcgcccagaccaatgctgagcctgatgggccgacacccgagctcgaagaggaaatgttcaagaaacggaacctgaccattatggaccttcaccctggctctggaaagacacgcaaatacctgcccgccatcgtgagagaggcgattaagcggagactccgcaccctgatcctcgcccctacgcgggttgtggctgccgaaatggaggaggctctgaagggccttcccatcagatatcaaacaaccgccaccaaaagcgaacatacagggcgcgagattgtcgatctgatgtgccacgccacctttacaatgcggctgctctcccctgtgagagttccgaattacaacctgatcattatggacgaagctcatttcaccgatcccgcgtctatcgccgctcgcggatacattagcacgcgggtgggcatgggggaggccgccgctatctttatgacagccacccctcccggaacagcggacgctttccctcagtccaatgcccccatccaggacgaagagagagatattccggagcgctcttggaacagcggcaatgaatggatcaccgactttgccgggaagacggtctggttcgtgccttccattaaagctggcaacgatatcgccaactgtcttcggaagaatggcaaaaaggtgattcagctgtctagaaagacctttgacacagagtatcagaagacaaagctcaacgattgggacttcgtcgttacaaccgatatcagcgaaatgggagcgaattttaaagccgaccgggtgattgatccccgcagatgcctgaagcccgtgatcctgacagacgggcctgagcgggtcatcctcgctggacccatgcctgtgaccgccgcttccgccgctcagcgcagaggccgggttgggagaaacccgcagaaagagaatgatcagtacattttcacgggacaaccccttaacaatgacgaagaccacgcccattggacagaggcgaagatgctgctggataacatcaatacccctgaaggcattatccccgccctcttcgagcctgaacgcgaaaagagcgctgccattgacggggagtatcggctgaaaggcgaatctagaaagacctttgtggagcttatgcgccggggagatctgcccgtctggctcgctcacaaagtggcctccgaaggcatcaagtacacagacagaaaatggtgcttcgatgggcagcgcaacaatcagatcctggaggaaaacatggacgttgagatttggaccaaggagggagagaaaaagaagctgcggccgagatggctcgatgcccgcacatatagcgaccctcttgctctgaaagagtttaaggatttcgcggccggcagaaaatctatcgctctggacctcgtgacggaaattgggcgggtcccctcccacctggcccatcgcaccagaaatgcccttgataacctggtgatgctccacacaagcgagcatggaggcaaggcttaccggcacgccgtcgaagaactgcctgagaccatggaaacactgctccttctgggcctgatgatcctcctgaccgggggagcgatgctttttctgatttccggcaaagggatcggaaagacgtctatcggcctcatttgtgtgatcgccagctccgggatgctgtggatggctgagattcccctgcagtggatcgccagcgctattgttctcgagttctttatgatggtgcttctgatccctgagcccgagaagcaacgcaccccgcaggacaatcagctggcctatgtggtcattggaatcctcacactggcggccatcattgctgccaacgaaatgggccttctggagaccacaaaaagagatctcggcatgtctaaggaacctggggttgtgtcccccaccagctacctggacgtggacctgcaccccgcttctgcctggacgctctacgctgtcgccacaaccgtgatcacacctatgcttcggcataccattgagaatagcaccgcgaacgtttccctggccgctatcgccaaccaagctgtggtcctgatgggactcgataaaggctggccgatttctaagatggacctgggggtgccccttctggccctcggatgctatagccaggtcaatcctctgacactgacggccgcggtgctccttctgatcacccactacgctatcattggccccgggctgcaggccaaagctacaagagaagcccagaagcgcaccgccgctggaatcatgaagaaccctacagttgatggcattatgaccatcgacctcgatcccgtgatttatgactccaaattcgagaagcaactgggccaggtcatgcttctggtgctctgtgccgttcagctgctgctcatgcggacgtcttgggcgctttgcgaggccctgacactggctaccgggcctatcaccacactctgggaaggaagcccgggcaaattttggaataccacaatcgccgtgtccatggctaacattttcagagggagctacctggccggagcgggccttgccttttctatcatgaagtccgtcgggacgggaaaacgcggcaccggcagccagggggagacactgggagaaaagtggaagaaaaagctcaatcaactgtcccggaaagagttcgatctgtataagaaatctggcattaccgaagtggacagaacagaggctaaggaggggctcaaacggggagaaatcacccatcacgccgtgagccgcggctccgctaaacttcagtggtttgttgagagaaacatggtcattcccgaagggcgggtgatcgatctgggatgtggccgcggcgggtggtcttactattgcgccggactgaagaaagtgacggaggtcagaggctacaccaaagggggacctggccatgaggaacccgttcctatgagcacatacgggtggaatattgtgaaactcatgtccggaaaggacgtgttctatctgcccccggagaaatgtgatacccttctgtgcgacatcggcgaaagctctccttcccccacagtcgaggaaagccggaccatccgcgtgctcaagatggttgagccctggctgaagaacaatcagttctgtattaaagtgctgaacccttacatgcccacagtcatcgagcacctcgaaagacttcagcggaagcacggcgggatgctggtgcgcaatcctctgtctagaaactccacccatgagatgtattggattagcaatggaacgggcaacatcgttgcttctgtgaatatggtcagccggctcctgcttaacagatttacaatgacccaccgccggccgaccattgaaaaagatgtggacctgggggccggaacaagacatgtgaacgcggagcccgaaacgcctaatatggacgtcatcggcgagcgcatcaagcggattaaagaggaacacaactccacctggcactacgatgacgagaatccctataagacatgggcctaccatgggtcttatgaagttaaggctaccggaagcgcctccagcatgatcaacggcgtggtgaaactcctgacaaagccttgggatgtcgtgcccatggttacccaaatggctatgacagacaccacgccgttcggccagcagagagtgtttaaagagaaggtcgatacccgcacacctcggtccatgcccgggaccagacgcgtgatgggaattacagccgaatggctgtggcggaccctcggcagaaataaaaagcctcgcctgtgcacgcgggaggagttcacaaagaaagttagaaccaacgccgcgatgggggctgtgtttacagaagagaatcaatgggactctgccaaggccgctgtcgaagatgaggacttctggaaacttgtggatcgcgaaagagagctgcacaagctcggaaaatgtggcagctgcgtttacaacatgatggggaagcgggagaaaaagctgggcgaatttggaaaggccaaaggctcccgcgctatctggtacatgtggcttggggccagatatctggagttcgaagcgctcggatttctgaatgaggaccattggttctctcgggagaacagctactccggcgtggaaggggagggactgcacaagctcggctatattctgagagatatctctaaaatccccgggggcgccatgtacgctgacgacaccgccggatgggatacgcggattaccgaagacgatcttcataatgaggaaaagatcacacaccagatggaccctgagcaccgccagctggctaacgccatttttaaactcacctatcagaataaggtcgtgaaggtccaaagacccacaccgaccggcacagtgatggatatcattagccggaaagaccagcgcgggtccggacaggttggcacctacgggctgaacacgttcacaaatatggaggcgcagcttatcagacaaatggaaggagagggcgtgctgagcaaggccgatctcgaaaaccctcatctgtctgagaaaaagatcacccagtggctggaaaccaaaggggtcgagcggctcaagcgcatggctatttccggcgacgattgcgtggtgaagcccatcgacgatagatttgccaacgctctgcttgccctgaatgacatgggaaaagttcggaaggatattccccagtggcagcctagcaaaggctggcacgactggcaacaggtgccgttctgttctcatcacttccacgagctcatcatgaaggacgggcgcaaactggtcgtgccctgcagacctcaggatgaacttattggacgggctcgcatctcccagggcgccgggtggagcctgagagagacagcgtgtctcggaaaggcctatgctcaaatgtggtctctgatgtactttcatcggcgcgacctgagactcgcctccaacgccatttgcagcgctgttcccgtgcactgggtccctacctcccggacaacgtggagcatccatgcccaccatcagtggatgaccacagaagatatgctgaccgtgtggaatagagtctggatcgaggacaacccctggatggaagataagacacctgtgaccacgtgggagaatgttccctaccttggcaaacgcgaggaccagtggtgtgggtctctgattggcctcaccagccgggcgacatgggctcaaaacatcccgaccgccattcaacaggtgagatccctgatcggaaatgaagagttccttgattatatgccttctatgaagcgctttcggaaagaagaggagagcgaaggcgccatttggtga

SEQ ID NO: 20699 - RNA, 9873 nt, synthetic construct
  misc_feature 1..9873: note = derived and/or modified CDS sequence (opt5) from DENV-3__FJ024467__SS-prME
  source 1..9873: mol_type = other RNA
accagcctgtgcctcatgatggtgctgcccgccgctcttgccttccacctgacatccagagacggcgagcctcggatgatcgtcgggaagaacgaacgcggaaaatctctcctgtttaagacggcgagcggcattaatatgtgtacccttatcgctatggatctgggggagatgtgcgacgatacagttacctacaaatgtccgcatattacagaagtggagcccgaagacatcgattgctggtgtaacctcacctccacatgggtgacctatggaacgtgcaatcaggccggcgagcacagacgggacaagcgctctgtcgccctggctcctcatgtggggatgggactggataccagaacacaaacctggatgagcgccgagggcgcttggcggcaggttgaaaaagtggagacatgggccctccgccaccccggcttcaccattctggcgctttttctggcccattacatcgggacgtccctcacacagaaggtcgtgatcttcattctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacaactggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcagaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgccccctgtaaaatccctttcagcaccgaggacggccaagggaaggcgcataacggaagactgattacagctaatcccgtggtcaccaaaaaggaggaacccgtgaacatcgaggccgaacctccgttcggcgagtccaatattgtgatcgggattggcgataacgccctgaaaatcaattggtataagaagggatctagcatcggcaaaatgtttgaagctacggcccggggggctagacgcatggccattcttggagacacagcgtgggatttcggctccgttgggggagtcctcaacagcctgggcaagatggtgcaccagatctttgggtctgcctacaccgctctgttctccggcgtgagctgggtcatgaaaattggaatcggcgtgctcctgacctggattgggcttaattctaagaacacaagcatgtccttttcttgcatcgccattggagttatcaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagcggattcccccaagcggctggccacagctatcgccggcgcttgggagaatggagtctgtggcattagaagcaccacacgcatggaaaaccttctctggaaacagatcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtgtgggaagtcgaggactatggctttggcgttttcacaaccaatatttggctcaaactgcgcgaagtgtacacgcagctgtgtgaccaccggcttatgagcgctgccgtgaaggatgagagagccgtccacgctgacatggggtactggatcgagtcccagaaaaacggatcttggaagctcgaaaaagccagcctgatcgaggtgaagacatgcacctggcctaagtcccataccctgtggtctaatggcgttctcgaaagcgatatgattatccccaaatccctggcggggcctattagccagcacaaccatcgccccggatatcaaacacagaccgctggcccttggcaccttgggaagctggagctcgactttaattactgcgagggaacgacagtggtcatcaccgaaaactgtggcacacggggcccctctctgagaaccacaaccgtgtccgggaaactgattcacgagtggtgctgtcgcagctgcacgcttccgcctctccggtatatgggagaagatggctgttggtacgggatggagatcagacccatctctgaaaaggaggagaatatggttaaatccctggtgagcgccggatctggcaaggtcgacaacttcaccatgggggtgctgtgcctcgccattctgtttgaagagatgatgcggggaaagttcggcaaaaagcatatgatcgctggcgttttctttacattcgtgcttctgctcagcgggcagattacctggcgcgatatggcccacacactgatcatgattggatccaatgcgagcgacagaatgggcatgggggtcacctatctggctcttatcgccgcctttaaaattcaacccttcctggctctcggatttttcctgcggaagctcacgtctagagaaaacctgcttctgggcgtggggctcgccatggctacaaccctgcagctgcctgaggatatcgaacagatggccaatggaatcgcgcttggcctgatggccctcaaactgattacacagtttgagacctaccaactctggaccgctctgatctcccttacatgtagcaacacgatgttcaccctgacagtggcctggcgcaccgctacactcattctggccggcgtctccctgcttccggtttgccagtctagctccatgcggaagaccgactggctgcccatggccgtggctgcgatgggggtgcctcccctccctctgtttatcttctctctcaaggatacgctgaaaagacgcagctggccccttaatgagggagtcatggccgtgggcctggtttccattctggcttctagcctcctgagaaacgacgtgcctatggccgggccccttgtcgccggaggcctgctcatcgcttgttatgtgatcacagggacctccgccgatctgaccgttgaaaaggcggctgacattacatgggaggaagaggccgaacagaccggagtgagccataacctcatgatcacagtcgacgatgacggcacgatgcggattaaagatgacgagaccgagaatatcctgacagtgcttctgaagaccgccctgctcattgtctctggcgtgtttccgtactccatccctgctacactgcttgtttggcacacctggcagaaacaaacgcagcgcagcggggtgctgtgggatgtcccctctcctcccgaaacccagaaggccgagctcgaagagggagtgtacagaatcaaacagcaaggcattttcgggaagacacaggttggagtgggcgtccagaaggagggggtgtttcataccatgtggcacgtgacacggggagcggttctgacctataacggcaaacgcctcgaaccgaattgggcttccgtcaagaaagacctgatcagctacggcgggggatggagactttctgcccaatggcagaagggcgaggaagtgcaggtgattgccgtcgagcctgggaaaaaccccaagaatttccagacaatgcctggaacgttccaaaccacaaccggcgaaatcggggctattgccctggattttaagcccggaacctccggcagccccatcattaaccgggagggcaaagtggttgggctgtatggaaatggcgtggtcacaaagaacgggggatacgtgtccggcatcgctcagacgaatgccgagcctgacgggccgacccccgaactcgaggaagagatgttcaaaaagcgcaacctgacaatcatggatcttcaccctggcagcggaaaaaccagaaagtatctgcccgcgattgttcgggaagccatcaagcgcagactccggacactgattctcgctcctaccagagtggtcgccgctgagatggaggaagccctgaaaggccttcccatccgctaccagacgacagccaccaagtctgagcataccgggcgggaaattgtggacctgatgtgccacgctacatttaccatgagactgctcagccctgttcgcgtgccgaattataacctgatcatcatggatgaggcgcatttcacagaccccgcctccattgctgcccggggatacatctctaccagagtcggcatgggggaagccgctgccatttttatgacggcgacacctcccggaaccgctgatgccttccctcagagcaatgcccccatccaagacgaggagaaagacattccggaacgctcctggaactctggcaatgagtggatcacagattttgctgggaagaccgtgtggttcgtgcctagcatcaaagccggcaacgacattgcgaactgtcttcggaagaatggaaagaaagtcatccagctgtccagaaagacgtttgataccgaataccagaaaacaaagctcaacgactgggatttcgttgtgaccacagacatttctgagatgggcgccaattttaaagctgatcgcgtgatcgacccccggagatgcctgaagcccgtcattctgaccgatgggcctgagcgggtgatcctcgccggacccatgcctgttacagctgccagcgctgcccagcgcagaggccgggtggggcgcaacccgcaaaaggaaaatgaccagtatattttcaccggacagccccttaacaatgatgaggaccacgcgcattggacggaagccaaaatgctgctggacaacatcaatacacctgagggcatcattcccgctctcttcgaacctgagagagagaagtccgccgctatcgatggggaataccggctgaaaggcgagagcagaaagacctttgtcgaacttatgcgccggggagacctgcccgtgtggctcgcccacaaagttgcctctgagggcattaagtataccgatagaaaatggtgcttcgacgggcagcgcaacaatcaaatcctggaagagaacatggatgtggagatttggacaaaggaaggagagaagaaaaagctgcggccgagatggctcgacgctcgcacctactccgatcctcttgcgctgaaagaatttaaggacttcgccgctggccggaaaagcatcgccctggatctcgtcacagagatcgggagagtgccctctcacctggcccatcgcacgagaaatgctcttgacaacctggtcatgctccacacctccgaacatggaggccgggcctatcgccacgcggtggaggagctgcctgaaacaatggagaccctgctccttctgggcctgatgattctcctgacagggggagccatgctttttctgatcagcggcaaggggattggaaagacctccatcggcctcatttgtgttatcgcttctagcgggatgctgtggatggccgaaatccccctgcagtggattgcttccgccatcgtgctcgagttctttatgatggtgcttctgattcctgagcccgaaaaacagagaacgccgcaagataatcagctggcgtacgtcgttatcggaattctcaccctggccgctatcattgccgctaacgagatgggccttctggaaacaaccaagcgggacctcggcatgagcaaagagcctggggtggtgtctcccacatcctatctggatgtcgacctgcaccccgccagcgcttggaccctctacgccgtggcgacgacagttatcacccctatgcttcgccatacaatcgaaaattctaccgccaacgtgagcctggctgccattgctaaccaggccgtcgtgctgatgggactcgacaagggctggccgatctccaaaatggatctgggggtcccccttctggccctcggatgctactctcaggtgaatcctctgaccctgacagcggctgttctccttctgattacgcactatgccatcattggccccgggctgcaagctaaggccaccagagaggcccagaagcggacagctgccggaatcatgaaaaaccctaccgtggacggcatcatgacaattgatctcgaccccgtcatctacgatagcaagttcgagaaacagctgggccaggtgatgcttctggttctctgtgcggtgcaactgctgctcatgagaacctcctgggccctttgcgaagctctgacgctggccacagggcctattaccaccctctgggagggatctccgggcaagttttggaatacaaccatcgctgtcagcatggccaacattttccgcgggtcctatctggcgggagccggccttgcttttagcatcatgaaatctgtggggacaggaaagcggggcacgggctcccagggggaaaccctgggagagaagtggaaaaagaaactcaatcagctgagcagaaaggaattcgacctgtacaaaaagtccggcatcacagaggtggatcgcaccgaggccaaagaagggctcaagcggggagagacaacccatcacgctgtttctagaggcacggccaagcttcagtggtttgtcgaacggaacatggtgattcccgaggggcgcgtgatcgacctgggatgtggcagaggcgggtggagctattactgcgctggactgaaaaaggtcaccgaagttcggggctatacaaaagggggacctggccatgaggagcccgtgcctatgtccacctacgggtggaatattgtgaagctcatgtctggaaaagatgtcttctacctgcccccggaaaagtgtgacacacttctgtgcgatatcggcgagagctcccctagccccaccgtggaagagtctcgcacaattagagttctcaagatggtggagccctggctgaaaaacaatcaattctgtatcaaggtcctgaacccttatatgcccaccgtgattgaacacctcgagcggcttcagcgcaaacacggcgggatgctggttagaaatcctctgtcccggaacagcacgcatgaaatgtactggatctctaatggaacaggcaacatcgtggcctccgtcaatatggtgagccgcctcctgcttaacagatttaccatgacccaccggagaccgacaattgagaaggacgtggatctgggggcgggaacgcgccatgtcaacgccgaacccgagacccctaatatggacgttatcggcgagcggattaaaagaatcaaggaagagcacaactctacatggcactatgacgatgaaaatccctacaagacctgggcttatcatgggagctacgaggtgaaagccacaggatccgcttctagcatgattaacggcgtggtcaagctcctgaccaaaccttgggacgtggttcccatggtgacacagatggccatgaccgatacgaccccgttcggccaacagcgcgtctttaaggaaaaagtggacacacggacccctagatccatgcccgggacacgccgggccatgggaatcaccgcggagtggctgtggagaacgctcggccgcaataagaagcctcggctgtgcacaagagaggaattcaccaaaaaggttcgcacaaacgctgccatgggggccgtgtttaccgaggaaaatcagtgggatagcgctaaagccgctgtcgaggacgaaaacttctggaagcttgtggatcgggagagagagctgcacaaactcggaaagtgtggctcctgcgtttataatatgatggggaaacgcgaaaagaagctgggcgagtttggaaaagccaagggctctagagcgatctggtacatgtggcttggggcccggtacctggaattcgaggctctcggatttctgaacgaggaccattggttcagccgcgaaaattcctattctggcgtggagggggaaggactgcacaaactcggctacattctgagagatatcagcaagattcccgggggcgccatgtatgctgacgatacggccggatgggacacccggatcacagaggacgatcttcataacgaagagaaaattacccagcaaatggaccctgagcacagacagctggcgaatgccatctttaagctcacataccagaacaaggtcgtgaaagtccagcggcccaccccgacaggcaccgtgatggatatcatttcccgcaaggaccaaagagggtctggacaggttggcacgtatgggctgaatacattcaccaacatggaagctcagcttatccggcagatggagggagaaggcgtgctgagcaaagccgatctcgagaaccctcacctgcccgaaaagaaaattacccaatggctggagacaaagggggtcgagcgcctcagacggatggctatctccggcgacgattgcgtggtgaagcccattgacgatcgctttgccaatgctctgcttgccctgaacgacatgggaaaagttagaaaggatatccctcagtggcagccgagcaaaggctggcatgactggcagcaagtgcccttctgttctcaccatttccacgaactcatcatgaaggatgggcggaaactggtcgtgccttgccgcccccaggacgagcttattggaagagcgcggatctcccagggcgccgggtggagcctgcgcgaaaccgcttgtctcggaaaggcctacgcccaaatgtggtctctgatgtattttcacagacgggacctgcgcctcgcttccaatgccatttgcagcgcggttcctgtgcattgggtccccacatctagaacgacctggtccatccacgctcatcaccagtggatgacaaccgaggatatgctgacagtgtggaaccgggtctggattgaagacaatccttggatggaggataagacccccgtgacgacctgggagaacgttccgtaccttggcaaaagagaagaccagtggtgtgggagcctgatcggcctcacatcccgcgccacctgggcccagaatattcctacagctatccaacaggtgcggagcctgatcggaaacgaggaattccttgattacatgccctctatgaagagatttcgcaaagaggaggaaagcgagggcgccatttggtga

SEQ ID NO: 20700 - RNA, 9873 nt, synthetic construct
  misc_feature 1..9873: note = derived and/or modified CDS sequence (opt5) from DENV-3__FJ024468__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggagtgatcaccctgtatctcggcgctgttgtgcaggccgacatggggtgtgtcattaattggaaaggaaaggagctgaagtgcggcagcgggatcttcgtgacaaacgaggttcatacgtggaccgaacagtacaaatttcaagcggattcccccaagcggctggccacagctattgccggcgcttgggagaatggagtgtgtggcatcagaagcaccacacgcatggaaaaccttctctggaaacagattgccaatgagctgaactatatcctgtgggaaaataacatcaagctcaccgtcgtggttggggacattatcggagtgctggagcagggcaaacggacgcttacccctcagcccatggagctgaagtactcttggaaaacatgggggaaggccaagattgtcaccgctgaaacacaaaactccagcttcatcattgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggatcgagtcccagaaaaacggatcttggaagctcgaaaaagccagcctgattgaggtcaagacatgcacctggcctaagtcccataccctgtggtctaatggcgtgctcgaaagcgatatgatcattcccaaatccctggcggggcctatcagccagcacaactatcgccccggataccatacacaaaccgctggcccttggcaccttgggaagctggagctcgactttaattattgcgagggaacgacagttgtgattaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagatcagacccatttctgaaaaggaggagaatatggtgaaatccctggttagcgccggatctggcaaggtggacaacttcaccatgggggtcctgtgcctcgccatcctgtttgaagaggtgatgcggggaaagttcggcaaaaagcatatgattgctggcgttttctttacattcgtgcttctgctcagcgggcagatcacctggcgcgatatggcccacacactgattatgatcggatccaatgcgagcgacaaaatgggcatgggggtcacctacctggctcttattgccacgtttaagatccagcccttcctggccctcggatttttcctgagaaaactcacatctcgggaaaacctgcttctgggcgtggggctcgctatggccaccacactgcaactgcctgaggatatcgaacagatggctaatggaattgcccttggcctgatggcgctcaagctgatcacccagtttgagacctatcagctctggacagccctgatttcccttacgtgtagcaacaccatgttcacactgaccgtggcttggagaacagccaccctcatcctggctggcgtctccctgcttccggtttgccaatctagctccatgcgcaagacggactggctgcccatggccgtggccgctatgggggtgcctcccctccctctgtttattttctctctcaaagatacactgaagcggagaagctggccccttaatgagggagtcatggcggtgggcctggtttccatcctggcctctagcctcctgcgcaacgacgtgcctatggctgggccccttgtcgccggaggcctgctcatcgcctgttacgtgattaccgggacctccgctgatctgacagttgaaaaagccgcggacatcacctgggaggaagaggctgaacagacaggagtgagccataacctcatgattacggtcgacgatgacggcaccatgagaatcaaggatgacgagacagagaatattctgaccgtgcttctgaaaacagccctgctcatcgtctctggcgtgtttccgtactccatccctgccaccctgcttgtttggcacacgtggcagaagcagacccaacggagcggggtgctgtgggatgtcccctctcctcccgaaacacagaaagctgagctcgaagagggagtgtatcgcattaagcagcagggcatcttcgggaagacccaagttggagtgggcgtccagaaagagggggtgtttcatacaatgtggcacgtgaccagaggagccgttctgacatacaacggcaagcggctcgaaccgaattgggcgtccgtcaaaaaggacctgattagctatggcgggggatggcgcctttctgctcagtggcaaaaaggcgaggaagtgcaggtgatcgccgtcgagcctgggaagaaccccaagaatttccagacgatgcctggaaccttccagacaaccaccggcgaaattggggccatcgctctggattttaaacccggaacatccggcagccccattatcaacagagagggcaaggtggttgggctgtacggaaatggcgtggtcacgaaaaacgggggatatgtgtccggcatcgcccaaaccaatgctgagcctgacgggccgacacccgaactcgaggaagagatgttcaagaaacggaacctgaccattatggatcttcaccctggcagcggaaagacacgcaagtacctgcccgccatcgttagagaagcgattaaacggcgcctcagaaccctgatcctcgcccctacgcgggtggtcgctgccgagatggaggaagctctgaagggccttcccattagatatcagacaaccgccaccaaatctgagcatacagggcgcgaaatcgtggacctgatgtgccacgccacctttacaatgcggctgctcagccctgttagagtgccgaattacaacctgatcattatggatgaggctcatttcaccgaccccgcgtccatcgccgctcgcggatacatttctacgcgggtcggcatgggggaagccgccgctatctttatgacagccacccctcccggaacagcggatgctttccctcagagcaatgcccccattcaggacgaggagagagacatcccggaacgctcctggaactctggcaatgagtggatcaccgattttgccgggaagacggtgtggttcgtgcctagcattaaagctggcaacgacatcgccaactgtcttcggaagaatggaaagaaagtcattcaactgtccagaaagacctttgatacagaatatcagaaaaccaagctcaacgactgggatttcgttgtgacaaccgacatctctgagatgggcgcgaattttaaagccgatcgcgtgattgacccccggagatgcctgaagcccgtcatcctgacagatgggcctgagcgggtgattctcgctggacccatgcctgttaccgccgctagcgccgctcagcgcagaggccgggtggggcgcaacccgcagaaggaaaatgaccaatacatcttcacgggacagccccttaacaatgatgaggaccacgcccattggacagaagcgaaaatgctgctggacaacatcaatacccctgagggcattatccccgccctcttcgaacctgagagagagaagtccgctgccattgatggggaatatcggctgaaaggcgagagcagaaagacctttgtcgaacttatgcgccggggagacctgcccgtgtggctcgctcacaaagttgcctctgagggcatcaagtacacagatagaaaatggtgcttcgacgggcagcgcaacaatcagattctggaagagaacatggatgtggagatctggaccaaggaaggagagaagaaaaagctgcggccgagatggctcgacgcccgcacatattccgatcctcttgctctgaaagaatttaaggacttcgcggccggccggaaaagcatcgctctggatctcgtcacggagattgggagagtgccctctcacctggcccatcgcaccagaaatgcccttgacaacctggtcatgctccacacatccgaacatggaggccgggcttaccgccacgccgtggaggagctgcctgaaaccatggagacactgctccttctgggcctgatgatcctcctgaccgggggagcgatgctttttctgattagcggcaaggggatcggaaagacgtccattggcctcatctgtgttatcgcctctagcgggatgctgtggatggctgaaattcccctgcaatggatcgcctccgctattgtgctcgagttctttatgatggtgcttctgatccctgagcccgaaaaacagagaaccccgcaggataatcaactggcctatgtcgttattggaatcctcacactggcggccattatcgctgccaacgagatgggccttctggaaaccacaaagcgggacctcggcatgagcaaagagcctggggtggtgtctcccacctcctacctggatgtcgacctgcaccccgctagcgcctggacgctctacgctgtggccacaaccgttatcacacctatgcttcgccataccattgaaaattctaccgcgaacgtgagcctggccgctatcgccaaccaggctgtcgtgctgatgggactcgacaagggctggccgatttccaaaatggatctgggggtcccccttctggccctcggatgctattctcaggtgaatcctctgacactgacggccgcggttctccttctgatcacccactacgctattatcggccccgggctgcaggccaaggctacaagagaggcccaaaagcggaccgccgctggaatcatgaaaaaccctacagtggacggcattatgaccatcgatctcgaccccgtcatttatgatagcaagttcgagaaacagctgggccaggtgatgcttctggttctctgtgccgtgcagctgctgctcatgagaacgtcctgggcgctttgcgaagccctgacactggctaccgggcctatcaccacactctgggagggatctccgggcaagttttggaataccacaattgccgtcagcatggctaacatcttccgcgggtcctacctggccggagcgggccttgcctttagcatcatgaaatctgtggggacgggaaagcggggcaccggctcccaaggggaaacactgggagagaagtggaaaaagaaactcaatcagctgagcagaaaggaattcgacctgtataaaaagtccggcattaccgaggtggatcgcacagaggctaaagaagggctcaagcggggagagaccacgcatcacgccgtttctagaggcaccgctaagcttcagtggtttgtcgaacggaacatggtgatccccgaggggcgcgtgattgacctgggatgtggcagaggcgggtggagctactattgcgccggactgaaaaaggtcacagaagttcggggctacaccaaagggggacctggccatgaggagcccgtgcctatgtccacatacgggtggaatatcgtgaagctcatgtctggaaaagatgtcttctatctgcccccggaaaagtgtgacacccttctgtgcgatattggcgagagctcccctagccccacagtggaagagtctcgcaccatcagagttctcaagatggtggagccctggctgaaaaacaatcagttctgtattaaggtcctgaacccttacatgcccacggtgatcgaacacctcgagcggcttcaacgcaaacacggcgggatgctggttagaaatcctctgtcccggaacagcacacatgaaatgtattggatctctaatggaaccggcaacattgtggcttccgtcaatatggtgagccgcctcctgcttaacagatttaccatgacacaccggagaccgacgatcgagaaggacgtggatctgggggccggaacccgccatgtcaacgcggaacccgagacacctaatatggacgttattggcgagcggatcaaaagaattaaggaagagcacaactctacctggcactacgacgatgaaaatccctataagacatgggcctaccatgggagctatgaggtgaaagctaccggatccgcctctagcatgatcaacggcgtggtcaagctcctgacaaaaccttgggacgtggttcccatggtgacccagatggctatgacggataccacaccgttcggccagcaacgcgtctttaaggaaaaagtggacacccggacacctagatccatgcccgggacccgccgggttatgggaatcacggccgagtggctgtggagaacactcggccgcaataagaagcctcggctgtgcaccagagaggaattcacaaaaaaggtgcgcaccaacgccgcgatgggggctgtctttacggaggaaaatcagtgggatagcgccaaagccgctgtggaggacgaagatttctggaagcttgttgaccgggagagagagctgcacaaactcggaaagtgtggctcctgcgtgtacaacatgatggggaaacgcgaaaagaagctgggcgagtttggaaaagccaagggctctagagctatttggtacatgtggcttggggcccggtatctggaattcgaggcgctcggatttctgaatgaggatcattggttcagccgcgaaaactcctactctggcgtcgagggggaaggactgcacaaactcggctatatcctgagagacattagcaagatccccgggggcgccatgtacgctgatgacaccgccggatgggacacacggattaccgaggatgaccttcataatgaagagaaaatcacacagcagatggatcctgagcacagacaactggctaacgccatctttaagctcacctatcagaataaggtggtcaaagtgcagcggcccacaccgaccggcacggttatggacattatctcccgcaaggatcagagagggtctggacaagtgggcacatacgggctgaacaccttcaccaatatggaagcgcagcttattcggcagatggagggagaaggcgtcctgagcaaagccgacctcgagaaccctcacctgcccgaaaagaaaatcacacagtggctggagaccaagggggtggagcgcctcagacggatggctatttccggcgatgactgcgtggttaagcccatcgatgaccgctttgccaacgctctgcttgccctgaatgatatgggaaaagtgagaaaggacatccctcaatggcagccgagcaaaggctggcatgattggcagcaggtccccttctgttctcaccatttccacgaactcattatgaaggacgggcggaaactggtggttccttgccgcccccaagacgagcttatcggaagagctcggatttcccagggcgccgggtggagcctgcgcgaaacagcgtgtctcggaaaggcctatgctcagatgtggtctctgatgtactttcacagacgggatctgcgcctcgcctccaacgccatctgcagcgctgtgcctgtccattgggtgcccacgtctagaaccacatggtccattcacgcccatcaccaatggatgaccacagaggacatgctgaccgtctggaatcgggtgtggatcgaagataacccttggatggaggacaagacgcccgttaccacatgggagaatgtgccgtaccttggcaaaagagaagatcagtggtgtgggagcctgattggcctcacctcccgcgcgacatgggctcagaacatccctaccgccatccagcaagtccggagcctgattggaaatgaggaattccttgactatatgccctctatgaagagatttcgcaaagaggaggaaagcgagggcgccatctggtga

SEQ ID NO: 20701 - RNA, 9873 nt, synthetic construct
  misc_feature 1..9873: note = derived and/or modified CDS sequence (opt5) from DENV-3__FJ024470__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggccctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccattttcacactgaccgtggcttggcgcacagccaccctcatcctggctggcgtgtccctgcttccggtctgccaatctagctccatgcggaagacggactggctgcccatggccgttgccgctatgggggtgcctcccctccctctgtttatcttctctctcaaggatacactgaaaagacgcagctggccccttaatgagggagtgatggcggtcggcctggtgtccattctggcctctagcctcctgagaaacgacgttcctatggctgggccccttgtggccggaggcctgctcatcgcctgttatgtcattaccgggacctccgctgatctgacagtggaaaaggccgcggacatcacctgggaggaagaggctgaacagacaggagttagccacaacctcatgattacggtggacgatgacggcaccatgcggatcaaagatgacgagacagagaatatcctgaccgtccttctgaagacagccctgctcattgtgtctggcatctttccgtactccattcctgccaccctgcttgtctggcatacgtggcagaaacagacccaacgcagcggggtgctgtgggatgttccctctcctcccgaaacacagaaggctgagctcgaagagggagtgtacagaatcaaacagcagggcattttcgggaagacccaagtcggagtgggcgttcagaaggagggggtgtttcacacaatgtggcacgtcacccggggagccgtgctgacatataacggcaaacgcctcgaaccgaattgggcgtccgtgaagaaagacctgatcagctacggcgggggatggagactttctgctcagtggcaaaagggcgaggaagttcaggtcattgccgtggagcctgggaaaaaccccaagaatttccagacgatgcctggaaccttccagacaaccaccggcgaaatcggggccatcgctctggattttaagcccggaacatccggcagccccattatcaaccgggagggcaaagtggtcgggctgtatggaaatggcgtggttacgaagaacgggggatacgtgtccggcattgcccaaaccaatgctgagcctgacgggccgacacccgaactcgaggaagagatgttcaaaaagcgcaacctgaccatcatggatcttcatcctggcagcggaaaaacaagaaagtatctgcccgccattgtccgggaagcgatcaagcgcagactccggaccctgatcctcgcccctacgagagtggttgctgccgagatggaggaagctctgaaaggccttcccattcgctaccagacaaccgccaccaagtctgagcacacagggcgggaaatcgtggacctgatgtgccatgccacctttacaatgagactgctcagccctgtccgcgtgccgaattataacctgattatcatggatgaggctcacttcaccgaccccgcgtccattgccgctcggggatacatctctacgagagttggcatgggggaagccgccgctatctttatgacagccacccctcccggaacagcggatgctttccctcagagcaatgcccccattcaggacgaggagcgcgacatcccggaacggtcctggaactctggcaatgagtggattaccgattttgccgggaaaacggtgtggttcgtccctagcatcaaggctggcaacgacattgccaactgtcttcgcaaaaatggaaagaaggtgatccaactgtccagaaaaacctttgatacagaataccagaagaccaaactcaacgactgggatttcgtggtcacaaccgacatttctgagatgggcgcgaattttaaggccgatcgggttatcgaccccagacggtgcctgaaacccgtgatcctgacagatgggcctgagcgcgtgattctcgctggacccatgcctgtcaccgccgctagcgccgctcagagacggggccgcgtggggagaaacccgcagaaggaaaatgaccaatatatcttcacgggacagccccttaacaatgatgaggaccatgcccactggacagaagcgaagatgctgctggacaacattaatacccctgagggcatcattcccgccctcttcgaacctgagcgggagaaatccgctgccatcgatggggaatacagactgaagggcgagagccgcaaaacctttgttgaacttatgcggagaggagacctgcccgtgtggctcgctcacaaggtcgcctctgagggcatcaaatatacagatcgcaagtggtgcttcgacgggcagcggaacaatcagattctggaagagaacatggatgtggagatctggaccaaagaaggagagaagaagaaactgagaccgcgctggctcgacgcccggacatactccgatcctcttgctctgaaggaatttaaagacttcgcggccggcagaaagagcattgctctggatctcgttacggagatcgggcgcgtgccctctcatctggcccacagaacccggaatgcccttgacaacctggtcatgctccatacatccgaacacggaggccgcgcttatagacacgccgtggaggagctgcctgaaaccatggagacactgctccttctgggcctgatgattctcctgaccgggggagcgatgctttttctgatcagcggcaaagggatcggaaagacgtccattggcctcatctgtgtcattgcctctagcgggatgctgtggatggctgaaatccccctgcaatggattgcctccgctatcgtgctcgagttctttatgatggttcttctgattcctgagcccgaaaagcagcggaccccgcaggataatcaactggcctacgtggtgatcggaatcctcacactggcggccattatcgctgccaacgagatgggccttctggaaaccacaaaacgcgacctcggcatgagcaaggagcctggggtcgtttctcccacctcctatctggatgtggacctgcatcccgctagcgcctggacgctctacgctgtggccacaaccgtcattacacctatgcttagacacaccatcgaaaattctaccgcgaacgtgagcctggccgctattgccaaccaggctgttgtgctgatgggactcgacaaaggctggccgatctccaagatggatctgggggtcccccttctggccctcggatgctactctcaggtgaatcctctgacactgacggccgcggtcctccttctgatcacccattatgctattatcggccccgggctgcaggccaaagctacacgggaggcccaaaagagaaccgccgctggaattatgaagaaccctacagtggacggcatcatgaccattgatctcgaccccgttatctacgatagcaaattcgagaagcagctgggccaggtgatgcttctggtcctctgtgccgtgcagctgctgctcatgcgcacgtcctgggcgctttgcgaagccctgacactggctaccgggcctatcaccacactctgggagggatctccgggcaaattttggaataccacaattgccgttagcatggctaacatcttccgggggtcctatctggccggagcgggccttgcctttagcattatgaagtctgtggggacgggaaaaagaggcaccggctcccaaggggaaacactgggagagaagtggaagaaaaagctcaatcagctgagccgcaaagagttcgacctgtacaagaaatccggcatcaccgaggtcgatcggacagaggctaaggaagggctcaaaagaggagagattacccaccatgccgtgtctcggggcagcgctaaacttcagtggtttgtggaacgcaacatggttatccccgaggggagagtcattgacctgggatgtggccggggcgggtggtcctattactgcgccggactgaagaaagtgacggaagtgcgcggctataccaaagggggacctggccacgaggagcccgtccctatgtctacatacgggtggaatatcgttaaactcatgagcggaaaggatgtgttctacctgcccccggaaaaatgtgacacccttctgtgcgatatcggcgagtccagcccttctcccacagtggaagagtccagaaccattcgggtcctcaagatggtggagccctggctgaagaacaatcagttctgtatcaaagttctgaacccttatatgcccacagtgattgaacacctcgagcgccttcaaagaaagcatggcgggatgctggtccggaatcctctgagccgcaactctacccacgaaatgtactggatctccaatggaacgggcaacattgtggctagcgttaatatggtgtctagactcctgcttaaccggtttacaatgacccatagacgcccgaccatcgagaaagacgtcgatctgggggccggaacacggcacgtgaacgcggaacccgagacgcctaatatggacgtgatcggcgagagaattaagcgcatcaaagaagaacacaacagcacctggcattatgacgatgaaaatccctacaagacatgggcctatcacgggtcctacgaggtcaaggctaccggatctgccagctccatgattaacggcgttgtgaaactcctgacaaagccttgggacgtggtccccatggtgacccagatggctatgacagataccacgccgttcggccagcaacgggtttttaaagaaaaggtggacaccagaacacctcgcagcatgcccgggacccggagagtcatgggaatcacagccgagtggctgtggcgcaccctcggccggaataaaaagcctagactgtgcacgcgcgaggagttcacaaagaaagtgcggaccaacgccgcgatgggggctgtttttacagaggaaaatcagtgggattccgccaaggccgctgtggaggacgaagatttctggaaacttgtcgacagagagcgcgagctgcataagctcggaaaatgtggctcttgcgtgtataacatgatggggaagagagagaagaagctgggcgagtttggaaaggccaaaggcagccgggctatttggtacatgtggcttggggcccgctacctggagttcgaggcgctcggatttctgaatgaggatcactggttctccagagaaaactcttatagcggcgttgagggggaaggactgcataagctcggctacatcctgcgggacatctccaaaattcccgggggcgccatgtatgctgatgacaccgccggatgggacacgagaatcaccgaggatgaccttcacaatgaagagaagattacacagcagatggatcctgagcaccggcaactggctaacgccatctttaaactcacctaccagaataaggtggtcaaggtgcagcgccccacaccgaccggcacagtcatggacattatctctagaaaagatcagcgggggagcggacaagtgggcacctatgggctgaacacgttcacaaatatggaagcgcagcttatccgccagatggagggagaaggcgttctgtccaaggccgacctcgagagccatcatctgcctgagaagaagattacccagtggctggagaccaaaggggtggagagactcaagcggatggctatctctggcgatgactgcgtcgtgaagcccattgatgaccgctttgccaacgctctgcttgccctgaacgatatgggaaaagtgagaaaggacatcccccaatggcagccttccaaaggctggcatgattggcagcaggttccgttctgtagccaccacttccatgaactcattatgaaggacgggcggaaactggtggtcccctgccgccctcaagacgagcttatcggacgggctcggatttctcagggcgccgggtggtccctgcgcgaaacagcgtgtctcggaaaggcctacgctcagatgtggagcctgatgtattttcacagacgggatctgcgcctcgcctctaatgccatctgctccgctgtgcccgttcattgggtgcctaccagcagaacaacgtggtccatccacgcccatcaccaatggatgaccacagaggacatgctgaccgtctggaaccgggtgtggattgaagataatccctggatggaggacaagacacctgtcaccacgtgggagaacgtgccctaccttggcaaaagagaagatcagtggtgtgggagcctgatcggcctcacctctcgcgcgacatgggctcagaatattccgaccgccatccagcaagttcggagcctgattggaaacgaggagttccttgactacatgccttccatgaagagatttcgcaaagaggaggaatctgagggcgccatctggtga

SEQ ID NO: 20702 - RNA, 9873 nt, synthetic construct
  misc_feature 1..9873: note = derived and/or modified CDS sequence (opt5) from DENV-3__FJ024471__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggccctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaaccatcgccccggatatcacacacaaaccgctggcccttggcaccttgggaagctggagctcgactttaattactgcgagggaacgacagtggttatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcacatgatcgctggcgtgttctttacattcgttcttctgctcagcgggcagattacctggcgcgatatggcccatacactgatcatgattggatccaatgcgagcgacagaatgggcatgggggtgacctatctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctaccagctctggacagccctgatctcccttacgtgtagcaacaccattttcacactgaccgtggcttggcgcacagccaccctcatcctggctggcgtgtccctgcttccggtctgccaatctagctccatgcggaagacggactggctgcccatggccgttgccgctatgggggtgcctcccctccctctgtttatcttctctctcaaggatacactgaaaagacgcagctggccccttaatgagggagtgatggcggtcggcctggtgtccattctggcctctagcctcctgagaaacgacgttcctatggctgggccccttgtggccggaggcctgctcatcgcctgttatgtcattaccgggacctccgctgatctgacagtggaaaaggccgcggacatcacctgggaggaagaggctgaacagacaggagttagccacaacctcatgattacggtggacgatgacggcaccatgcggatcaaagatgacgagacagagaatatcctgaccgtccttctgaagacagccctgctcattgtgtctggcatctttccgtactccattcctgccaccctgcttgtctggcatacgtggcagaaacagacccaacgcagcggggtgctgtgggatgttccctctcctcccgaaacacagaaggctgagctcgaagagggagtgtacagaatcaaacagcagggcattttcgggaagacccaagtcggagtgggcgttcagaaggagggggtgtttcacacaatgtggcacgtcacccggggagccgtgctgacatataacggcaaacgcctcgaaccgaattgggcgtccgtgaagaaagacctgatcagctacggcgggggatggagactttctgctcagtggcaaaagggcgaggaagttcaggtcattgccgtggagcctgggaaaaaccccaagaatttccagacgatgcctggaaccttccagacaaccaccggcgaaatcggggccatcgctctggattttaagcccggaacatccggcagccccattatcaaccgggagggcaaagtggtcgggctgtatggaaatggcgtggttacgaagaacgggggatacgtgtccggcattgcccaaaccaatgctgagcctgacgggccgacacccgaactcgaggaagagatgttcaaaaagcgcaacctgaccatcatggatcttcatcctggcagcggaaaaacaagaaagtatctgcccgccattgtccgggaagcgatcaagcgcagactccggaccctgatcctcgcccctacgagagtggttgctgccgagatggaggaagctctgaaaggccttcccattcgctaccagacaaccgccaccaagtctgagcacacagggcgggaaatcgtggacctgatgtgccatgccacctttacaatgagactgctcagccctgtccgcgtgccgaattataacctgattatcatggatgaggctcacttcaccgaccccgcgtccattgccgctcggggatacatctctacgagagttggcatgggggaagccgccgctatctttatgacagccacccctcccggaacagcggatgctttccctcagagcaatgcccccattcaggacgaggagcgcgacatcccggaacggtcctggaactctggcaatgagtggattaccgattttgccgggaaaacggtgtggttcgtccctagcatcaaggctggcaacgacattgccaactgtcttcgcaaaaatggaaagaaggtgatccaactgtccagaaaaacctttaacacagaataccagaagaccaaactcaatgattgggacttcgtggtcacaaccgatatttctgagatgggcgcgaactttaaggccgaccgggttatcgatcccagacggtgcctgaaacccgtgatcctgacagacgggcctgagcgcgtgattctcgctggacccatgcctgtcaccgccgctagcgccgctcagagacggggccgcgtggggagaaatccgcagaaggaaaacgatcaatatatcttcacgggacagccccttaataacgacgaggatcatgcccactggacagaagcgaagatgctgctggacaatattaacacccctgagggcatcattcccgccctcttcgaacctgagcgggagaaatccgctgccatcgacggggaatacagactgaagggcgagagccgcaaaacctttgttgaacttatgcggagaggagatctgcccgtgtggctcgctcacaaggtcgcctctgagggcatcaaatatacagaccgcaagtggtgcttcgatgggcagcggaataaccagattctggaagagaatatggacgtggagatctggaccaaagaaggagagaagaagaaactgagaccgcgctggctcgatgcccggacatactccgaccctcttgctctgaaggaatttaaagatttcgcggccggcagaaagagcattgctctggacctcgttacggagatcgggcgcgtgccctctcatctggcccacagaacccggaacgcccttgataatctggtcatgctccatacatccgaacacggaggccgcgcttatagacacgccgtggaggagctgcctgaaaccatggagacactgctccttctgggcctgatgattctcctgaccgggggagcgatgctttttctgatcagcggcaaagggatcggaaagacgtccattggcctcatctgtgtcattgcctctagcgggatgctgtggatggctgaaatccccctgcaatggattgcctccgctatcgtgctcgagttctttatgatggttcttctgattcctgagcccgaaaagcagcggaccccgcaggacaaccaactggcctacgtggtgatcggaatcctcacactggcggccattatcgctgccaatgagatgggccttctggaaaccacaaaacgcgatctcggcatgagcaaggagcctggggtcgtttctcccacctcctatctggacgtggatctgcatcccgctagcgcctggacgctctacgctgtggccacaaccgtcattacacctatgcttagacacaccatcgaaaactctaccgcgaacgtgagcctggccgctattgccaatcaggctgttgtgctgatgggactcgacaaaggctggccgatctccaagatggacctgggggtcccccttctggccctcggatgctactctcaggtgaaccctctgacactgacggccgcggtcctccttctgatcacccattatgctattatcggccccgggctgcaggccaaagctacacgggaggcccaaaagagaaccgccgctggaattatgaagaatcctacagtggatggcatcatgaccattgacctcgatcccgttatctacgacagcaaattcgagaagcagctgggccaggtgatgcttctggtcctctgtgccgtgcagctgctgctcatgcgcacgtcctgggcgctttgcgaagccctgacactggctaccgggcctatcaccacactctgggagggatctccgggcaaattttggaacaccacaattgccgttagcatggctaatatcttccgggggtcctatctggccggagcgggccttgcctttagcattatgaagtctgtggggacgggaaaaagaggcaccggctcccaaggggaaacactgggagagaagtggaagaaaaagctcaaccagctgagccgcaaagagttcgatctgtacaagaaatccggcatcaccgaggtcgaccggacagaggctaaggaagggctcaaaagaggagagattacccaccatgccgtgtctcggggcagcgctaaacttcagtggtttgtggaacgcaatatggttatccccgaggggagagtcattgatctgggatgtggccggggcgggtggtcctattactgcgccggactgaagaaagtgacggaagtgcgcggctataccaaagggggacctggccacgaggagcccgtccctatgtctacatacgggtggaacatcgttaaactcatgagcggaaaggacgtgttctacctgcccccggaaaaatgtgatacccttctgtgcgacatcggcgagtccagcccttctcccacagtggaagagtccagaaccattcgggtcctcaagatggtggagccctggctgaagaataaccagttctgtatcaaagttctgaatccttatatgcccacagtgattgaacacctcgagcgccttcaaagaaagcatggcgggatgctggtccggaaccctctgagccgcaattctacccacgaaatgtactggatctccaacggaacgggcaatattgtggctagcgttaacatggtgtctagactcctgcttaaccggtttacaatgacccatagacgcccgaccatcgagaaagatgtcgacctgggggccggaacacggcacgtgaatgcggaacccgagacgcctaacatggatgtgatcggcgagagaattaagcgcatcaaagaagaacacaatagcacctggcattatgacgacgaaaacccctacaagacatgggcctatcacgggtcctacgaggtcaaggctaccggatctgccagctccatgattaatggcgttgtgaaactcctgacaaagccttgggatgtggtccccatggtgacccagatggctatgacagacaccacgccgttcggccagcaacgggtttttaaagaaaaggtggataccagaacacctcgcagcatgcccgggacccggagagtcatgggaatcacagccgagtggctgtggcgcaccctcggccggaacaaaaagcctagactgtgcacgcgcgaggagttcacaaagaaagtgcggaccaatgccgcgatgggggctgtttttacagaggaaaaccagtgggactccgccaaggccgctgtggaggatgaagacttctggaaacttgtcgatagagagcgcgagctgcataagctcggaaaatgtggctcttgcgtgtataatatgatggggaagagagagaagaagctgggcgagtttggaaaggccaaaggcagccgggctatttggtacatgtggcttggggcccgctacctggagttcgaggcgctcggatttctgaacgaggaccactggttctccagagaaaattcttatagcggcgttgagggggaaggactgcataagctcggctacatcctgcgggatatctccaaaattcccgggggcgccatgtatgctgacgataccgccggatgggacacgagaatcaccgaggacgatcttcacaacgaagagaagattacacagcagatggaccctgagcaccggcaactggctaatgccatctttaaactcacctaccagaacaaggtggtcaaggtgcagcgccccacaccgaccggcacagtcatggatattatctctagaaaagaccagcgggggagcggacaagtgggcacctatgggctgaatacgttcacaaacatggaagcgcagcttatccgccagatggagggagaaggcgttctgtccaaggccgatctcgagagccatcacctgtctgagaagaagattacccagtggctggagaccaaaggggtggagagactcaagcggatggctatctccggcgacgattgcgtcgtgaagcctattgacgatcgctttgccaacgctctgcttgccctgaatgacatgggaaaagtgagaaaggatatcccccaatggcagcccagcaaaggctggcatgactggcagcaggttcctttctgttctcaccacttccatgaactcattatgaaggatgggcggaaactggtggtcccgtgccgcccccaagacgagcttatcggacgggctcggatttcccagggcgccgggtggagcctgcgcgaaacagcgtgtctcggaaaggcctacgctcagatgtggtctctgatgtattttcacagacgggacctgcgcctcgcctccaacgccatctgcagcgctgtgcctgttcattgggtgcccacctccagaacaacgtggagcatccacgcccatcaccaatggatgaccacagaggatatgctgaccgtctggaatcgggtgtggattgaagacaacccttggatggaggataagacacccgtcaccacgtgggagaatgtgccttaccttggcaaaagagaagaccagtggtgtgggtctctgatcggcctcaccagccgcgcgacatgggctcagaacattcccaccgccatccagcaagttcggtccctgattggaaatgaggagttccttgattacatgccgtctatgaagagatttcgcaaagaggaggaaagcgagggcgccatctggtga

SEQ ID NO: 20703 - RNA, 9873 nt, synthetic construct
  misc_feature 1..9873: note = derived and/or modified CDS sequence (opt5) from DENV-3__FJ182005__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaagtgcctttcagcaccgaggacggccaagggaaggcccattccggaagactgattacagcgaaccccgtcgtgaccaaaaaggaggaacccgtgaatatcgaggctgaacctccgttcggcgagtctaacattgttatcgggattggcgataatgccctgaaaatcaactggtataagaagggaagctccatcggcaaaatgtttgaagccacggctagaggggccagacgcatggctattcttggagacacagcctgggatttcggcagcgtcgggggagtgctcaattctctgggcaagatggtgcaccagatctttgggtccgcgtacaccgccctgttcagcggcgtctcttgggtgatgaaaattggaatcggcattctcctgacctggatcgggcttaacagcaagaatacatccatgtcttttagctgcattgttatcggaatcattaccctgtatctcggcgctgtggtccaggccgacatggggtgtgtgatcaactggaaaggaaaggagctgaagtgcggctccgggattttcgttacaaatgaggtgcatacgtggaccgaacagtacaaatttcaagctgatagccccaagcggctggccacagcgatcgccggcgcttgggagaacggagtctgtggcattagatctaccacacgcatggaaaatcttctctggaaacagatcgccaacgagctgaattatatcctgtgggaaaacaatattaagctcaccgtggttgtgggggacatcattggagtcctggagcagggcaaacggacgcttacccctcagcccatggagctgaagtactcctggaaggcttgggggaaggccaagatcgtgacagccgaaacccaaaacagctctttcattatcgatggacctaacacacccgagtgcccgtccgctagcagagcgtggaatgtgtgggaagtcgaggactatggctttggcgttttcaccacaaacatctggctcaaactgcgcgaagtgtacacccagctgtgtgaccaccggcttatgtccgccgctgtgaaggatgagagagccgtccacgccgacatggggtactggattgagtctcagaaaaatggaagctggaagctcgaaaaggcttccctgatcgaggtgaagacgtgcacatggcctaagtctcataccctgtggagcaacggcgttctcgaatccgatatgattatccccaaaagcctggccgggcctatttctcagcacaattatcgccccggataccatacccaaacagcgggcccttggcaccttgggaagctggagctcgactttaactattgcgagggaaccacggtggtcatcacagaaaattgtggcacccggggcccctccctgagaacaaccacagtgagcgggaaactgatccacgagtggtgctgtcgctcttgcacccttccgcctctccggtacatgggagaagatggctgttggtatgggatggagattagacccatctccgaaaaggaggagaacatggttaaaagcctggtgtctgctggaagcggcaaggtcgacaatttcacgatgggggtgctgtgcctcgccattctgtttgaagaggttatgcggggaaagttcggcaaaaagcatatgatcgccggcgtgttctttaccttcgtccttctgctctccgggcagattacatggcgcgatatggctcacaccctgatcatgattggaagcaacgcctctgacagaatgggcatgggggtgacatacctggcgcttatcgctacctttaaaatccagcccttcctggccctcggatttttcctgcggaagctcacgtccagagaaaatctgcttctgggcgtggggctcgccatggctacaaccctgcaactgcctgaggatattgaacagatggccaacggaatcgctcttggcctgatggccctcaaactgattacacagtttgagacctatcagctctggaccgcgctgatcagccttacatgttccaatacgattttcaccctgacagtcgcctggcgcaccgctacactcatcctggccggcgtttctctgcttccggtgtgccaaagctcctctatgcggaagaccgactggctgcccatgacggtggctgccatgggggtccctcccctccctctgtttatcttcagcctcaaggatacactgaaaagacgctcctggccccttaacgagggagtgatggccgttggcctggtgtctattctggctagctccctcctgagaaatgacgtccctatggcggggccccttgtggccggaggcctgctcatcgcttgttacgttattaccgggaccagcgccgatctgacagtggaaaaggccgctgacgtcacctgggaggaagaggccgaacagacaggagtgtctcataacctcatgatcacggtcgacgatgacggcaccatgcggattaaagatgacgagacagagaacatcctgaccgtgcttctgaagacagcgctgctcatcgtttccggcatttttccgtacagcatccctgctaccctgcttgtgtggcacacgtggcagaaacagacccaacgctctggggtcctgtgggatgtgccctcccctcccgaaacacagaaggccgagctcgaagagggagtttatagaattaaacagcagggcatcttcgggaagacccaagtgggagtcggcgtgcagaaggagggggtgtttcatacaatgtggcacgttacccggggagccgtcctgacatacaatggcaaacgcctcgaaccgaactgggctagcgtgaagaaagacctgatttcttatggcgggggatggagactttccgcccagtggcaaaagggcgaggaagtgcaggtcatcgcggtggagcctgggaaaaatcccaagaacttccagacgatgcctggaaccttccagacaaccaccggcgaaattggggctatcgccctggattttaagcccggaacaagcggctcccccatcattaatcgggagggcaaagttgtggggctgtacggaaacggcgtcgtgacgaagaatgggggatatgttagcggcatcgcccaaaccaacgctgagcctgacgggccgacacccgaactcgaggaagagatgttcaaaaagcgcaatctgaccattatggatcttcaccctggctctggaaaaacaagaaagtacctgcccgccatcgtgcgggaagctattaagcgcagactccggaccctgatcctcgcccctacgagagtcgtggcggccgagatggaggaagctctgaaaggccttcccatccgctatcagacaaccgccaccaagagcgagcatacagggcgggaaattgttgacctgatgtgccacgctacctttacaatgagactgctctcccctgtgcgcgtcccgaactacaatctgatcattatggatgaggcccatttcaccgaccccgcctctatcgctgcgcggggatacattagcacgagagtgggcatgggggaagccgctgccatctttatgacagccacccctcccggaacagctgatgccttccctcagtccaacgcgcccatccaggacgaggagcgcgacattccggaacggtcttggaatagcggcaacgagtggatcaccgattttgctgggaaaacggtgtggttcgtcccttccattaaggccggcaatgacatcgccaactgtcttcgcaaaaacggaaagaaggttattcaactgtctagaaaaacctttgatacagaatatcagaagaccaaactcaatgactgggatttcgtggtgacaaccgacatcagcgagatgggcgctaactttaaggccgatcgggtcattgaccccagacggtgcctgaaacccgtgatcctgacagatgggcctgagcgcgttatcctcgcgggacccatgcctgtgaccgccgcttccgccgctcagagacggggccgcgtcgggagaaatccgcagaaggaaaacgaccaatacattttcacgggacagccccttaataacgatgaggaccacgcccattggacagaagctaagatgctgctggacaatatcaacacccctgagggcattatccccgccctcttcgaacctgagcgggagaaaagcgcggccattgatggggaatatagactgaagggcgagtctcgcaaaacctttgtggaacttatgcggagaggagacctgcccgtttggctcgctcacaaggtggcctccgagggcatcaaatacacagatcgcaagtggtgcttcgacgggcagcggaataaccagatcctggaagagaatatggatgtcgagatttggaccaaagaaggagagaagaagaaactgagaccgcgctggctcgacgctcggacatatagcgatcctcttgccctgaaggaatttaaagacttcgccgctggcagaaagtctatcgcgctggatctcgtgacggagattgggcgcgtcccctcccacctggcccatagaacccggaacgctcttgacaatctggtgatgctccacacaagcgaacatggaggccgcgcctacagacacgccgttgaggagctgcctgaaaccatggagacactgctccttctgggcctgatgatcctcctgaccgggggagctatgctttttctgatttccggcaaagggatcggaaagacgtctatcggcctcatttgtgtgatcgccagctccgggatgctgtggatggcggaaattcccctgcaatggatcgccagcgctattgtgctcgagttctttatgatggtccttctgatccctgagcccgaaaagcagcggaccccgcaggataaccaactggcctatgttgtgattggaatcctcacactggctgccatcattgcggccaatgagatgggccttctggaaaccacaaaacgcgacctcggcatgtctaaggagcctggggtggtctcccccaccagctacctggatgtggacctgcaccccgcttctgcctggacgctctacgctgttgccacaaccgtgatcacacctatgcttagacataccattgaaaacagcaccgctaatgtctccctggccgcgatcgccaaccaggctgtggtcctgatgggactcgacaaaggctggccgatttctaagatggatctgggggtgccccttctggccctcggatgctatagccaggttaaccctctgacactgacggctgccgtgctccttctgatcacccactacgccatcattggccccgggctgcaggcgaaagctacacgggaggcccaaaagagaaccgctgccggaatcatgaagaatcctacagtcgacggcattatgaccatcgatctcgaccccgtgatttatgattccaaattcgagaagcagctgggccaggttatgcttctggtgctctgtgccgtccagctgctgctcatgcgcacgtcttgggctctttgcgaagccctgacactggcgaccgggcctatcaccacactctgggagggaagcccgggcaaattttggaacaccacaatcgccgtgtccatggctaatattttccgggggagctacctggccggagctggccttgccttttctatcatgaagtccgtggggacgggaaaaagaggcaccggcagccaaggggaaacactgggagagaagtggaagaaaaagctcaaccagctgtcccgcaaagagttcgacctgtataagaaatctggcattaccgaggttgatcggacagaggcgaaggaagggctcaaaagaggagagatcacccatcacgccgtcagccggggctccgctaaacttcagtggtttgtggaacgcaatatggtgattcccgaggggagagtcatcgacctgggatgtggccggggcgggtggtcttactattgcgccggactgaagaaagttacggaagtgcgcggctacaccaaagggggacctggccatgaggagcccgtgcctatgagcacatacgggtggaacattgtcaaactcatgtccggaaaggatgtgttctatctgcccccggaaaaatgtgacacccttctgtgcgatatcggcgagagctctccttcccccacagttgaagagagcagaaccatccgggtgctcaagatggtcgagccctggctgaagaataaccagttctgtattaaagtgctgaatccttacatgcccacagttatcgaacacctcgagcgccttcaaagaaagcacggcgggatgctggtgcggaaccctctgtctcgcaattccacccatgaaatgtattggattagcaacggaacgggcaatatcgtcgcttctgtgaacatggtgagcagactcctgcttaatcggtttacaatgacccacagacgcccgaccattgagaaagacgtcgatctgggggccggaacacggcatgttaacgctgaacccgagacgcctaacatggacgtgatcggcgagagaatcaagcgcattaaagaagaacacaattccacctggcactacgacgatgaaaacccctataagacatgggcctaccatgggtcttatgaggtgaaggcgaccggaagcgcctccagcatgatcaatggcgtcgtgaaactcctgacaaagccttgggacgttgtgcccatggtcacccagatggctatgacagataccacgccgttcggccagcaacgggtgtttaaagaaaaggttgacaccagaacacctcgctccatgcccgggacccggagagtgatgggaattacagccgagtggctgtggcgcaccctcggccggaacaaaaagcctagactgtgcacgcgcgaggagttcacaaagaaagtccggaccaatgctgccatgggggccgtgtttacagaggaaaaccagtgggattctgcgaaggctgccgttgaggacgaagatttctggatccttgtggacagagagcgcgagctgcacaaactcggaaagtgtggcagctgcgtctacaatatgatggggaaaagagaaaagaaactgggcgagtttggaaaggccaagggctcccgggctatttggtacatgtggcttggggcccgctatctggagttcgaggctctcggatttctgaacgaggatcattggttctctagagaaaatagctactccggcgtggagggggaaggactgcacaaactcggctatatcctgcgggacatctctaagattcccgggggcgccatgtacgcggatgacaccgccggatgggacacgagaatcaccgaggatgaccttcataacgaagagaaaattacacagcagatggatcctgagcaccggcaactggctagcgccatctttaagctcacctatcagaataaagtcgtgaaggttcagcgccccacaccgaccggcacagtgatggacattatctccagaaaggatcagcgggggagcggacaagtcggcacctacgggctgaacacgttcacaaatatggaagctcagcttatccgccagatggagggagaaggcgtgctgtctaaagccgacctcgagaaccctcatctgcccgaaaagaaaattacccagtggctggagaccaagggggtggagagactcaaacggatggcgatctccggcgatgactgcgttgtgaagcccattgatgaccgctttgccaatgctctgcttgccctgaacgatatgggaaaggtcagaaaagacatccctcaatggcagccgagcaagggctggcatgattggcaacaggtgcccttctgttctcaccatttccacgaactcattatgaaagacgggcggaagctggttgtgccttgccgcccccaagacgagcttatcggacgggctcggatttcccagggcgccgggtggagcctgcgcgaaacagcttgtctcggaaaagcctatgcgcagatgtggtctctgatgtactttcacagacgggatctgcgcctcgcctccaacgctatctgcagcgccgtccctgtgcattgggtccccacctccagaacaacgtggagcatccacgcccatcaccaatggatgaccacagaggacatgctgaccgtgtggaatcgggtttggattgaagataacccttggatggaggacaagacacccgtgaccacgtgggagaatgtcccgtaccttggcaagagagaagatcagtggtgtgggtctctgatcggcctcaccagccgcgctacatgggcccagaacattcctaccgcgatccagcaagtgcggtccctgattggaaatgaggagttccttgactatatgccctctatgaaaagatttcgcaaggaggaggaaagcgagggcgctatctggtga

SEQ ID NO: 20704 - RNA, 9873 nt, synthetic construct
  misc_feature 1..9873: note = derived and/or modified CDS sequence (opt5) from DENV-3__FJ373302__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgacaaaaaaggaggaacccgtcaacattgaggccgaacctccgttcggcgagtccaatatcgtgattgggatcggcgataacgctctgaaaatcaattggtataagaagggatctagcattggcaaaatgtttgaagccaccgctcggggggccagacgcatggcgatccttggagacacggcctgggatttcggctccgtggggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacaccgggtgtgtgatcaattggaaaggaaaggagctgaagtgcggcagcgggattttcgtcacaaacgaggtgcatacgtggaccgaacagtacaaatttcaagccgattcccccaagcggctggctacagccatcgctggcgcctgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtctgggaagtggaggactatggctttggcgtgttcacaaccaatatctggctcaaactgcgcgaagcctacacgcagctgtgtgaccaccggcttatgagcgccgctgtcaaggatgagagagccgttcacgcggacatggggtactggattgagtcccagaaaaagggatcttggaaactcgaaaaggctagcctgatcgaggtgaagacatgcacctggcctaaatcccataccctgtggtctaacggcgtgctcgaaagcgatatgattatccccaagtccctggccgggcctattagccagcacaattatcgccccggataccatacacaaaccgccggcccttggcaccttgggaaactggagctcgactttaactattgcgagggaacgacagtcgtgatcaccgaaaattgtggcacacggggcccctctctgagaaccacaaccgtttccgggaagctgatccacgagtggtgctgtcgcagctgcacgcttccgcctctccggtacatgggagaagatggctgttggtatgggatggagattagacccatctctgaaaaagaggagaacatggtgaagtccctggtcagcgctggatctggcaaggtggacaatttcaccatgggggttctgtgcctcgccattctgtttgaagaggtgatgcggggaaaattcggcaagaaacatatgatcgcgggcgtcttctttacattcgtgcttctgctcagcgggcagattacctggcgcgatatggctcacacactgatcatgattggatccaacgccagcgacagaatgggcatgggggttacctacctggcccttatcgctacgtttaagatccagcccttcctggccctcggatttttcctgcggaaactcacatctagagaaaatctgcttctgggcgtggggctcgctatggccaccacactgcaactgcctgaggatattgaacagatggcgaacggaatcgcccttggcctgatggctctcaagctgattacccagtttgagacctatcagctctggacagccctgatctcccttacgtgtagcaataccattttcacactgaccgtcgcttggcgcacagccaccctcatcctggccggcgtgtccctgcttccggtgtgccaatctagctccatgcggaagtctgactggctgcccatgacggtcgctgcgatgggggttcctcccctccctctgtttatcttcagcctcaaagatacactgaagagacgctcctggccccttaacgagggagtgatggccgtgggcctggtctctattctggctagctccctcctgagaaatgacgtgcctatggccgggccccttgttgccggaggcctgctcatcgcttgttacgtgattaccgggaccagcgccgatctgacagtcgaaaaagcggctgacgtgacctgggaggaagaggccgaacagacaggagtttctcataacctcatgatcacggtggacgatgacggcaccatgcggattaaggatgacgagacagagaacatcctgaccgtccttctgaaaacagccctgctcatcgtgtccggcatttttccgtacagcatccctgctaccctgcttgtctggcacacgtggcagaagcagacccgcagatctggggtgctgtgggatgttccctcccctcccgaaacacaaaaagccgagctcgaagagggagtgtatcggattaagcagcagggcatcttcgggaagacccaggtcggagtgggcgttcaaaaagagggggtgtttcatacaatgtggcacgtcacccgcggagcggtgctgacatacaatggcaagagactcgaaccgaactgggctagcgtgaaaaaggacctgatttcttatggcgggggatggcggctttccgcccagtggcagaaaggcgaggaagttcaagtcatcgccgtggagcctgggaagaatcccaagaacttccagacgatgcctggaaccttccagacaaccaccggcgaaattggggctatcgccctggattttaaacccggaacaagcggctcccccatcattaatcgcgagggcaaggtggtcgggctgtacggaaacggcgtggttacgaaaaatgggggatatgtgagcggcatcgctcagaccaacgccgagcctgacgggccgacacccgaactcgaggaagagatgttcaagaaaagaaatctgaccattatggatcttcaccctggctctggaaagacacggaagtacctgcccgcgatcgtccgcgaagccattaaaagacggctcagaaccctgatcctcgctcctacgcgcgtggttgccgctgagatggaggaagccctgaagggccttcccatccggtatcaaacaaccgccaccaaaagcgagcatacagggagagaaattgtggacctgatgtgccacgctacctttacaatgcgcctgctctcccctgtccgggtgccgaactacaatctgatcattatggatgaggcgcatttcaccgaccccgcctctatcgctgccagaggatacattagcacgcgcgttggcatgggggaagccgctgccatctttatgacagcgacccctcccggaacagctgatgccttccctcagtccaacgcccccatccaggacgaggagcgggacattccggaaagatcttggaatagcggcaacgagtggatcaccgattttgctgggaagacggtgtggttcgtcccttccattaaagccggcaatgacatcgcgaactgtcttcgcaagaacggaaagaaagtgattcagctgtctcggaagacctttgatacagaatatcaaaaaaccaagctcaatgactgggatttcgtggtcacaaccgacatcagcgagatgggcgccaactttaaagctgatagagttattgacccccggcgctgcctgaagcccgtgatcctgacagatgggcctgagagagtgatcctcgccggacccatgcctgtcaccgctgcctccgctgcccagcggcgcggcagagtggggcggaatccgcagaaggaaaacgaccagtacattttcacgggacaaccccttaataacgatgaggaccacgcgcattggacagaagccaaaatgctgctggacaatatcaacacccctgagggcattatccccgctctcttcgaacctgagagagagaagagcgccgctattgatggggaatatcgcctgaaaggcgagtctcggaagacctttgttgaacttatgagacgcggagacctgcccgtgtggctcgcccacaaagtcgcctccgagggcatcaagtacacagatcggaaatggtgcttcgacgggcagagaaataaccagatcctggaagagaatatggatgtggagatttggaccaaggaaggagagaagaaaaagctgcgcccgcggtggctcgacgctagaacatatagcgatcctcttgcgctgaaagaatttaaggacttcgccgctggccgcaaatctatcgccctggatctcgttacggagattgggagagtgccctcccacctggcccatcggacccgcaacgctcttgacaatctggtcatgctccacacaagcgaacatggaggcaaggcctacagacacgcggtggaggagctgcctgaaaccatggagacactgctccttctgggcctgatgatcctcctgaccgggggagccatgctttttctgatttccggcaaggggatcggaaaaacgtctatcggcctcatttgtgtcatcgctagctccgggatgctgtggatggccgaaattcccctgcagtggatcgctagcgccattgtgctcgagttctttatgatggttcttctgatccctgagcccgaaaagcaacggaccccgcaggataaccagctggcgtatgtggtgattggaatcctcacactggccgctatcattgccgctaatgagatgggccttctggaaaccacaaaacgcgacctcggcatgtctaaggagcctggggtcgtttcccccaccagctacctggatgtggacctgcaccccgcctctgcttggacgctctacgccgtggcgacaaccgtcatcacacctatgcttagacataccattgaaaacagcaccgccaatgtgtccctggctgccatcgctaaccaagccgttgtgctgatgggactcgacaaaggctggccgatttctaagatggatctgggggtcccccttctggccctcggatgctatagccaggtgaaccctctgacactgacggcggctgtcctccttctgatcacccactacgccatcattggccccgggctgcaggctaaggccacacgggaggcccagaaaagaaccgctgccggaatcatgaagaatcctacagtggacggcattatgaccatcgatctcgaccccgttatttatgattccaaattcgagaagcaactgggccaggtgatgcttctggtcctctgtgcggtgcagctgctgctcatgcgcacgtcttgggccctttgcgaagctctgacactggccaccgggcctatcaccacactctgggagggaagcccgggcaaattttggaacaccacaatcgctgtttccatggccaatattttccgggggagctacctggcgggagccggccttgctttttctatcatgaagtccgtggggacgggaaagagaggcaccggcagcaaaggggaaacactgggagagaagtggaaaaagaaactcaaccagctgtcccgcaaggaattcgacctgtataaaaagtctggcattaccgaggtcgatcggacagaggccaaggaagggctcaaaagaggagagatcacccatcacgctgtgagccggggctccgccaagcttcaatggtttgtggaacgcaatatggttattcccgaggggagagtcatcgacctgggatgtggccggggcgggtggtcttactattgcgctggactgaaaaaggtgacggaagtgcgcggctacaccaaagggggacctggccatgaggagcccgtccctatgagcacatacgggtggaacattgttaagctcatgtccggaaaggatgtgttctatctgcccccggaaaaatgtgacacccttctgtgcgatatcggcgagagctctccttcccccacagtggaagagagcagaaccatccgggtcctcaagatggtggagccctggctgaaaaataaccagttctgtattaaggttctgaatccttacatgcccacagtgatcgaacacctcgagcgccttcagagaaaacacggcgggatgctggtccggaaccctctgtctcgcaattccacccatgaaatgtattggattagcaacggaacgggcaatatcgtggcctctgttaacatggtgagcagactcctgcttaatcggtttacaatgacccacagacgcccgaccattgagaaggacgtcgatctgggggcgggaacacggcatgtgaacgccgaacccgagacgcctaacatggacgtgatcggcgagagaatcaagcgcattaaagaagagcacaattccacctggcactacgacgatgaaaacccctataagacatgggcttaccatgggtcttatgaggtcaaagccaccggaagcgcttccagcatgatcaatggcgttgtgaagctcctgacaaaaccttgggacgtggtccccatggtgacccagatggccatgacagataccacgccgttcggccaacagcgggtttttaaggaaaaggtggacaccagaacacctcgctccatgcccgggacccggagagtcatgggaattacagccgagtggctgtggcgcaccctcggccggaacaaaaagcctagactgtgcacgcgcgaggaattcacaaaaaaggtgcggaccaatgcggctatgggggccgtttttacagaggaaaaccagtgggattctgccaaagctgccgtggaggacgaagatttctggaagcttgtcgacagagagcgcgagctgcacaaactcggaaagtgtggcagctgcgtgtacaatatgatggggaagagagaaaaaaagctgggcgagtttggaaaagctaagggctcccgggccatctggtacatgtggcttggggcgcgctatctggaattcgaggccctcggatttctgaacgaggatcattggttctctagagaaaatagctactccggcgttgagggggaaggactgcacaaactcggctatattctgcgggacatctctaagatccccgggggcgctatgtacgccgatgacaccgctggatgggacacgagaattaccgaggatgaccttcataacgaagagaagatcacacaacagatggatcctgagcaccggcagctggccaatgcgatttttaaactcacctatcagaacaaggtggtcaaagtgcaacgccccacaccgaccggcacagtcatggacatcattagcagaaaggatcagcgggggtccggacaggtgggcacctacgggctgaatacgttcacaaacatggaagcccagcttatccgccaaatggagggagaaggcgttctgagcaaagctgacctcgagaatcctcacctgtctgaaaagaagatcacccagtggctggagaccaaaggggtggagagactcaagcggatggccatttccggcgatgactgcgtcgtgaaacccatcgatgaccgctttgctaacgccctgcttgctctgaacgatatgggaaaggtgagaaaagacattccccagtggcagcctagcaagggctggcatgattggcaacaggttccgttctgttctcaccatttccacgaactcatcatgaaggacgggcggaaactggtggtcccctgccgccctcaggacgagcttattggaagagcccggatctcccagggcgcggggtggagcctgcgcgaaacagcctgtctcggaaaggcttatgcccaaatgtggtctctgatgtactttcacagacgggatctgcgcctcgcctccaatgctatttgcagcgccgtgcccgttcattgggtgcctacctccagaacaacgtggagcatccacgcgcatcaccagtggatgaccacagaggacatgctgaccgtctggaaccgggtgtggatcgaagataatccctggatggaggacaaaacacctgtcaccacgtgggagaacgtgccctaccttggcaagagagaagatcagtggtgtgggtctctgattggcctcaccagccgcgctacatgggcccaaaatatcccgaccgccattcagcaggttcggtccctgatcggaaacgaggaattccttgactatatgccttctatgaaaagatttcgcaaggaggaggaaagcgagggcgctatttggtga

SEQ ID NO: 20705 - RNA, 9873 nt, synthetic construct
  misc_feature 1..9873: note = derived and/or modified CDS sequence (opt5) from DENV-3__FJ182007__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgacaaaaaaggaggaacccgtcaacattgaggccgaacctccgttcggcgagtccaatatcgtgattgggaccggcgataacgctctgaaaatcaattggtataagaagggatctagcatcggcaaaatgtttgaagccacggctcggggggccagacgcatggcgattcttggagacacagcctgggatttcggctccgtggggggagttctcaacagcctgggcaagatggtccaccagatctttgggtctgcttacaccgccctgttctccggcgtgagctgggtgatgaaaattggaatcggcgtcctcctgacctggattgggcttaattctaagaacacaagcatgtccttttcttgcatcgctattggaatcatcaccctgtatctcggcgccgtggttcaggcggacacagggtgtgtgattaattggaaaggaaaggagctgaagtgcggcagcgggatcttcgtcacgaacgaggtgcatacctggacagaacagtacaaatttcaagccgattcccccaagcggctggctaccgccattgctggcgcctgggagaatggagtttgtggcatcagaagcacaacccgcatggaaaaccttctctggaaacagattgccaatgagctgaactatatcctgtgggaaaataacatcaagctcacggtggtcgtgggggacattatcggagttctggagcagggcaaacggacccttacacctcagcccatggagctgaagtactcttggaaaacctgggggaaggctaagattgtgacagcggaaacccaaaactccagcttcatcattgatggacctaatacacccgagtgcccgtctgcctccagagcttggaacgtctgggaagtggaggactatggctttggcgtgttcaccacgaatatctggctcaaactgcgcgaagtctacacacagctgtgtgaccaccggcttatgagcgccgccgttaaggatgagagagctgtgcacgccgacatggggtactggatcgagtcccagaaaaacggatcttggaagctcgaaaaagcgagcctgattgaggtgaagacctgcacctggcctaagtcccatacactgtggtctaatggcgtcctcgaaagcgatatgatcattcccaaatccctggctgggcctatcagccagcacaactatcgccccggataccatacccaaacggccggcccttggcaccttgggaagctggagctcgactttaattattgcgagggaacaaccgtggttattacagaagattgtggcacccggggcccctctctgagaacaaccacggtgtccgggaaactgatccacgagtggtgctgtcgcagctgcacccttccgcctctccggtacatgggagaagacggctgttggtatgggatggagatcagacccatttctgaaaaggaggagaacatggtcaaatccctggtgagcgccggatctggcaaggttgataatttcacaatgggggtgctgtgcctcgctatcctgtttgaagaggtcatgcggggaaagttcggcaaaaagcatatgattgccggcgtgttctttaccttcgttcttctgctcagcgggcagatcacatggcgcgacatggcgcacaccctgattatgatcggatccaacgctagcgatagaatgggcatgggggtgacgtacctggcccttattgccacatttaaaatccagcccttcctggctctcggatttttcctgcggaagctcacctctagagaaaatctgcttctgggcgtcgggctcgccatggctacaaccctgcaactgcctgaggacatcgaacagatggccaacggaattgcgcttggcctgatggccctcaaactgatcacccagtttgagacatatcagctctggacggctctgatttcccttacctgtagcaatacaatcttcaccctgacagtggcctggcgcaccgctacgctcattctggccggcgtgtccctgcttccggtctgccaatctagctccatgcggaagtctgattggctgcccatgacagttgccgctatgggggtgcctcccctccctctgtttatcttcagcctcaaggacaccctgaaaagacgctcctggccccttaacgagggagtgatggcggtcggcctggtgtctatcctggccagctccctcctgagaaatgatgttcctatggctgggccccttgtggccggaggcctgctcattgcctgttacgtcatcaccgggacaagcgctgacctgaccgtggaaaaggccgcggacgttacatgggaggaagaggctgaacagacgggagtgtctcataacctcatgattaccgtcgatgacgatggcacaatgcggatcaaagacgatgagaccgagaacattctgacagtgcttctgaagaccgccctgctcatcgtctccggcatctttccgtacagcattcctgccacgctgcttgtgtggcacacctggcagaaacagacacgcagatctggggttctgtgggacgtgccctcccctcccgaaacccaaaaggctgagctcgaagagggagtctatcggatcaaacagcagggcattttcgggaagacacaggtgggagttggcgtgcaaaaggagggggtctttcataccatgtggcacgtgacacgcggagccgtgctgacgtacaatggcaaaagactcgaaccgaactgggcgagcgttaagaaagatctgatctcttatggcgggggatggcggctttccgctcagtggcagaagggcgaggaagtccaagtgattgccgtggagcctgggaaaaatcccaagaacttccagaccatgcctggaacattccagaccaccacaggcgaaatcggggccattgctctggactttaagcccggaacgagcggctcccccatcatcaatcgcgagggcaaagtcgtggggctgtacggaaacggcgttgtgaccaagaatgggggatatgtcagcggcattgcccagacaaacgctgagcctgatgggccgacccccgaactcgaggaagagatgttcaaaaagagaaatctgacaatcatggaccttcaccctggctctggaaaaacccggaagtacctgcccgccattgtgcgcgaagcgatcaagagacggctcagaacgctgattctcgcccctacacgcgttgtggctgccgagatggaggaagctctgaaaggccttcccatccggtatcaaaccaccgccacaaagagcgagcataccgggagagaaatcgtcgatctgatgtgccacgccacatttaccatgcgcctgctctcccctgtgcgggttccgaactacaatctgattatcatggacgaggctcatttcacggatcccgcgtctattgccgctagaggatacatcagcacacgcgtgggcatgggggaagccgccgctatttttatgaccgccacacctcccggaaccgcggacgctttccctcagtccaacgcccccatccaggacgaggagcgggatatcccggaaagatcttggaatagcggcaacgagtggattacggactttgccgggaaaaccgtctggttcgtgccttccatcaaggctggcaatgatattgccaactgtcttcgcaaaaacggaaagaaggtgatccagctgtctcggaaaacatttgacaccgaatatcaaaagacaaaactcaatgattgggacttcgtcgttaccacagatattagcgagatgggcgcgaactttaaggccgacagagtgatcgatccccggcgctgcctgaaacccgtgattctgaccgacgggcctgagagagtcatcctcgctggacccatgcctgtgacggccgcttccgccgctcagcggcgcggcagagttgggcggaatccgcagaaggaaaacgatcagtacatcttcacaggacaaccccttaataacgacgaggaccacgcccattggaccgaagcgaagatgctgctggataatattaacacccctgagggcatcattcccgccctcttcgaacctgagagagagaaaagcgctgccatcgacggggaatatcgcctgaagggcgagtctcggaaaacatttgtggaacttatgagacgcggagatctgcccgtctggctcgctcacaaggtggcctccgagggcattaaatacaccgaccggaagtggtgcttcgatgggcagagaaataaccagatcctggaagagaatatggacgttgagatctggacaaaagaaggagagaagaagaaactgcgcccgcggtggctcgatgccagaacgtatagcgaccctcttgctctgaaggaatttaaagatttcgcggccggccgcaagtctattgctctggacctcgtgaccgagatcgggagagtcccctcccacctggcccatcggacacgcaacgcccttgataatctggtgatgctccacaccagcgaacatggaggcaaagcttacagacacgccgtcgaggagctgcctgaaacaatggagaccctgctccttctgggcctgatgattctcctgacggggggagcgatgctttttctgatctccggcaaggggattggaaagacctctatcggcctcatctgtgtgattgccagctccgggatgctgtggatcgctgaaattcccctgcagtggatcgccagcgctattgttctcgagttctttatgatggtgcttctgatccctgagcccgaaaaacaacggacaccgcaggacaaccagctggcctatgtggtcattggaatcctcaccctggcggccatcattgctgccaatgagatgggccttctggaaacaaccaagcgcgatctcggcatgtctaaagagcctggggttgtgtcccccacgagctacctggacgtggacctgcaccccgcttctgcctggacactctacgctgtcgccaccacagtgatcacccctatgcttagacataccattgaaaacagcacagcgaatgtttccctggccgctatcgccaaccaagctgtggtcctgatgggactcgataagggctggccgatttctaaaatggacctgggggtgccccttctggccctcggatgctatagccaggtcaaccctctgacgctgaccgccgcggtgctccttctgatcacacactacgctatcattggccccgggctgcaggccaaggctacccgggaggcccagaagagaacagccgctggaatcatgaaaaatcctaccgttgatggcattatgacgatcgacctcgatcccgtgatttatgactccaagttcgagaaacaactgggccaggtcatgcttctggtgctctgtgccgttcagctgctgctcatgcgcacatcttgggcgctttgcgaagccctgaccctggctaccgggcctatcacaaccctctgggagggaagcccgggcaagttttggaacacaacgatcgccgtgtccatggctaatattttccgggggagctacctggccggagcgggccttgccttttctatcatgaaatccgtcgggaccggaaagagaggcacaggcagccagggggaaaccctgggagagaagtggaaacgcaagctcaaccaactgtcccggaaagaattcgatctgtataagaaatctggcattacagaggtggacagaaccgaggctaaggaagggctcaaacggggagagatcacgcatcacgccgtgagccgcggctccgctaagcttcagtggtttgttgaaagaaatatggtcattcccgaggggcgggtgatcgatctgggatgtggccgcggcgggtggtcttactattgcgccggactgaagaaagtgaccgaagtcagaggctacacaaaggggggacctggccatgaggagcccgttcctatgagcacctacgggtggaacattgtgaaactcatgtccggaaaggacgtgttctatctgcccccggaaaaatgtgatacacttctgtgcgacatcggcgagagctctccttcccccaccgtcgaagagagccggacaatccgcgtgctcaagatggttgagccctggctgaagaataaccagttctgtattaaagtgctgaatccttacatgcccaccgtcatcgaacacctcgagagacttcagcggaagcacggcgggatgctggtgcgcaaccctctgtctagaaattccacgcatgaaatgtattggattagcaacggaacaggcaatatcgttgcttctgtgaacatggtcagccggctcctgcttaatagatttaccatgacccaccgccggccgacaattgagaaagatgtggacctgggggccggaacgagacatgtgaacgcggaacccgagacccctaacatggacgtcatcggcgagcgcatcaagcggattaaagaagagcacaattccacatggcactacgatgacgaaaacccctataagacctgggcctaccatgggtcttatgaggttaaggctacaggaagcgcctccagcatgatcaatggcgtggtgaaactcctgaccaagccttgggatgtcgtgcccatggttacacaaatggctatgaccgacacgaccccgttcggccagcagagagtgtttaaagaaaaggtcgatacacgcacccctcggtccatgcccgggacaagacgcgtgatgggaattaccgccgagtggctgtggcggacgctcggcagaaacaaaaagcctcgcctgtgcacacgggaggaattcaccaagaaagttagaacaaatgccgcgatgggggctgtgtttaccgaggaaaaccaatgggactctgccaaggccgctgtcgaggatgaagacttctggaaacttgtggatcgcgagagagagctgcacaagctcggaaaatgtggcagctgcgtttacaatatgatggggaagcgggaaaaaaagctgggcgagtttggaaaggccaaaggctcccgcgctatctggtacatgtggcttggggccagatatctggaattcgaggcgctcggatttctgaacgaggaccattggttctctcgggaaaatagctactccggcgtggagggggaaggactgcacaagctcggctatattctgagagatatctctaaaatccccgggggcgccatgtacgctgacgacacggccggatgggatacccggattacagaggacgatcttcataacgaagagaagatcacccagcagatggaccctgagcaccgccagctggctaatgccatttttaaactcacatatcaaaacaaggtcgtgaaggtccagagacccaccccgacaggcaccgtgatggatatcattagccggaaagaccagcgcgggtccggacaggttggcacgtacgggctgaatacattcaccaacatggaagcgcaacttatcagacagatggagggagaaggcgtgctgagcaaggccgatctcgagaatcctcacctgtctgaaaaaaagatcacccagtggctggagacaaaaggggtcgagcggctcaagcgcatggctatttccggcgacgattgcgtggtgaagcccatcgacgatagatttgccaacgctctgcttgccctgaacgacatgggaaaagttcggaaggatattccccagtggcaacctagcaaaggctggcatgactggcagcaggtgccgttctgttctcaccatttccacgaactcatcatgaaggacgggcgcaaactggtcgtgccctgcagacctcaggatgagcttattggacgggctcgcatctcccaaggcgccgggtggagcctgagagaaaccgcgtgtctcggaaaggcctatgctcagatgtggtctctgatgtactttcaccggcgcgacctgagactcgcctccaatgccatttgcagcgctgttcccgtgcattgggtccctacatcccggacgacctggagcatccacgcccatcaccagtggatgacaaccgaggatatgctgacagtgtggaacagagtctggatcgaagacaatccctggatggaggataagacccctgtgacgacctgggagaacgttccctaccttggcaaacgcgaagaccaatggtgtgggtctctgattggcctcacaagccgggcgacctgggctcagaatatcccgacagccattcagcaggtgagatccctgatcggaaacgaggaattccttgattatatgccttctatgaagcgctttcggaaagaggaggaaagcgagggcgccatttggtga

SEQ ID NO: 20706 - RNA, 9873 nt, synthetic construct
  misc_feature 1..9873: note = derived and/or modified CDS sequence (opt5) from DENV-3__FJ182008__SS-prME
  source 1..9873: mol_type = other RNA
accagcctgtgcatcatgatgattctccccgccgctctggccttccaccttacatccagagacggcgagcctcggatgatcgtggggaagaacgaacgcggaaaatctctgctctttaagacggcgagcggcattaatatgtgtaccctgatcgctatggatcttggggagatgtgcgacgatacagtcacctacaaatgtccgcatattacagaagttgagcccgaagacatcgattgctggtgtaacctgacctccacatgggtgacctatggaacgtgcaatcaggccggcgagcacagacgggacaagcgctctgtggccctcgctcctcatgtcgggatgggactggataccagaacacaaacctggatgagcgccgagggcgcttggcggcaggtggaaaaagttgagacatgggccctgcgccaccccggcttcaccatcctcgcgctgtttcttgcccattacattgggacgtccctgacacagaaggtggtcatcttcattctcctgatgcttgtgaccccttctatgacaatgagatgtgttggagtgggcaaccgggactttgtcgaagggctgagcggagctacctgggtggatgtggtcctcgagcacggcgggtgcgttaccacaatggccaagaataaacccacgctggacatcgagctgcagaagaccgaagctacacaactcgccaccctgcgcaaactttgtattgagggaaagatcacaaacattaccacggattccagatgccctacacagggcgaagcggtgctgccggaggaacaggaccagaattatgtgtgtaaacacacctacgtcgatcggggctgggggaacggatgcggcctcttcgggaagggaagcctggtgacctgcgccaagtttcaatgtcttgagcccatcgagggcaaagttgtgcagtatgaaaatctgaagtacacagtcatcattaccgtgcatacaggggaccagcaccaggttggaaacgagacgcaaggcgtgaccgctgaaatcacacctcaggcctctaccacagaggctattctccccgaatatggcaccctggggctggagtgctcccctcgcacgggactcgacttcaatgagatgatcctgcttaccatgaaaaacaaggcctggatggtccatagacagtggtttttcgatctgcccctcccgtggacaagcggcgccaccacagaaacccctacgtggaatcggaaagagctgcttgtgacatttaagaacgctcacgcgaaaaagcaagaagtcgtggttctggggtctcaggagggagccatgcacaccgctctcacaggcgccaccgaaattcagaattccgggggcaccagcatcttcgccggacatctgaagtgtcgcctgaaaatggacaagctcgagctgaaaggcatgtcttacgctatgtgcacaaacacgtttgtgcttaagaaagaggtctccgaaacccagcacgggacaatcctgattaaggtggagtacaagggagaagatgccccctgtaaaatccctttcagcaccgaggacggccaagggaaggcgcataacggaagactcattacagctaatcccgttgtgaccaaaaaggaggaacccgtcaacatcgaggccgaacctccgttcggcgagtccaatattgtgatcgggatcggcgataacgccctgaaaattaattggtataagaagggatctagcatcggcaaaatgtttgaagctacggcccggggggctagacgcatggccattctgggagacacagcgtgggatttcggctccgtggggggagttcttaacagcctcggcaagatggtccaccagatctttgggtctgcctacaccgctctgttctccggcgtgagctgggtgatgaaaattggaatcggcgtcctgctcacctggattgggctgaattctaagaacacaagcatgtccttttcttgcatcgccatcggagtgattaccctttatctgggcgctgttgtgcaggccgacatggggtgtgtcatcaattggaaaggaaaggagctcaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaacctgctttggaaacagatcgccaatgagctcaactatatcctgtgggaaaataacattaagctgaccgtcgtggttggggacatcattggagtgctcgagcagggcaaacggacgctgacccctcagcccatggagcttaagtactcttggaaaacatgggggaaggccaagatcgtcaccgctgaaacacaaaactccagcttcattatcgatggacctaatacccccgagtgcccgtctgcgtccagagcctggaacgtgtgggaagtggaggactatggctttggcgtcttcacaaccaatatctggctgaaactccgcgaagtttacacgcagctgtgtgaccaccggctgatgagcgctgccgtgaaggatgagagagccgtgcacgctgacatggggtactggattgagtcccagaaaaacggatcttggaagcttgaaaaagccagcctcatcgaggtcaagacatgcacctggcctaagtcccataccctgtggtctaatggcgtgctggaaagcgatatgattatccccaaatccctcgcggggcctattagccagcacaactatcgccccggataccatacacaaaccgctggcccttggcacctggggaagcttgagctggactttaattattgcgagggaacgacagttgtgatcaccgaaaactgtggcacacggggcccctctctcagaaccacaaccgtctccgggaaactgatccacgagtggtgctgtcgcagctgcacgctgccgcctcttcggtacatgggagaagatggctgttggtatgggatggagattagacccatctctgaaaaggaggagaatatggtgaaatccctcgttagcgccggatctggcaaggtggacaacttcaccatgggggtcctgtgcctggccattctctttgaagaggtgatgcggggaaagttcggcaaaaagcatatgatcgctggcgttttctttacattcgtgctgcttctgagcgggcagattacctggcgcgatatggcccacacactcatcatgattggatccaatgcgagcgacaaaatgggcatgggggtcacctacctggctctgatcgccacgtttaagatccagcccttccttgccctgggatttttcctcagaaaactgacatctcgggaaaacctcctgcttggcgtggggctggctatggccaccacactccaactgcctgaggatattgaacagatggctaatggaatcgccctgggccttatggcgctgaagctcattacccagtttgagacctatcagctgtggacagccctcatctccctgacgtgtagcaacaccatgttcacacttaccgtggcttggagaacagccaccctgattctcgctggcgtctccctgctgccggtttgccaatctagctccatgcgcaagacggactggcttcccatggccgtggccgctatgggggtgcctcccctgcctctctttatcttctctctgaaagatacactcaagcggagaagctggcccctgaatgagggagtcatggcggtgggccttgtttccatcctggcctctagcctgctccgcaacgacgtgcctatggctgggcccctggtcgccggaggccttctgattgcctgttacgtgatcaccgggacctccgctgatctcacagttgaaaaagccgcggacattacctgggaggaagaggctgaacagacaggagtgagccataacctgatgatcacggtcgacgatgacggcaccatgagaattaaggatgacgagacagagaatatcctcaccgtgctgcttaaaacagccctgctgatcatttctggcgtctttccgtactccatccctgccaccctcctggtgtggcacacgtggcagaagcagacccaacggagcggggttctttgggatgtgccctctcctcccgaaacacagaaagctgagctggaagagggagtctatcgcattaagcagcagggcatcttcgggaagacccaagtgggagttggcgtgcagaaagagggggtctttcatacaatgtggcacgtgaccagaggagccgtgctcacatacaacggcaagcggctggaaccgaattgggcgtccgttaaaaaggacctcattagctatggcgggggatggcgcctgtctgctcagtggcaaaaaggcgaggaagtccaggtgatcgccgtggagcctgggaagaaccccaagaatttccagacgatgcctggaaccttccagacaaccaccggcgaaattggggccatcgctcttgattttaaacccggaacatccggcagccccatcattaacagagagggcaaggtcgtggggctgtacggaaatggcgttgtgacgaaaaacgggggatatgtctccggcatcgcccaaaccaatgctgagcctgacgggccgacacccgaactggaggaagagatgttcaagaaacggaacctcaccattatggatctgcaccctggcagcggaaagacacgcaagtaccttcccgccatcgtgagagaagcgattaaacggcgcctgagaaccctcatcctggcccctacgcgggttgtggctgccgagatggaggaagctctcaagggcctgcccatcagatatcagacaaccgccaccaaatctgagcatacagggcgcgaaattgtcgaccttatgtgccacgccacctttacaatgcggctgctgagccctgtgagagttccgaattacaacctcatcattatggatgaggctcatttcaccgaccccgcgtccatcgccgctcgcggatacatttctacgcgggtgggcatgggggaagccgccgctatctttatgacagccacccctcccggaacagcggatgctttccctcagagcaatgcccccatccaggacgaggagagagacattccggaacgctcctggaactctggcaatgagtggatcaccgattttgccgggaagacggtctggttcgtgcctagcattaaagctggcaacgacatcgccaactgtctgcggaagaatggaaagaaagtgattcaactttccagaaagacctttgatacagaatatcagaaaaccaagctgaacgactgggatttcgtcgttacaaccgacatctctgagatgggcgcgaattttaaagccgatcgcgtgattgacccccggagatgcctcaagcccgtgatcctgacagatgggcctgagcgggtcatcctggctggacccatgcctgtgaccgccgctagcgccgctcagcgcagaggccgggttgggcgcaacccgcagaaggaaaatgaccaatacattttcacgggacagcccctcaacaatgatgaggaccacgcccattggacagaagcgaaaatgcttctggacaacatcaatacccctgagggcattatccccgccctgttcgaacctgagagagagaagtccgctgccattgatggggaatatcggctcaaaggcgagagcagaaagacctttgtggaactgatgcgccggggagaccttcccgtctggctggctcacaaagtggcctctgagggcatcaagtacacagatagaaaatggtgcttcgacgggcagcgcaacaatcagatcctcgaagagaacatggatgttgagatttggaccaaggaaggagagaagaaaaagctgcggccgagatggctggacgcccgcacatattccgatcctctcgctcttaaagaatttaaggacttcgcggccggccggaaaagcatcgctctggatctggtgacggagattgggagagtcccctctcacctcgcccatcgcaccagaaatgccctggacaaccttgtgatgctgcacacatccgaacatggaggccgggcttaccgccacgccgtcgaggagctccctgaaaccatggagacactgctgctccttggcctgatgatcctgctcaccgggggagcgatgctgtttcttattagcggcaaggggatcggaaagacgtccatcggcctgatttgtgtgatcgcctctagcgggatgctctggatggctgaaattcccctgcaatggatcgcctccgctattgttctggagttctttatgatggtgctccttatccctgagcccgaaaaacagagaaccccgcaggataatcaactggcctatgtggtcattggaatcctgacactcgcggccatcattgctgccaacgagatgggcctgcttgaaaccacaaagcgggacctgggcatgagcaaagagcctggggttgtgtctcccacctcctacctcgatgtggacctgcaccccgctagcgcctggacgctgtacgctgtcgccacaaccgtgatcacacctatgctccgccataccattgaaaattctaccgcgaacgttagccttgccgctatcgccaaccaggctgtggtcctgatgggactggacaagggctggccgatttccaaaatggatctcggggtgcccctgcttgccctgggatgctattctcaggtcaatcctctcacactgacggccgcggtgctgctccttatcacccactacgctatcattggccccgggctgcaggccaaggctacaagagaggcccaaaagcggaccgccgctggaatcatgaaaaaccctacagttgacggcattatgaccatcgatctggaccccgtgatttatgatagcaagttcgagaaacagctcggccaggtcatgctgcttgtgctgtgtgccgttcagctcctgctgatgagaacgtcctgggcgctctgcgaagcccttacactggctaccgggcctatcaccacactgtgggagggatctccgggcaagttttggaataccacaatcgccgtgagcatggctaacattttccgcgggtcctacctcgccggagcgggcctggcctttagcatcatgaaatctgtcgggacgggaaagcggggcaccggctcccaaggggaaacacttggagagaagtggaaaaagaaactgaatcagctcagcagaaaggaattcgacctgtataaaaagtccggcattaccgaggtggatcgcacagaggctaaagaagggctgaagcggggagagaccacgcatcacgccgtgtctagaggcaccgctaagctccagtggtttgttgaacggaacatggtcatccccgaggggcgcgtgattgaccttggatgtggcagaggcgggtggagctactattgcgccggactgaaaaaggtgacagaagtccggggctacaccaaagggggacctggccatgaggagcccgttcctatgtccacatacgggtggaatatcgtgaagctgatgtctggaaaagatgtgttctatctccccccggaaaagtgtgacaccctgctttgcgatattggcgagagctcccctagccccacagtcgaagagtctcgcaccatcagagtgctgaagatggttgagccctggctcaaaaacaatcagttctgtatcaaggtgctgaacccttacatgcccacggtcattgaacacctggagcggctccaacgcaaacacggcgggatgcttgtgagaaatcctctgtcccggaacagcacacatgaaatgtattggatctctaatggaaccggcaacattgttgcttccgtgaatatggtcagccgcctgctcctgaacagatttaccatgacacaccggagaccgacgatcgagaaggacgtggatcttggggccggaacccgccatgtgaacgcggaacccgagacacctaatatggacgtcattggcgagcggatcaaaagaatcaaggaagagcacaactctacctggcactacgacgatgaaaatccctataagacatgggcctaccatgggagctatgaggttaaagctaccggatccgcctctagcatgattaacggcgtggtgaagctgctcacaaaaccttgggacgtcgtgcccatggttacccagatggctatgacggataccacaccgttcggccagcaacgcgtgtttaaggaaaaagtcgacacccggacacctagatccatgcccgggacccgccgggtgatgggaatcacggccgagtggctgtggagaacactgggccgcaataagaagcctcggctctgcaccagagaggaattcacaaaaaaggttcgcaccaacgccgcgatgggggctgtgtttacggaggaaaatcagtgggatagcgccaaagccgctgtcgaggacgaagatttctggaagctggtggaccgggagagagagcttcacaaactgggaaagtgtggctcctgcgtttacaacatgatggggaaacgcgaaaagaagctcggcgagtttggaaaagccaagggctctagagctatttggtacatgtggctgggggcccggtatcttgaattcgaggcgctgggatttctcaatgaggatcattggttcagccgcgaaaactcctactctggcgtggagggggaaggactgcacaaactgggctatatcctcagagacattagcaagatccccgggggcgccatgtacgctgatgacaccgccggatgggacacacggatcaccgaggatgacctgcataatgaagagaaaattacacagcagatggatcctgagcacagacaacttgctaacgccatctttaagctgacctatcagaataaggtcgtgaaagtccagcggcccacaccgaccggcacggtgatggacattatctcccgcaaggatcagagagggtctggacaagttggcacatacgggctcaacaccttcaccaatatggaagcgcagctgattcggcagatggagggagaaggcgtgcttagcaaagccgacctggagaaccctcacctccccgaaaagaaaatcacacagtggctggagaccaagggggtcgagcgcctgagacggatggctatctccggcgatgactgcgtggtgaagcccattgatgaccgctttgccaacgctctcctggcccttaatgatatgggaaaagttagaaaggacatccctcaatggcagccgagcaaaggctggcatgattggcagcaggtgcccttctgttctcaccatttccacgaactgattatgaaggacgggcggaaactcgtcgtgccttgccgcccccaagacgagctgatcggaagagctcggatttcccagggcgccgggtggagccttcgcgaaacagcgtgtctgggaaaggcctatgctcagatgtggtctctcatgtactttcacagacgggatctgcgcctggcctccaacgccatctgcagcgctgttcctgtgcattgggtccccacgtctagaaccacatggtccattcacgcccatcaccaatggatgaccacagaggacatgctcaccgtgtggaatcgggtctggatcgaagataacccttggatggaggacaagacgcccgtgaccacatgggagaatgttccgtacctgggcaaaagagaagatcagtggtgtgggagccttatcggcctgacctcccgcgcgacatgggctcagaacattcctaccgccatccagcaagtgcggagcctcattggaaatgaggaattcctggactatatgccctctatgaagagatttcgcaaagaggaggaaagcgagggcgccatctggtga

SEQ ID NO: 20707 - RNA, 9873 nt, synthetic construct
  misc_feature 1..9873: note = derived and/or modified CDS sequence (opt5) from DENV-3__FJ182010__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcgtgctgcttatgctggttacaccttctatgaccatgagatgtgtgggagtcggcaaccgggactttgtggaagggctcagcggagccacatgggtggatgtcgttctggagcacggcgggtgcgtgaccaccatggctaagaataaacccacactggacatcgagctccagaagacggaagccacccaactggcgacacttcgcaaactgtgtattgagggaaagatcaccaacattacaaccgattccagatgccctacgcagggcgaagccgtgctcccggaggaacaggaccagaattatgtctgtaaacacacatacgtggatcggggctgggggaacggatgcggcctgttcgggaagggaagccttgttacctgcgctaagtttcaatgtctggagcccatcgagggcaaagtggtccagtatgaaaatctcaagtacaccgtgattatcacagttcataccggggaccagcaccaggtgggaaacgagacacaaggcgtcacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggttgtgctcgggtctcaggagggagctatgcacacagccctgaccggcgccacagaaattcagaattccgggggcaccagcatcttcgctggacatctgaagtgtcgcctcaaaatggacaagctggagcttaaaggcatgtcttacgccatgtgcaccaacacatttgtcctgaagaaagaggtgtccgaaacgcagcacgggaccattctcatcaaggttgagtacaagggagaagatgcgccctgtaaaatccctttcagcacagaggacggccaagggaaggctcataacggaagactgattaccgccaatcccgtggtcacaaaaaaggaggaacccgtgaacatcgaggccgaacctccgttcggcgagtccaatattgtgatcgggattggcgataacgctctgaaaatcaattggtataagaagggatctagcatcggcaaaatgtttgaagccaccgctcggggggccagacgcatggcgattcttggagacacggcctgggatttcggctccgttgggggagtcctcaacagcctgggcaagatggtgcaccagatctttgggtctgcttacacagccctgttctccggcgtgagctgggtcatgaaaattggaatcggcgtgctcctgacctggattgggcttaattctaagaacaccagcatgtccttttcttgcatcgctattggaatcatcacactgtatctcggcgccgttgtgcaggcggacaccgggtgtgtcattaattggaaaggaaaggagctgaagtgcggcagcgggatcttcgtgacaaacgaggttcatacgtggaccgaacagtacaaatttcaagccgattcccccaagcggctggctacagccattgctggcgcctgggagaatggagtgtgtggcatcagaagcaccacacgcatggaaaaccttctctggaaacaggtcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtgtgggaagtcgaggactatggctttggcgttttcacaaccaatatttggctcaaactgcgcgaagtgtacacgcagctgtgtgaccaccggcttatgagcgccgccgtgaaggatgagagagctgtccacgccgacatggggtactggatcgagtcccagaaaaacggatcttggaagctcgaaaaagcgagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatctctgaaaaggaggagaatatggttaaatccctggtgagcgccggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcgcacacactgatcatgattggatccaatgctagcgacagaatgggcatgggggtgacctacctggcccttatcgccacgtttaaaattcagcccttcctggctctcggatttttcctgcggaagctcacatctagagaaaacctgcttctgggcgtggggctcgccatggctaccacactgcaactgcctgaggatatcgaacagatggccaatggaatcgcgcttggcctgatggccctcaaactgattacccagtttgagacctatcagctctggacagctctgatctcccttacgtgtagcaacaccattttcacactgaccgtcgcctggcgcacagctaccctcatcctggccggcgtttccctgcttccggtgtgccaatctagctccatgcggaagtctgactggctgcccatgacggtggccgctatgggggtccctcccctccctctgtttattttcagcctcaaggatacactgaaaagacgctcctggccccttaatgagggagtgatggcggttggcctggtgtctatcctggccagctccctcctgagaaacgacgtccctatggctgggccccttgtggccggaggcctgctcatcgcctgttacgttattaccgggaccagcgctgatctgacagtggaaaaggccgcggacgtcacctgggaggaagaggctgaacagacaggagtgtctcataacctcatgatcacggtcgacgatgacggcaccatgcggattaaagatgacgagacagagaatatcctgaccgtgcttctgaagacagccctgctcattgtttccggcatctttccgtacagcatccctgccaccctgcttgtgtggcacacgtggcagaaacagacccgcagatctggggtcctgtgggatgtgccctcccctcccgaaacacaaaaggctgagctcgaagagggagtttatcggattaaacagcagggcatcttcgggaagacccaggtgggagtcggcgtgcaaaaggagggggtgtttcatacaatgtggcacgttacccgcggagccgtcctgacatacaacggcaaaagactcgaaccgaattgggcgagcgtgaagaaagacctgatttcttatggcgggggatggcggctttccgctcagtggcagaagggcgaggaagtgcaagtcatcgccgtggagcctgggaaaaaccccaagaatttccagacgatgcctggaaccttccagacaaccaccggcgaaattggggccatcgctctggattttaagcccggaacaagcggctcccccattatcaaccgcgagggcaaagttgtggggctgtacggaaatggcgtcgtgacgaagaacgggggatatgttagcggcatcgcccagaccaatgctgagcctgacgggccgacacccgaactcgaggaagagatgttcaaaaagagaaacctgaccattatggatcttcaccctggctctggaaaaacacggaagtacctgcccgccatcgtgcgcgaagcgattaagagacggctcagaaccctgatcctcgcccctacgcgcgtcgtggctgccgagatggaggaagctctgaaaggccttcccattcggtatcaaacaaccgccaccaagagcgagcatacagggagagaaatcgttgacctgatgtgccacgccacctttacaatgcgcctgctctcccctgtgcgggtcccgaattacaacctgatcattatggatgaggctcatttcaccgaccccgcgtctatcgccgctagaggatacattagcacgcgcgtgggcatgggggaagccgccgctatctttatgacagccacccctcccggaacagcggatgctttccctcagtccaatgcccccattcaggacgaggagcgggacatcccggaaagatcttggaacagcggcaatgagtggatcaccgattttgccgggaaaacggtgtggttcgtcccttccattaaggctggcaacgacatcgccaactgtcttcgcaaaaatggaaagaaggttattcagctgtctcggaaaacctttgatacagaatatcaaaagaccaaactcaacgactgggatttcgtggtgacaaccgacatcagcgagatgggcgcgaattttaaggccgatagagtcattgacccccggcgctgcctgaaacccgtgatcctgacagatgggcctgagagagttattctcgctggacccatgcctgtgaccgccgcttccgccgctcagcggcgcggcagagtcgggcggaacccgcagaaggaaaatgaccagtacatcttcacgggacaaccccttaacaatgatgaggaccacgcccattggacagaagcgaagatgctgctggacaacatcaatacccctgagggcattatccccgccctcttcgaacctgagagagagaaaagcgctgccattgatggggaatatcgcctgaagggcgagtctcggaaaacctttgtggaacttatgagacgcggagacctgcccgtttggctcgctcacaaggtggcctccgagggcatcaaatacacagatcggaagtggtgcttcgacgggcagagaaacaatcagattctggaagagaacatggatgtcgagatctggaccaaagaaggagagaagaagaaactgcgcccgcggtggctcgacgccagaacatatagcgatcctcttgctctgaaggaatttaaagacttcgcggccggccgcaagtctatcgctctggatctcgtgacggagattgggagagtcccctcccacctggcccatcggacccgcaatgcccttgacaacctggtgatgctccacacaagcgaacatggaggcaaagcttacagacacgccgttgaggagctgcctgaaaccatggagacactgctccttctgggcctgatgatcctcctgaccgggggagcgatgctttttctgatttccggcaaggggatcggaaagacgtctattggcctcatctgtgtgatcgccagctccgggatgctgtggatggctgaaattcccctgcagtggatcgccagcgctattgtgctcgagttctttatgatggtccttctgatccctgagcccgaaaaacaacggaccccgcaggataatcagctggcctatgttgtgattggaatcctcacactggcggccattatcgctgccaacgagatgggccttctggaaaccacaaagcgcgacctcggcatgtctaaagagcctggggtggtctcccccaccagctacctggatgtggacctgcaccccgcttctgcctggacgctctacgctgttgccacaaccgtgatcacacctatgcttagacataccattgaaaatagcaccgcgaacgtctccctggccgctatcgccaaccaagctgtggtcctgatgggactcgacaagggctggccgatttctaaaatggatctgggggtgccccttctggccctcggatgctatagccaggttaatcctctgacactgacggccgcggtgctccttctgatcacccactacgctattatcggccccgggctgcaggccaaggctacacgggaggcccagaagagaaccgccgctggaatcatgaaaaaccctacagtcgacggcattatgaccatcgatctcgaccccgtgatttatgattccaagttcgagaaacaactgggccaggttatgcttctggtgctctgtgccgtccagctgctgctcatgcgcacgtcttgggcgctttgcgaagccctgacactggctaccgggcctatcaccacactctgggagggaagcccgggcaagttttggaataccacaattgccgtgtccatggctaacatcttccgggggagctacctggccggagcgggccttgccttttctatcatgaaatccgtggggacgggaaagagaggcaccggcagccagggggaaacactgggagagaagtggaaaaagaaactcaatcaactgtcccgcaaggaattcgacctgtataaaaagtctggcattaccgaggttgatcggacagaggctaaagaagggctcaagagaggagagatcacccatcacgccgtcagccggggctccgctaagcttcagtggtttgtggaacgcaacatggtgattcccgaggggagagtcatcgacctgggatgtggccggggcgggtggtcttactattgcgccggactgaaaaaggttacggaagtgcgcggctacaccaaagggggacctggccatgaggagcccgtgcctatgagcacatacgggtggaatattgtcaagctcatgtccggaaaagatgtgttctatctgcccccggaaaagtgtgacacccttctgtgcgatatcggcgagagctctccttcccccacagttgaagagagcagaaccattcgggtgctcaagatggtcgagccctggctgaaaaacaatcagttctgtatcaaggtgctgaacccttacatgcccacagttatcgaacacctcgagcgccttcagagaaaacacggcgggatgctggtgcggaatcctctgtctcgcaactccacccatgaaatgtattggattagcaatggaacgggcaacatcgtcgcttctgtgaatatggtgagcagactcctgcttaaccggtttacaatgacccacagacgcccgaccattgagaaggacgtcgatctgggggccggaacacggcatgttaacgcggaacccgagacgcctaatatggacgtgatcggcgagagaattaaacgcatcaaggaagagcacaactccacctggcactacgacgatgaaaatccctataagacatgggcctaccatgggtcttatgaggtgaaagctaccggaagcgcctccagcatgatcaacggcgtcgtgaagctcctgacaaaaccttgggacgttgtgcccatggtcacccaaatggctatgacagataccacgccgttcggccagcagcgggtgtttaaggaaaaagttgacaccagaacacctcgctccatgcccgggacccggagagtgatgggaattacagccgagtggctgtggcgcaccctcggccggaataagaagcctagactgtgcacgcgcgaggaattcacaaaaaaggtccggaccaacgccgcgatgggggctgtgtttacagaggaaaatcaatgggattctgccaaagccgctgttgaggacgaagatttctggaagcttgtggacagagagcgcgagctgcacaaactcggaaagtgtggcagctgcgtctacaacatgatggggaaaagagaaaagaagctgggcgagtttggaaaagccaagggctcccgggctatctggtacatgtggcttggggcccgctatctggaattcgaggcgctcggatttctgaatgaggatcattggttctctagagaaaacagctactccggcgtggagggggaaggactgcacaaactcggctatattctgcgggacatctctaagattcccgggggcgccatgtacgctgatgacaccgccggatgggacacgagaatcaccgaggatgaccttcataatgaagagaaaatcacacagcagatggatcctgagcaccggcagctggctgacgccatttttaagctcacctatcaaaacaaggtcgtgaaagttcagcgccccacaccgaccggcacagtgatggatatcattagcagaaaggaccagcgggggtccggacaggtcggcacctacgggctgaatacgttcacaaacatggaagcgcaacttatccgccagatggagggagaaggcgtgctgaccaaagccgatctcgagaatcctcacctgagcgaaaagaaaattacccagtggctggagacaaagggggtggagagactcaagcggatggctatctctggcgacgattgcgttgtgaaacccatcgacgatcgctttgccaacgctctgcttgccctgaacgacatgggaaaggtcagaaaagatattccccagtggcaaccttccaagggctggcatgactggcagcaggtgccgttctgtagccaccatttccacgaactcatcatgaaagacgggcggaagctggttgtgccctgccgccctcaggatgagcttattggaagagctcggatctctcaaggcgccgggtggtccctgcgcgaaaccgcgtgtctcggaaaggcctatgctcagatgtggagcctgatgtactttcacagacgggacctgcgcctcgcctctaatgccatttgctccgctgtccccgtgcattgggtccctacaagcagaacgacctggtccatccacgcccatcaccagtggatgacaaccgaggatatgctgacagtgtggaaccgggtttggattgaagacaatccctggatggaggataaaacccctgtgacgacctgggagaacgtcccctaccttggcaagagagaagaccaatggtgtgggagcctgatcggcctcacatctcgcgcgacctgggctcagaatatcccgacagccattcagcaggtgcggagcctgatcggaaacgaggaattccttgattatatgccttccatgaaaagatttcgcaaggaggaggaatctgagggcgccatttggtga

SEQ ID NO: 20708 - RNA, 9873 nt, synthetic construct
  misc_feature 1..9873: note = derived and/or modified CDS sequence (opt5) from DENV-3__FJ182011__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgacaaaaaaggaggaacccgtcaacattgaggccgaacctccgttcggcgagtccaatatcgtgattgggatcggcgataacgctctgaaaatcaattggtataagaagggatctagcattggcaaaatgtttgaagccaccgctcggggggccagacgcatggcgatccttggagacacggcctgggatttcggctccgtggggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacaccgggtgtgtgatcaattggaaaggaaaggagctgaagtgcggcagcgggattttcgtcacaaacgaggtgcatacgtggaccgaacagtacaaatttcaagccgattcccccaagcggctggctacagccatcgctggcgcctgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtctgggaagtggaggactatggctttggcgtgttcacaaccaatatctggctcaaactgcgcgaagtctacacgcagctgtgtgaccaccggcttatgagcgccgccgttaaggatgagagagctgtgcacgccgacatggggtactggattgagtcccagaaaaacggatcttggaagctcgaaaaagcgagcctgatcgaggtgaagacatgcacctggcctaagtcccataccctgtggtctaatggcgtcctcgaaagcgatatgattatccccaaatccctggctgggcctattagccagcacaactatcgccccggataccatacacaaaccgccggcccttggcaccttgggaagctggagctcgactttaattattgcgagggaacgacagtggttatcaccgataactgtggcacacggggcccctctctgagaaccacaaccgtgtccgggaaactgatccacgaatggtgctgtcgcagctgcacgcttccgcctctccggtacatgggagaggacggctgttggtatgggatggaaattagacccatctctgagaaggaagagaatatggtcaaatccctggtgagcgccggatctggcaaggttgataacttcaccatgggggtgctgtgcctcgctattctgtttgaggaagtcatgcggggaaagttcggcaaaaagcatatgatcgccggcgtgttctttacattcgttcttctgctcagcgggcagattacctggcgcgacatggcgcacacactgatcatgattggatccaatgctagcgatagaatgggcatgggggtgacctacctggcccttatcgccacgtttaaaatccagcccttcctggctctcggatttttcctgcggaagctcacatctagagagaacctgcttctgggcgtcgggctcgccatggctaccacactgcaactgcctgaagacattgagcagatggccaatggaatcgcgcttggcctgatggccctcaaactgattacccagtttgaaacctatcagctctggacagctctgatctcccttacgtgtagcaacaccattttcacactgaccgtggcctggcgcacagctaccctcatcctggccggcgtgtccctgcttccggtctgccaatctagctccatgcggaagtctgattggctgcccatgacggttgccgctatgggggtgcctcccctccctctgtttatcttcagcctcaaggacacactgaaaagacgctcctggccccttaatgagggagtgatggcggtcggcctggtgtctattctggccagctccctcctgagaaacgatgttcctatggctgggccccttgtggccggaggcctgctcatcgcctgttacgtcattaccgggaccagcgctgacctgacagtggagaaggccgcggacgttacctgggaagaggaagctgagcagacaggagtgtctcataacctcatgatcacggtcgatgacgatggcaccatgcggattaaagacgatgaaacagagaatatcctgaccgtgcttctgaagacagccctgctcatcgtctccggcatttttccgtacagcatccctgccaccctgcttgtgtggcacacgtggcagaaacagacccgcagatctggggttctgtgggacgtgccctcccctcccgagacacaaaaggctgaactcgaggaaggagtctatcggattaaacagcagggcatcttcgggaagacccaggtgggagttggcgtgcaaaaggagggggtctttcatacaatgtggcacgtgacccgcggagccgtgctgacatacaacggcaaaagactcgagccgaattgggcgagcgttaagaaagatctgatttcttatggcgggggatggcggctttccgctcagtggcagaagggcgaagaggtccaagtgatcgccgtggaacctgggaaaaaccccaagaatttccagacgatgcctggaaccttccagacaaccaccggcgagattggggccatcgctctggactttaagcccggaacaagcggctcccccatcattaaccgcgaaggcaaagtcgtggggctgtacggaaatggcgttgtgacgaagaacgggggatatgtcagcggcatcgcccagaccaatgctgagcctgatgggccgacacccgagctcgaagaggaaatgttcaaaaagagaaacctgaccattatggaccttcaccctggctctggaaaaacacggaagtacctgcccgccatcgtgcgcgaggcgattaagagacggctcagaaccctgatcctcgcccctacgcgcgttgtggctgccgaaatggaggaggctctgaaaggccttcccatccggtatcaaacaaccgccaccaagagcgaacatacagggagagagattgtcgatctgatgtgccacgccacctttacaatgcgcctgctctcccctgtgcgggttccgaattacaacctgatcattatggacgaagctcatttcaccgatcccgcgtctatcgccgctagaggatacattagcacgcgcgtgggcatgggggaggccgccgctatctttatgacagccacccctcccggaacagcggacgctttccctcagtccaatgcccccatccaggacgaagagcgggatattccggagagatcttggaacagcggcaatgaatggatcaccgactttgccgggaaaacggtctggttcgtgccttccattaaggctggcaacgatatcgccaactgtcttcgcaaaaatggaaagaaggtgattcagctgtctcggaaaacctttgacacagagtatcaaaagaccaaactcaacgattgggacttcgtcgttacaaccgatatcagcgaaatgggcgcgaattttaaggccgacagagtgattgatccccggcgctgcctgaaacccgtgatcctgacagacgggcctgagagagtcatcctcgctggacccatgcctgtgaccgccgcttccgccgctcagcggcgcggcagagttgggcggaacccgcagaaggagaatgatcagtacattttcacgggacaaccccttaacaatgacgaagaccacgcccattggacagaggcgaagatgctgctggataacatcaatacccctgaaggcattatccccgccctcttcgagcctgaaagagagaaaagcgctgccattgacggggagtatcgcctgaagggcgaatctcggaaaacctttgtggagcttatgagacgcggagatctgcccgtctggctcgctcacaaggtggcctccgaaggcatcaaatacacagaccggaagtggtgcttcgatgggcagagaaacaatcagatcctggaggaaaacatggacgttgagatttggaccaaagagggagaaaagaagaaactgcgcccgcggtggctcgatgccagaacatatagcgaccctcttgctctgaaggagtttaaagatttcgcggccggccgcaagtctatcgctctggacctcgtgacggaaattgggagagtcccctcccacctggcccatcggacccgcaatgcccttgataacctggtgatgctccacacaagcgagcatggaggcaaagcttacagacacgccgtcgaagagctgcctgagaccatggaaacactgctccttctgggcctgatgatcctcctgaccgggggagcgatgctttttctgatttccggcaaggggatcggaaagacgtctatcggcctcatttgtgtgatcgccagctccgggatgctgtggatggctgagattcccctgcagtggatcgccagcgctattgttctcgaattctttatgatggtgcttctgatccctgagcccgagaaacaacggaccccgcaggacaatcagctggcctatgtggtcattggaatcctcacactggcggccatcattgctgccaacgaaatgggccttctggagaccacaaagcgcgatctcggcatgtctaaagaacctggggttgtgtcccccaccagctacctggacgtggacctgcaccccgcttctgcctggacgctctacgctgtcgccacaaccgtgatcacacctatgcttagacataccattgagaatagcaccgcgaacgtttccctggccgctatcgccaaccaagctgtggtcctgatgggactcgataagggctggccgatttctaaaatggacctgggggtgccccttctggccctcggatgctatagccaggtcaatcctctgacactgacggccgcggtgctccttctgatcacccactacgctatcattggccccgggctgcaggccaaggctacacgggaagcccagaagagaaccgccgctggaatcatgaaaaaccctacagttgatggcattatgaccatcgacctcgatcccgtgatttatgactccaagttcgagaaacaactgggccaggtcatgcttctggtgctctgtgccgttcagctgctgctcatgcgcacgtcttgggcgctttgcgaggccctgacactggctaccgggcctatcaccacactctgggaaggaagcccgggcaagttttggaataccacaatcgccgtgtccatggctaacattttccgggggagctacctggccggagcgggccttgccttttctatcatgaaatccgtcgggacgggaaagagaggcaccggcagccagggggagacactgggagaaaagtggaaaaagaaactcaatcaactgtcccgcaaggagttcgatctgtataaaaagtctggcattaccgaagtggaccggacagaggctaaagaggggctcaagagaggagaaatcacccatcacgccgtgagccggggctccgctaagcttcagtggtttgttgagcgcaacatggtcattcccgaagggagagtgatcgatctgggatgtggccggggcgggtggtcttactattgcgccggactgaaaaaggtgacggaggtccgcggctacaccaaagggggacctggccatgaagagcccgttcctatgagcacatacgggtggaatattgtgaagctcatgtccggaaaagacgtgttctatctgcccccggagaagtgtgatacccttctgtgcgacatcggcgaaagctctccttcccccacagtcgaggaaagcagaaccatccgggtgctcaagatggttgagccctggctgaaaaacaatcagttctgtattaaggtgctgaacccttacatgcccacagtcatcgagcacctcgaacgccttcagagaaaacacggcgggatgctggtgcggaatcctctgtctcgcaactccacccatgagatgtattggattagcaatggaacgggcaacatcgttgcttctgtgaatatggtcagcagactcctgcttaaccggtttacaatgacccacagacgcccgaccattgaaaaggatgtggacctgggggccggaacacggcatgtgaacgcggagcccgaaacgcctaatatggacgtcatcggcgagagaatcaaacgcattaaggaggaacacaactccacctggcactacgatgacgagaatccctataagacatgggcctaccatgggtcttatgaagttaaagctaccggaagcgcctccagcatgatcaacggcgtggtgaagctcctgacaaaaccttgggatgtcgtgcccatggttacccaaatggctatgacagacaccacgccgttcggccagcagcgggtgtttaaggagaaagtcgataccagaacacctcgctccatgcccgggacccggagagtgatgggaattacagccgaatggctgtggcgcaccctcggccggaataagaagcctagactgtgcacgcgcgaggagttcacaaaaaaggttcggaccaacgccgcgatgggggctgtgtttacagaagagaatcaatgggactctgccaaagccgctgtcgaagatgaggacttctggaagcttgtggatagagaacgcgagctgcacaaactcggaaagtgtggcagctgcgtttacaacatgatggggaaaagagagaagaagctgggcgaatttggaaaagccaagggctcccgggctatctggtacatgtggcttggggcccgctatctggagttcgaagcgctcggatttctgaatgaggaccattggttctctagagagaacagctactccggcgtggaaggggagggactgcacaaactcggctatattctgcgggatatctctaagatccccgggggcgccatgtacgctgacgacaccgccggatgggatacgagaattaccgaagacgatcttcataatgaggaaaaaatcacacaccagatggaccctgagcaccggcagctggctaacgccatttttaagctcacctatcagaataaggtcgtgaaagtccaacgccccacaccgaccggcacagtgatggatatcattagcagaaaggaccagcgggggtccggacaggttggcacctacgggctgaacacgttcacaaatatggaggcgcagcttatccgccaaatggaaggagagggcgtgctgagcaaagccgatctcgaaaaccctcatctgtctgagaagaaaatcacccagtggctggaaaccaagggggtcgagagactcaagcggatggctatttccggcgacgattgcgtggtgaaacccatcgacgatcgctttgccaacgctctgcttgccctgaatgacatgggaaaggttagaaaagatattccccagtggcagcctagcaagggctggcacgactggcaacaggtgccgttctgttctcatcacttccacgagctcatcatgaaagacgggcggaagctggtcgtgccctgccgccctcaggatgaacttattggaagagctcggatctcccagggcgccgggtggagcctgcgcgagacagcgtgtctcggaaaggcctatgctcaaatgtggtctctgatgtactttcatagacgggacctgcgcctcgcctccaacgccatttgcagcgctgttcccgtgcactgggtccctacctccagaacaacgtggagcatccatgcccaccatcagtggatgaccacagaagatatgctgaccgtgtggaatcgggtctggatcgaggacaacccctggatggaagataaaacacctgtgaccacgtgggagaatgttccctaccttggcaagagagaggaccagtggtgtgggtctctgattggcctcaccagccgcgcgacatgggctcaaaacatcccgaccgccattcagcaggtgcggtccctgatcggaaatgaagagttccttgattatatgccttctatgaaaagatttcgcaaggaagaggagagcgaaggcgccatttggtga

SEQ ID NO: 20709 - RNA, 9873 nt, synthetic construct
  misc_feature 1..9873: note = derived and/or modified CDS sequence (opt5) from DENV-3__FJ182038__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccaccctgttctccggcgtgagctgggtgatgaaaatcggaattggcgtcctcctgacatggatcgggcttaattctaagaacaccagcatgtccttttcttgcattgctatcggagtgatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttttctttaccttcgtgcttctgctcagcgggcagatcacatggcgcgatatggctcacaccctgattatgatcggatccaatgccagcgacaaaatgggcatgggggtcacgtacctggcgcttattgctacatttaagatccagcccttcctggccctcggatttttcctgagaaaactcacctctcgggaaaacctgcttctgggcgtggggctcgccatggctacaaccctgcaactgcctgaggatatcgaacagatggccaatggaattgctcttggcctgatggccctcaagctgatcacccagtttgagacatatcagctctggacggcgctgatttcccttacctgtagcaacacaatgttcaccctgacagtggcctggagaaccgctacgctcatcctggccggcgtctccctgcttccggtttgccaatctagctccatgcgcaagacagactggctgcccatggctgtggccgccatgggggtgcctcccctccctctgtttattttctctctcaaagataccctgaagcggagaagctggccccttaatgagggagtcatggctgtgggcctggtttccatcctggcgtctagcctcctgcgcaacgacgtgcctatggccgggccccttgtcgctggaggcctgctcatcgcctgttacgtgattaccgggacatccgccgatctgaccgttgaaaaagctgccgacatcacatgggaggaagaggcggaacagacgggagtgagccataacctcatgattaccgtcgacgatgacggcacaatgagaatcaaggatgacgagaccgagaatattctgacagtgcttctgaaaaccgctctgctcatcgtctctggcgtgtttccgtactccatccctgccacgctgcttgtttggcacacctggcagaagcagacacaacggagcggggtgctgtgggatgtcccctctcctcccgaaacccagaaagccgagctcgaagagggagtgtatcgcattaagcagcagggcatcttcgggaagacacaagttggagtgggcgtccagaaagagggggtgtttcataccatgtggcacgtgacaagaggagctgttctgacgtacaacggcaagcggctcgaaccgaattgggcctccgtcaaaaaggacctgattagctatggcgggggatggcgcctttctgcgcagtggcaaaaaggcgaggaagtgcaggtgatcgctgtcgagcctgggaagaaccccaagaatttccagaccatgcctggaacattccagaccaccacaggcgaaattggggccatcgccctggattttaaacccggaacgtccggcagccccattatcaacagagagggcaaggtggttgggctgtacggaaatggcgtggtcaccaaaaacgggggatatgtgtccggcatcgctcaaacaaatgccgagcctgacgggccgacccccgaactcgaggaagagatgttcaagaaacggaacctgacaattatggatcttcaccctggcagcggaaagacccgcaagtacctgcccgctatcgttagagaagccattaaacggcgcctcagaacgctgatcctcgcgcctacacgggtggtcgccgctgagatggaggaagccctgaagggccttcccattagatatcagaccaccgctacaaaatctgagcataccgggcgcgaaatcgtggacctgatgtgccacgccacatttaccatgcggctgctcagccctgttagagtgccgaattacaacctgatcattatggatgaggcccatttcacggaccccgcttccatcgcggcccgcggatacatttctacacgggtcggcatgggggaagctgccgccatctttatgaccgctacacctcccggaaccgccgatgcgttccctcagagcaatgctcccattcaggacgaggagagagacatcccggaacgctcctggaactctggcaatgagtggatcacggattttgccgggaagaccgtgtggttcgtgcctagcattaaagccggcaacgacatcgctaactgtcttcggaagaatggaaagaaagtcattcaactgtccagaaagacatttgataccgaatatcagaaaacaaagctcaacgactgggatttcgttgtgaccacagacatctctgagatgggcgccaattttaaagcggatcgcgtgattgacccccggagatgcctgaagcccgtcatcctgaccgatgggcctgagcgggtgattctcgccggacccatgcctgttacggctgccagcgctgcccagcgcagaggccgggtggggcgcaacccgcagaaggaaaatgaccaatacatcttcatgggacagccccttaacaatgatgaggaccacgctcattggacagaagccaaaatgctgctggacaacatcaatacccctgagggcattatccccgcgctcttcgaacctgagagagagaagtccgccgctattgatggggaatatcggctgaaaggcgagagcagaaagacctttgtcgaacttatgcgccggggagacctgcccgtgtggctcgcccacaaagttgcttctgagggcatcaagtacacagatagaaaatggtgcttcgacgggcagcgcaacaatcagattctggaagagaacatggatgtggagatctggaccaaggaaggagagaagaaaaagctgcggccgagatggctcgacgcccgcacatattccgatcctcttgccctgaaagaatttaaggacttcgctgcgggccggaaaagcatcgccctggatctcgtcacggagattgggagagtgccctctcacctggctcatcgcaccagaaatgcccttgacaacctggtcatgctccacacatccgaacatggaggccgggcctaccgccacgctgtggaggagctgcctgaaaccatggagacactgctccttctgggcctgatgatcctcctgaccgggggagccatgctttttctgattagcggcaaggggatcggaaagacgtccattggcctcatctgtgttatcgcgtctagcgggatgctgtggatggccgaaattcccctgcaatggatcgcttccgccattgtgctcgagttctttatgatggtgcttctgatccctgagcccgaaaaacagagaaccccgcaggataatcaactggcttatgtcgttattggaatcctcacactggccgcgaccattgccgctaacgagatgggccttctggaaacaaccaagcgggacctcggcatgagcaaagagcctggggtggtgtctcccacgtcctacctggatgtcgacctgcaccccgccagcgcttggacactctacgccgtggctaccacagttatcacccctatgcttcgccataccatcgaaaattctacagccaacgtgagcctggcggccattgctaaccaggccgtcgtgctgatgggactcgacaagggctggccgatctccaaaatggatctgggggtcccccttctggctctcggatgctattctcaggtgaatcctctgacgctgaccgccgccgttctccttctgattacacactacgcgatcattggccccgggctgcaggctaaggccaccagagaggctcaaaagcggacagccgccggaatcatgaaaaaccctaccgtggacggcatcatgacgattgatctcgaccccgtcatctatgatagcaagttcgagaaacagctgggccaggtgatgcttctggttctctgtgctgtgcagctgctgctcatgagaacatcctgggccctttgcgaagcgctgaccctggccaccgggcctattacaaccctctgggagggatctccgggcaagttttggaatacaacgatcgctgtcagcatggccaacattttccgcgggtcctacctggctggagccggccttgcgtttagcatcatgaaatctgtggggaccggaaagcggggcacaggctcccaaggggaaaccctgggagagaagtggaaaaagaaactcaatcagctgagcagaaaggaattcgacctgtataaaaagtccggcatcacagaggtggatcgcaccgaggccaaagaagggctcaagcggggagagacgacccatcacgctgtttctagaggcacagccaagcttcagtggtttgtcgaacggaacatggtgattcccgaggggcgcgtgatcgacctgggatgtggcagaggcgggtggagctactattgcgctggactgaaaaaggtcaccgaagttcggggctacacaaaagggggacctggccatgaggagcccgtgcctatgtccacctacgggtggaatattgtgaagctcatgtctggaaaagatgtcttctatctgcccccggaaaagtgtgacacacttctgtgcgatatcggcgagagctcccctagccccaccgtggaagagtctcgcacgattagagttctcaagatggtggagccctggctgaaaaacaatcagttctgtatcaaggtcctgaacccttacatgcccacagtgattgaacacctcgagcggcttcaacgcaaacacggcgggatgctggttagaaatcctctgtcccggaacagcacccatgaaatgtattggatctctaatggaaccggcaacatcgtggcctccgtcaatatggtgagccgcctcctgcttaacagatttacaatgacgcaccggagaccgaccattgagaaggacgtggatctgggggctggaacacgccatgtcaacgccgaacccgagacccctaatatggacgttatcggcgagcggattaaaagaatcaaggaagagcacaactctacatggcactacgacgatgaaaatccctataagacctgggcgtaccatgggagctatgaggtgaaagccacaggatccgcttctagcatgattaacggcgtggtcaagctcctgaccaaaccttgggacgtggttcccatggtgacgcagatggccatgaccgatacaaccccgttcggccagcaacgcgtctttaaggaaaaagtggacacacggacccctagatccatgcccgggacgcgccgggttatgggaatcacagctgagtggctgtggagaaccctcggccgcaataagaagcctcggctgtgcacaagagaggaattcaccaaaaaggtgcgcacgaacgccgccatgggggcggtctttaccgaggaaaatcagtgggatagcgctaaagccgccgtggaggacgaagatttctggaagcttgttgaccgggagagagagctgcacaaactcggaaagtgtggctcctgcgtgtacaacatgatggggaaacgcgaaaagaagctgggcgagtttggaaaagctaagggctctagagccatctggtacatgtggcttggggctcggtatctggaattcgaggccctcggatttctgaatgaggatcattggttcagccgcgaaaactcctactctggcgtcgagggggaaggactgcacaaactcggctatattctgagagacatcagcaagattcccgggggcgcgatgtacgccgatgacacagctggatgggacacccggatcacagaggatgaccttcataatgaagagaaaattacccagcagatggatcctgagcacagacaactggccaacgctatctttaagctcacatatcagaataaggtggtcaaagtgcagcggcccaccccgacgggcacagttatggacatcatttcccgcaaggatcagagagggtctggacaagtgggcacctacgggctgaacaccttcacaaatatggaagcccagcttatccggcagatggagggagaaggcgtcctgagcaaagcggacctcgagaaccctcacctgcccgaaaagaaaattacccagtggctggagacaaagggggtggagcgcctcagacggatggccatctccggcgatgactgcgtggttaagcccattgatgaccgctttgctaacgccctgcttgctctgaatgatatgggaaaagtgagaaaggacatccctcaatggcagccgagcaaaggctggcatgattggcagcaggtccccttctgttctcaccatttccacgaactcatcatgaaggacgggcggaaactggtggttccttgccgcccccaagacgagcttattggaagagcccggatctcccagggcgctgggtggagcctgcgcgaaacggcctgtctcggaaaggcgtatgcccagatgtggtctctgatgtactttcacagacgggatctgcgcctcgcttccaacgccatttgcagcgccgtgcctgtccattgggtgcccacctctagaacaacctggtccatccacgctcatcaccaatggatgacaaccgaggacatgctgacggtctggaatcgggtgtggattgaagataacccttggatggaggacaagacccccgttacaacctgggagaatgtgccgtaccttggcaaaagagaagatcagtggtgtgggagcctgatcggcctcacatcccgcgccacctgggcgcagaacattcctacggctatccagcaagtccggagcctgatcggaaatgaggaattccttgactatatgccctctatgaagagatttcgcaaagaggaggaaagcgagggcgccatttggtga

SEQ ID NO: 20710 - RNA, 9873 nt, synthetic construct
  misc_feature 1..9873: note = derived and/or modified CDS sequence (opt5) from DENV-3__FJ182041__SS-prME
  source 1..9873: mol_type = other RNA
acaagcctgtgcctcatgatgatcctgcccgcggctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcgccgaagttgaacccgaagacattgattgctggtgtaacctcacatccacctgggtgacatatggaacctgcaatcaggccggcgagcaccggcgggacaagcgctctgtggctctggcccctcatgtcgggatgggactggatacgagaacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgctgaaacacaaaactccagcttcattatcgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacatgcacctggcctaagtcccataccctgtggtctaatggcgtgctcgaaagcgatatgattatccccaaatccctggcggggcctattagccagcacaactatcgccccggataccatacacaaaccgctggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgccggatctggcaaggtggacaacttcaccatgggggtcctgtgcctcgccattctgtttgaagaggtgatgcggggaaagttcggcaaaaagcatatgatcgctggcgttttctttacattcgtgcttctgctcagcgggcagattacctggcgcgatatggcccacacactgatcatgattggatccaatgcgagcgacagaatgggcatgggggtcacctacctggctcttatcgccacgtttaaaatccagcccttcctggccctcggatttttcctgcggaagctcacatctagagaaaacctgcttctgggcgtggggctcgctatggccaccacactgcaactgcctgaggatattgaacagatggctaatggaatcgcccttggcctgatggcgctcaaactgattacccagtttgagacctatcagctctggacagccctgatctcccttacgtgtagcaacaccattttcacactgaccgtggcttggcgcacagccaccctcatcctggctggcgtctccctgcttccggtttgccaatctagctccatgcggaagtctgactggctgcccatgacggtggccgccatgggggtgcctcccctccctctgtttatcttcagcctcaaggatacactgaaaagacgctcctggccccttaatgagggagtcatggctgtgggcctggtttctattctggcgagctccctcctgagaaacgacgtgcctatggccgggccccttgtcgctggaggcctgctcatcgcctgttacgtgattaccgggaccagcgccgatctgacagttgaaaaggctgccgacgtgacctgggaggaagaggcggaacagacaggagtctctcataacctcatgatcacggtggacgatgacggcaccatgcggattaaagatgacgagacagagaatatcctgaccgtccttctgaagacagctctgctcatcgtgtccggcatttttccgtacagcatccctgccaccctgcttgtttggcacacgtggcagaaacagacccaacgctctggggtgctgtgggatgtcccctcccctcccgaaacacagaaggccgagctcgaagagggagtgtatagaattaaacagcagggcatcttcgggaagacccaagttggagtgggcgtccagaaggagggggtgtttcatacaatgtggcacgtgacccggggagctgttctgacatacaacggcaaacgcctcgaaccgaattgggccagcgtcaagaaagacctgatttcttatggcgggggatggagactttccgcgcagtggcaaaagggcgaggaagtccaggtgatcgctgtcgagcctgggaaaaaccccaagaatttccagacgatgcctggaaccttccagacaaccaccggcgaaattggggccatcgccctggattttaagcccggaacaagcggctcccccatcattaaccgggagggcaaagtggttgggctgtacggaaatggcgtggtcacgaagaacgggggatatgtgagcggcatcgctcaaaccaatgccgagcctgacgggccgacacccgaactcgaggaagagatgttcaaaaagcgcaacctgaccattatggatcttcaccctggctctggaaaaacaagaaagtacctgcccgctatcgttcgggaagccattaagcgcagactccggaccctgatcctcgcgcctacgagagtggtcgccgctgagatggaggaagccctgaaaggccttcccatccgctatcagacaaccgctaccaagagcgagcatacagggcgggaaattgtggacctgatgtgccacgccacctttacaatgagactgctctcccctgttcgcgtgccgaattacaacctgatcattatggatgaggcccatttcaccgaccccgcttctatcgcggcccggggatacattagcacgagagtcggcatgggggaagctgccgccatctttatgacagctacccctcccggaacagccgatgcgttccctcagtccaatgctcccatccaggacgaggagcgcgacattccggaacggtcttggaacagcggcaatgagtggatcaccgattttgccgggaaaacggtgtggttcgtgccttccattaaggccggcaacgacatcgctaactgtcttcgcaaaaatggaaagaaggtcattcaactgtctagaaaaacctttgatacagaatatcagaagaccaaactcaacgactgggatttcgttgtgacaaccgacatcagcgagatgggcgccaattttaaggcggatcgggtgattgaccccagacggtgcctgaaacccgtcatcctgacagatgggcctgagcgcgtgatcctcgccggacccatgcctgttaccgctgcctccgctgcccagagacggggccgcgtggggagaaacccgcagaaggaaaatgaccaatacattttcacgggacagccccttaacaatgatgaggaccacgctcattggacagaagccaagatgctgctggacaacatcaatacccctgagggcattatccccgccctcttcgaacctgagcgggagaaaagcgccgctattgatggggaatatagactgaagggcgagtctcgcaaaacctttgtcgaacttatgcggagaggagacctgcccgtgtggctcgcccacaaggttgcttccgagggcatcaaatacacagatcgcaagtggtgcttcgacgggcagcggaacaatcagatcctggaagagaacatggatgtggagatttggaccaaagaaggagagaagaagaaactgagaccgcgctggctcgacgcccggacatatagcgatcctcttgccctgaaggaatttaaagacttcgctgcgggcagaaagtctatcgccctggatctcgtcacggagattgggcgcgtgccctcccacctggctcatagaacccggaatgcccttgacaacctggtcatgctccacacaagcgaacatggaggcaaagcctaccgccacgctgtggaggagctgcctgaaaccatggagacactgctccttctgggcctgatgatcctcctgaccgggggagccatgctttttctgatttccggcaaggggatcggaaagacgtctatcggcctcatttgtgttatcgcgagctccgggatgctgtggatggccgaaattcccctgcaatggatcgctagcgccattgtgctcgagttctttatgatggtgcttctgatccctgagcccgaaaaacagagaaccccgcaggataatcaactggcttatgtcgttattggaatcctcacactggccgcgatcattgccgctaacgagatgggccttctggaaaccacaaagcgggacctcggcatgtctaaagagcctggggtggtgtcccccaccagctacctggatgtcgacctgcaccccgcctctgcttggacgctctacgccgtggctacaaccgttatcacacctatgcttcgccataccattgaaaatagcaccgccaacgtgtccctggcggccatcgctaaccaggccgtcgtgctgatgggactcgacaagggctggccgatttctaaaatggatctgggggtcccccttctggctctcggatgctatagccaggtgaatcctctgacactgacggccgccgttctccttctgatcacccactacgcgatcattggccccgggctgcaggctaaggccacaagagaggctcaaaagcggaccgccgccggaatcatgaaaaaccctacagtggacggcattatgaccatcgatctcgaccccgtcatttatgattccaagttcgagaaacagctgggccaggtgatgcttctggttctctgtgctgtgcagctgctgctcatgagaacgtcttgggccctttgcgaagcgctgacactggccaccgggcctatcaccacactctgggagggaagcccgggcaagttttggaataccacaatcgctgtctccatggccaacattttccgcgggagctacctggctggagccggccttgcgttttctatcatgaaatccgtggggacgggaaagcggggcaccggcacacaaggggaaaccctgggagagaagtggaaaaagaaactcaatcagctgagcagaaaggagttcgacctgtataaaaagtccggcattacagaggtggatcgcaccgaggccaaagaagggctcaagcggggagagatcacgcatcacgctgtttctagaggcagcgccaaacttcagtggtttgtcgaacggaacatggtgattcccgaggggcgcgtgatcgacctgggatgtggcagaggcgggtggtcctactattgcgctggactgaaaaaggtcaccgaagttcggggctacacaaaagggggacctggccatgaggagcccgtgcctatgtctacctacgggtggaatattgtgaagctcatgagcggaaaagatgtcttctatctgcccccggaaaagtgtgacacacttctgtgcgatatcggcgagtccagcccttctcccaccgtggaagagtcccgcacaatcagagttctcaagatggtggagccctggctgaaaaacaatcagttctgtattaaggtcctgaacccttacatgcccaccgtgatcgaacacctcgagcggcttcaacgcaaacacggcgggatgctggttagaaatcctctgagccggaactctacgcatgaaatgtattggatttccaatggaacaggcaacatcgtggccagcgtcaatatggtgtctcgcctcctgcttaacagatttaccatgacccaccggagaccgacaattgagaaggacgtggatctgggggctggaacgcgccatgtcaacgccgaacccgagacccctaatatggacgttatcggcgagcggatcaaaagaattaaggaagaacacaacagcacatggcactacgacgatgaaaatccctataagacctgggcgtaccatgggtcctatgaggtgaaagccacaggatctgctagctccatgatcaacggcgtggtcaagctcctgaccaaaccttgggacgtggttcccatggtgacacagatggccatgaccgatacgaccccgttcggccagcaacgcgtctttaaggaaaaagtggacacacggacccctagaagcatgcccgggacacgccgggttatgggaattaccgctgagtggctgtggagaacgctcggccgcaataagaagcctcggctgtgcacaagagaggagttcaccaaaaaggtgcgcacaaacgccgccatgggggcggtctttaccgaggaaaatcagtgggattccgctaaagccgccgtggaggacgaagatttctggaaacttgttgaccgggagagagagctgcacaaactcggaaagtgtggctcttgcgtgtacaacatgatggggaaacgcgaaaagaagctgggcgagtttggaaaagctaagggcagcagagccatctggtacatgtggcttggggctcggtatctggagttcgaggccctcggatttctgaatgaggatcattggttctcccgcgaaaactcttacagcggcgtcgagggggaaggactgcacaaactcggctatattctgagagacatctccaagatccccgggggcgcgatgtacgccgatgacacggctggatgggacacccggattacagaggatgaccttcataatgaagagaaaatcacccagcagatggatcctgagcacagacaactggccaacgctatttttaagctcacatatcagaataaggtggtcaaagtgcagcggcccaccccgacaggcaccgttatggacatcatttctcgcaaggatcagagagggagcggacaagtgggcacgtacgggctgaacacattcaccaatatggaagcccagcttatccggcagatggagggagaaggcgtcctgtccaaagcggacctcgagaaccctcacctgagcgaaaagaaaatcacccagtggctggagacaaagggggtggagcgcctcaagagaatggccatttctggcgatgactgcgtggttaaacccatcgatgaccggtttgctaacgccctgcttgctctgaatgatatgggaaaggtgcgcaaagacattccccaatggcagccttccaagggctggcatgattggcagcaggtcccgttctgtagccaccatttccacgaactcatcatgaaagacgggagaaagctggtggttccctgccggcctcaagacgagcttattggacgcgccagaatctctcagggcgctgggtggtccctgcgggaaaccgcctgtctcggaaaggcgtatgcccagatgtggagcctgatgtactttcaccgcagagatctgcggctcgcttctaacgccatttgctccgccgtgcccgtccattgggtgcctacaagccgcacgacctggtccatccacgctcatcaccaatggatgacaaccgaggacatgctgacagtctggaatagagtgtggatcgaagataacccctggatggaggacaaaacccctgttacgacctgggagaatgtgccctaccttggcaagcgggaagatcagtggtgtgggagcctgattggcctcacatctagagccacctgggcgcagaacatcccgacagctattcagcaagtccgcagcctgatcggaaatgaggagttccttgactatatgccttccatgaaacggtttagaaaggaggaggaatctgagggcgccatttggtga

SEQ ID NO: 20711 - RNA, 9873 nt, synthetic construct
  misc_feature 1..9873: note = derived and/or modified CDS sequence (opt5) from DENV-3__FJ390371__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgacaaaaaaggaggaacccgtcaacattgaggccgaacctccgttcggcgagtccaatatcgtgattgggatcggcgataacgctctgaaaatcaattggtataagaagggatctagcattggcaaaatgtttgaagccaccgctcggggggccagacgcatggcgatccttggagacacggcctgggatttcggctccgtggggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacaccgggtgtgtgatcaattggaaaggaaaggagctgaagtgcggcagcgggattttcgtcacaaacgaggtgcatacgtggaccgaacagtacaaatttcaagccgattcccccaagcggctggctacagccatcgctggcgcctgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggctaagatcgtgaccgcggaaacacaaaactccagcttcattatcgatggacctaatacccccgagtgcccgtctgcctccagagcttggaacgtctgggaagtggaggactatggctttggcgtgttcacaaccaatatctggctcaaactgcgcgaagtctacacgcagctgtgtgaccaccggcttatgagcgccgccgttaaggatgagagagctgtgcacgccgacatggggtactggattgagtcccagaaaaacggatcttggaagctcgaaaaagcgagcctgatcgaggtgaagacatgcacctggcctaagtcccataccctgtggtctaatggcgtcctcgaaagcgatatgattatccccaaatccctggctgggcctattagccagcacaactatcgccccggataccatacacaaaccgccggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcaaggttgacaacttcaccatgggggtgctgtgcctcgctattctgtttgaagaggtcatgcggggaaagttcggcaaaaagcatatgatcgccggcgtgttctttacattcgttcttctgctcagcgggcagattacctggcgcgatatggcgcacacactgatcatgattggatccaatgctagcgacagaatgggcatgggggtgacctacctggcccttatcgccacgtttaaaatccagcccttcctggctctcggatttttcctgcggaagctcacatctagagaaaacctgcttctgggcgtcgggctcgccatggctaccacactgcaactgcctgaggatattgaacagatggccaatggaatcgcgcttggcctgatggccctcaaactgattacccagtttgagacctatcagctctggacagctctgatctcccttacgtgtagcaacaccattttcacactgaccgtggcctggcgcacagctaccctcatcctggccggcgtgtccctgcttccggtctgccaatctagctccatgcggaagtctgactggctgcccatgacggttgccgctatgggggtgcctcccctccctctgtttatcttcagcctcaaggatacactgaaaagacgctcctggccccttaatgagggagtgatggcggtcggcctggtgtctattctggccagctccctcctgagaaacgacgttcctatggctgggccccttgtggccggaggcctgctcatcgcctgttacgtcattaccgggaccagcgctgatctgacagtggaaaaggccgcggacgttacctgggaggaagaggctgaacagacaggagtgtctcataacctcatgatcacggtcgacgatgacggcaccatgcggattaaagatgacgagacagagaatatcctgaccgtgcttctgaagacagccctgctcatcgtctccggcatttttccgtacagcatccctgccaccctgcttgtgtggcacacgtggcagaaacagacccgcagatctggggttctgtgggatgtgccctcccctcccgaaacacaaaaggctgagctcgaagagggagtctatcggattaaacagcagggcatcttcgggaagacccaggtgggagttggcgtgcaaaaggagggggtctttcatacaatgtggcacgtgacccgcggagccgtgctgacatacaacggcaaaagactcgaaccgaattgggcgagcgttaagaaagacctgatttcttatggcgggggatggcggctttccgctcagtggcagaagggcgaggaagtccaagtgatcgccgtggagcctgggaaaaaccccaagaatttccagacgatgcctggaaccttccagacaaccaccggcgaaattggggccatcgctctggattttaagcccggaacaagcggctcccccatcattaaccgcgagggcaaagtcgtggggctgtacggaaatggcgttgtgacgaagaacgggggatatgtcagcggcatcgcccagaccaatgctgagcctgacgggccgacacccgaactcgaggaagagatgttcaaaaagagaaacctgaccattatggatcttcaccctggctctggaaaaacacggaagtacctgcccgccatcgtgcgcgaagcgattaagagacggctcagaaccctgatcctcgcccctacgcgcgttgtggctgccgagatggaggaagctctgaaaggccttcccatccggtatcaaacaaccgccaccaagagcgagcatacagggagagaaattgtcgacctgatgtgccacgccacctttacaatgcgcctgctctcccctgtgcgggttccgaattacaacctgatcattatggatgaggctcatttcaccgaccccgcgtctatcgccgctagaggatacattagcacgcgcgtgggcatgggggaagccgccgctatctttatgacagccacccctcccggaacagcggatgctttccctcagtccaatgcccccatccaggacgaggagcgggacattccggaaagatcttggaacagcggcaatgagtggatcaccgattttgccgggaaaacggtctggttcgtgccttccattaaggctggcaacgacatcgccaactgtcttcgcaaaaatggaaagaaggtgattcagctgtctcggaaaacctttgatacagaatatcaaaagaccaaactcaacgactgggatttcgtcgttacaaccgacatcagcgagatgggcgcgaattttaaggccgatagagtgattgacccccggcgctgcctgaaacccgtgatcctgacagatgggcctgagagagtcatcctcgctggacccatgcctgtgaccgccgcttccgccgctcagcggcgcggcagagttgggcggaacccgcagaaggaaaatgaccagtacattttcacgggacaaccccttaacaatgatgaggaccacgcccattggacagaagcgaagatgctgctggacaacatcaatacccctgagggcattatccccgccctcttcgaacctgagagagagaaaagcgctgccattgatggggaatatcgcctgaagggcgagtctcggaaaacctttgtggaacttatgagacgcggagacctgcccgtctggctcgctcacaaggtggcctccgagggcatcaaatacacagatcggaagtggtgcttcgacgggcagagaaacaatcagatcctggaagagaacatggatgttgagatttggaccaaagaaggagagaagaagaaactgcgcccgcggtggctcgacgccagaacatatagcgatcctcttgctctgaaggaatttaaagacttcgcggccggccgcaagtctatcgctctggatctcgtgacggagattgggagagtcccctcccacctggcccatcggacccgcaatgcccttgacaacctggtgatgctccacacaagcgaacatggaggcaaagcttacagacacgccgtcgaggagctgcctgaaaccatggagacactgctccttctgggcctgatgatcctcctgaccgggggagcgatgctttttctgatttccggcaaggggatcggaaagacgtctatcggcctcatttgtgtgatcgccagctccgggatgctgtggatggctgaaattcccctgcagtggatcgccagcgctattgttctcgagttctttatgatggtgcttctgatccctgagcccgaaaaacaacggaccccgcaggataatcagctggcctatgtggtcattggaatcctcacactggcggccatcattgctgccaacgagatgggccttctggaaaccacaaagcgcgacctcggcatgtctaaagagcctggggttgtgtcccccaccagctacctggatgtggacctgcaccccgcttctgcctggacgctctacgctgtcgccacaaccgtgatcacacctatgcttagacataccattgaaaatagcaccgcgaacgtttccctggccgctatcgccaaccaagctgtggtcctgatgggactcgacaagggctggccgatttctaaaatggatctgggggtgccccttctggccctcggatgctatagccaggtcaatcctctgacactgacggccgcggtgctccttctgatcacccactacgctatcattggccccgggctgcaggccaaggctacacgggaggcccagaagagaaccgccgctggaatcatgaaaaaccctacagttgacggcattatgaccatcgatctcgaccccgtgatttatgattccaagttcgagaaacaactgggccaggtcatgcttctggtgctctgtgccgttcagctgctgctcatgcgcacgtcttgggcgctttgcgaagccctgacactggctaccgggcctatcaccacactctgggagggaagcccgggcaagttttggaataccacaatcgccgtgtccatggctaacattttccgggggagctacctggccggagcgggccttgccttttctatcatgaaatccgtcgggacgggaaagagaggcaccggcagccagggggaaacactgggagagaagtggaaaaagaaactcaatcaactgtcccgcaaggaattcgacctgtataaaaagtctggcattaccgaggtggatcggacagaggctaaagaagggctcaagagaggagagatcacccatcacgccgtgagccggggctccgctaagcttcagtggtttgttgaacgcaacatggtcattcccgaggggagagtgatcgacctgggatgtggccggggcgggtggtcttactattgcgccggactgaaaaaggtgacggaagtccgcggctacaccaaagggggacctggccatgaggagcccgttcctatgagcacatacgggtggaatattgtgaagctcatgtccggaaaagatgtgttctatctgcccccggaaaagtgtgacacccttctgtgcgatatcggcgagagctctccttcccccacagtcgaagagagcagaaccatccgggtgctcaagatggttgagccctggctgaaaaacaatcagttctgtattaaggtgctgaacccttacatgcccacagtcatcgaacacctcgagcgccttcagagaaaacacggcgggatgctggtgcggaatcctctgtctcgcaactccacccatgaaatgtattggattagcaatggaacgggcaacatcgttgcttctgtgaatatggtcagcagactcctgcttaaccggtttacaatgacccacagacgcccgaccattgagaaggacgtggatctgggggccggaacacggcatgtgaacgcggaacccgagacgcctaatatggacgtcatcggcgagagaatcaaacgcattaaggaagagcacaactccacctggcactacgacgatgaaaatccctataagacatgggcctaccatgggtcttatgaggttaaagctaccggaagcgcctccagcatgatcaacggcgtggtgaagctcctgacaaaaccttgggacgtcgtgcccatggttacccaaatggctatgacagataccacgccgttcggccagcagcgggtgtttaaggaaaaagtcgacaccagaacacctcgctccatgcccgggacccggagagtgatgggaattacagccgagtggctgtggcgcaccctcggccggaataagaagcctagactgtgcacgcgcgaggaattcacaaaaaaggttcggaccaacgccgcgatgggggctgtgtttacagaggaaaatcaatgggattctgccaaagccgctgtcgaggacgaagatttctggaagcttgtggacagagagcgcgagctgcacaaactcggaaagtgtggcagctgcgtttacaacatgatggggaaaagagaaaagaagctgggcgagtttggaaaagccaagggctcccgggctatctggtacatgtggcttggggcccgctatctggaattcgaggcgctcggatttctgaatgaggatcattggttctctagagaaaacagctactccggcgtggagggggaaggactgcacaaactcggctatattctgcgggacatctctaagatccccgggggcgccatgtacgctgatgacaccgccggatgggacacgagaattaccgaggatgaccttcataatgaagagaaaatcacacagcagatggatcctgagcaccggcagctggctaacgccatttttaagctcacctatcaaaataaggtcgtgaaagtccagcgccccacaccgaccggcacagtgatggacatcattagcagaaaggatcagcgggggtccggacaggttggcacctacgggctgaacacgttcacaaatatggaagcgcaacttatccgccagatggagggagaaggcgtgctgaccaaagccgacctcgagaaccctcacctgagcgaaaagaaaatcacccagtggctggagacaaagggggtcgagagactcaagcggatggctatttctggcgatgactgcgtggtgaaacccatcgatgaccgctttgccaacgctctgcttgccctgaatgatatgggaaaggttagaaaagacattccccagtggcaaccttccaagggctggcatgattggcagcaggtgccgttctgtagccaccatttccacgaactcatcatgaaagacgggcggaagctggtcgtgccctgccgccctcaggacgagcttattggaagagctcggatctctcaaggcgccgggtggtccctgcgcgaaaccgcgtgtctcggaaaggcctatgctcagatgtggagcctgatgtactttcacagacgggatctgcgcctcgcctctaacgccatttgctccgctgttcccgtgcattgggtccctacaagcagaacgacctggtccatccacgcccatcaccagtggatgacaaccgaggacatgctgacagtgtggaatcgggtctggatcgaagataacccctggatggaggacaaaacccctgtgacgacctgggagaatgttccctaccttggcaagagagaagatcaatggtgtgggagcctgattggcctcacatctcgcgcgacctgggctcagaacatcccgacagccattcagcaggtgcggagcctgatcggaaatgaggaattccttgactatatgccttccatgaaaagatttcgcaaggaggaggaatctgagggcgccatttggtga

SEQ ID NO: 20712 - RNA, 9873 nt, synthetic construct
  misc_feature 1..9873: note = derived and/or modified CDS sequence (opt5) from DENV-3__FJ390372__SS-prME
  source 1..9873: mol_type = other RNA
accagcctgtgcctcatgatggtgctgcccgccgctcttgccttccacctgacatccagagacggcgagcctcggatgatcgtcgggaagaacgaacgcggaaaatctctcctgtttaagacggcgagcggcattaatatgtgtacccttatcgctatggatctgggggagatgtgcgacgatacagttacctacaaatgtccgcatattacagaagtggagcccgaagacatcgattgctggtgtaacctcacctccacatgggtgacctatggaacgtgcaatcaggccggcgagcacagacgggacaagcgctctgtcgccctggctcctcatgtggggatgggactggataccagaacacaaacctggatgagcgccgagggcgcttggcggcaggttgaaaaagtggagacatgggccctccgccaccccggcttcaccattctggcgctttttctggcccattacatcgggacgtccctcacacagaaggtcgtgatcttcattctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacaactggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcagaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgccccctgtaaaatccctttcagcaccgaggacggccaagggaaggcgcataacggaagactgattacagctaatcccgtggtcaccaaaaaggaggaacccgtgaacatcgaggccgaacctccgttcggcgagtccaatattgtgatcgggattggcgataacgccctgaaaatcaattggtataagaagggatctagcatcggcaaaatgtttgaagctacggcccggggggctagacgcatggccattcttggagacacagcgtgggatttcggctccgttgggggagtcctcaacagcctgggcaagatggtgcaccagatctttgggtctgcctacaccgctctgttctccggcgtgagctgggtcatgaaaattggaatcggcgtgctcctgacctggattgggcttaattctaagaacacaagcatgtccttttcttgcatcgccattggagttatcaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagcggattcccccaagcggctggccacagctatcgccggcgcttgggagaatggagtctgtggcattagaagcaccacacgcatggaaaaccttctctggaaacagatcgccaatgagctgaactatattctgtgggaaaataacatcaagctcaccgtggttgtgggggacatcattggagtcctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtgtgggaagtcgaggactatggctttggcgttttcacaaccaatatttggctcaaactgcgcgaagtgtacacgcagctgtgtgaccaccggcttatgagcgctgccgtgaaggatgagagagccgtccacgctgacatggggtactggatcgagtcccagaaaaacggatcttggaagctcgaaaaagccagcctgatcgaggtgaagacatgcacctggcctaagtcccataccctgtggtctaatggcgttctcgaaagcgatatgattatccccaaatccctggcggggcctattagccagcacaaccatcgccccggatatcacacacaaaccgctggcccttggcaccttgggaagctggagctcgactttaattactgcgagggaacgacagtggtcatcaccgaaaactgtggcacacggggcccctctctgagaaccacaaccgtgtccgggaaactgattcatgagtggtgctgtcgcagctgcacgcttccgcctctccggtatatgggagaagatggctgttggtacgggatggagatcagacccatctctgaaaaggaggagaatatggttaaatccctggtgagcgccggatctggcaaggtcgacaacttcaccatgggggtgctgtgcctcgccattctgtttgaagaggttatgcggggaaagttcggcaaaaagcacatgatcgctggcgtgttctttacattcgtccttctgctcagcgggcagattacctggcgcgatatggcccatacactgatcatgattggatccaatgcgagcgacagaatgggcatgggggtgacctatctggctcttatcgccacgtttaaaattcagcccttcctggccctcggatttttcctgcggaagctcacatctagagaaaacctgcttctgggcgtggggctcgctatggccaccacactgcaactgcctgaggatatcgaacagatggctaatggaatcgcccttggcctgatggcgctcaaactgattacccagtttgagacctaccagctctggacagccctgatctcccttacgtgtagcaacaccatgttcacactgaccgtcgcttggcgcacagccaccctcattctggctggcgtttccctgcttccggtgtgccaatctagctccatgcggaagacggactggctgcccatggccgtggccgctatgggggtccctcccctccctctgtttatcttctctctcaaggatacactgaaaagacgcagctggccccttaatgagggagtgatggcggttggcctggtgtccattctggcctctagcctcctgagaaacgacgtccctatggctgggccccttgtggccggaggcctgctcatcgcctgttatgttatcaccgggacctccgctgatctgacagtggaaaaggccgcggacattacctgggaggaagaggctgaacagacaggagtcagccacaacctcatgatcacggtggacgatgacggcaccatgcggattaaagatgacgagacagagaatatcctgaccgtccttctgaagacagccctgctcattgtgtctggcgtttttccgtactccatccctgccaccctgcttgtgtggcatacgtggcagaaacagacccaacgcagcggggtcctgtgggatgtgccctctcctcccgaaacacagaaggctgagctcgaagagggagtttacagaatcaaacagcagggcattttcgggaagacccaagtgggagtcggcgtgcagaaggagggggtgtttcacacaatgtggcacgttacccggggagccgtcctgacatataacggcaaacgcctcgaaccgaattgggcgtccgtgaagaaagacctgatcagctacggcgggggatggagactttctgctcagtggcaaaagggcgaggaagtgcaggtcattgccgtggagcctgggaaaaaccccaagaatttccagacgatgcctggaaccttccagacaaccaccggcgaaatcggggccattgctctggattttaagcccggaacatccggcagccccatcattaaccgggagggcaaagttgtggggctgtatggaaatggcgtcgtgacgaagaacgggggatacgtttccggcatcgcccaaaccaatgctgagcctgacgggccgacacccgaactcgaggaagagatgttcaaaaagcgcaacctgaccatcatggatcttcatcctggcagcggaaaaacaagaaagtatctgcccgccattgtgcgggaagcgatcaagcgcagactccggaccctgattctcgcccctacgagagtcgtggctgccgagatggaggaagctctgaaaggccttcccatccgctaccagacaaccgccaccaagtctgagcacacagggcgggaaattgttgacctgatgtgccatgccacctttacaatgagactgctcagccctgtgcgcgtcccgaattataacctgatcatcatggatgaggctcacttcaccgaccccgcgtccattgccgctcggggatacatctctacgagagtgggcatgggggaagccgccgctatttttatgacagccacccctcccggaacagcggatgctttccctcagagcaatgcccccatccaggacgaggagaaagacattccggaacgctcctggaactctggcaatgagtggatcaccgattttgccgggaagacggtgtggttcgtccctagcatcaaagctggcaacgacattgccaactgtcttcggaagaatggaaagaaagttatccaactgtccagaaagacctttgatacagaataccagaaaaccaagctcaacgactgggatttcgtggtgacaaccgacatttctgagatgggcgcgaattttaaagccgatcgcgtcatcgacccccggagatgcctgaagcccgtgattctgacagatgggcctgagcgggttatcctcgctggacccatgcctgtgaccgccgctagcgccgctcagcgcagaggccgggtcgggcgcaacccgcagaaggaaaatgaccaatatattttcacgggacagccccttaacaatgatgaggaccatgcccactggacagaagcgaaaatgctgctggacaacatcaatacccctgagggcatcattcccgccctcttcgaacctgagagagagaagtccgctgccatcgatggggaataccggctgaaaggcgagagcagaaagacctttgtggaacttatgcgccggggagacctgcccgtttggctcgctcacaaagtggcctctgagggcattaagtatacagatagaaaatggtgcttcgacgggcagcgcaacaatcagatcctggaagagaacatggatgtcgagatttggaccaaggaaggagagaagaaaaagctgcggccgagatggctcgacgcccgcacatactccgatcctcttgctctgaaagaatttaaggacttcgcggccggccggaaaagcatcgctctggatctcgtgacggagatcgggagagtcccctctcatctggcccaccgcaccagaaatgcccttgacaacctggtgatgctccatacatccgaacacggaggccgggcttatcgccacgccgttgaggagctgcctgaaaccatggagacactgctccttctgggcctgatgattctcctgaccgggggagcgatgctttttctgatcagcggcaaggggattggaaagacgtccatcggcctcatttgtgtgatcgcctctagcgggatgctgtggatggctgaaatccccctgcaatggattgcctccgctatcgtgctcgagttctttatgatggtccttctgattcctgagcccgaaaaacagagaaccccgcaggataatcaactggcctacgttgtgatcggaattctcacactggcggccatcattgctgccaacgagatgggccttctggaaaccacaaagcgggacctcggcatgagcaaagagcctggggtggtctctcccacctcctatctggatgtggacctgcatcccgctagcgcctggacgctctacgctgttgccacaaccgtgatcacacctatgcttcgccacaccatcgaaaattctaccgcgaacgtcagcctggccgctattgccaaccaggctgtggtcctgatgggactcgacaagggctggccgatctccaaaatggatctgggggtgccccttctggccctcggatgctactctcaggttaatcctctgacactgacggccgcggtgctccttctgattacccattatgctatcattggccccgggctgcaggccaaggctacaagagaggcccaaaagcggaccgccgctggaatcatgaaaaaccctacagtcgacggcatcatgaccattgatctcgaccccgtgatctacgatagcaagttcgagaaacagctgggccaggttatgcttctggtgctctgtgccgtccagctgctgctcatgagaacgtcctgggcgctttgcgaagccctgacactggctaccgggcctattaccacactctgggagggatctccgggcaagttttggaataccacaatcgccgtgagcatggctaacattttccgcgggtcctatctggccggagcgggccttgcctttagcatcatgaaatctgtggggacgggaaagcggggcaccggctcccaaggggaaacactgggagagaagtggaaaaagaaactcaatcagctgagcagaaaggaattcgacctgtacaaaaagtccggcatcaccgaggttgatcgcacagaggctaaagaagggctcaagcggggagagaccacgcaccatgccgtctctagaggcaccgctaagcttcagtggtttgtggaacggaacatggtgattcccgaggggcgcgtcatcgacctgggatgtggcagaggcgggtggagctattactgcgccggactgaaaaaggttacagaagtgcggggctataccaaagggggacctggccacgaggagcccgtgcctatgtccacatacgggtggaatattgtcaagctcatgtctggaaaagatgtgttctacctgcccccggaaaagtgtgacacccttctgtgcgatatcggcgagagctcccctagccccacagttgaagagtctcgcaccattagagtgctcaagatggtcgagccctggctgaaaaacaatcagttctgtatcaaggtgctgaacccttatatgcccacggttattgaacacctcgagcggcttcaacgcaaacatggcgggatgctggtgagaaatcctctgtcccggaacagcacacacgaaatgtactggatctctaatggaaccggcaacatcgtcgcttccgtgaatatggtgagccgcctcctgcttaacagatttaccatgacacatcggagaccgacgattgagaaggacgtcgatctgggggccggaacccgccacgttaacgcggaacccgagacacctaatatggacgtgatcggcgagcggattaaaagaatcaaggaagagcacaactctacctggcattatgacgatgaaaatccctacaagacatgggcctatcacgggagctacgaggtgaaagctaccggatccgcctctagcatgattaacggcgtcgtgaagctcctgacaaaaccttgggacgttgtgcccatggtcacccagatggctatgacggataccacaccgttcggccatcagcgcgtgtttaaggaaaaagttgacacccggacacctagatccatgcccgggcctcgccgggccatgggaatcaccgccgagtggctgtggagaacgctcggccgcaataagaagccccggctgtgcacaagagaggaattcaccaaaaaggggcgcacaaacgcggctatgggagccgtgtttaccgaggaaaatcaatgggatagcgccaaagctgccgtcgaggacgaagatttctggaagcttgtggaccgggagagagagctgcacaaactcggcaagtgtgggtcctgcgtttataacatgatgggcaaacgcgaaaagaagctgggagagtttggcaaagctaaggggtctagagccatctggtacatgtggcttggagcgcggtacctggaattcgaggccctcggctttctgaatgaggatcattggttcagccgcgaaaactcctattctggggtggagggagaaggcctgcacaaactcgggtacattctgagagacatcagcaagattcctggcggagctatgtatgccgatgctacggccggctgggacacccggatcacagaggacgatcttcacaatgaagagaaaattacccagcagatggaccccgatcatagacagctggcgacagccatctttaagctcacctaccaaaacaaggtcgtgaaagtccagcggccgacacctaccgggacggtgatggacatcatttcccgcaaggatcagagaggatctggccaggttgggacatatggactgaataccttcaccaacatggaggctcaacttatccggcagatggaaggcgagggggtgctgagcaaagccgacctcgaaaatccccacctgcccgagaagaaaattacacagtggctggaaaccaagggcgtcgagcgcctcagacggatggctatctccggagatgactgcgtggtgaagcctattgatgaccgctttgccaacgctctgcttgccctgaacgatatgggcaaagttagaaaggacatcccgcagtggcaacccagcaaagggtggcatgattggcagcaggtgcctttctgttctcaccacttccatgagctcatcatgaaggacggacggaaactggtcgtgccctgccgccctcaggacgaacttattggcagagcgcggatctcccaaggggccggatggagcctgcgcgagacagcttgtctcggcaaggcctacgcccagatgtggtctctgatgtattttcacagacgggatctgcgcctcgcttccaatgccatttgcagcgcggttcccgtgcattgggtccctacgtctagaaccacatggtccatccacgctcatcaccagtggatgaccacagaagacatgctgaccgtgtggaaccgggtctggattgaggataatccctggatggaagacaagacgccggtgaccacatgggagaacgttccttaccttgggaaaagagaggatcaatggtgtggcagcctgatcggactcacctcccgcgccacatgggcccagaatattcccaccgctatccagcaggtgcggagcctgatcggcaacgaagagttccttgactacatgccttctatgaagagatttcgcaaagaagaggagagcgaaggggccatttggtga

SEQ ID NO: 20713 - RNA, 9873 nt, synthetic construct
  misc_feature 1..9873: note = derived and/or modified CDS sequence (opt5) from DENV-3__FJ205870__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacacttattgctatggatctgggggaaatgtgcgacgatacagtcacctacaaatgtccgcatatcgccgaagttgaacccgaagacattgattgctggtgtaacctcacatccacctgggtgacatatggaacctgcaatcaggccggcgagcacagacgggacaagcgctctgtggctctggcccctcatgtcgggatgggactggatacgagaacccagacatggatgagcgctgagggcgcctggagacaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccagctggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcagtgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaaaaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggaatcctggagcagggcaaacggacgcttacccctcagcccatggagctgaagtactcttggaaaacatgggggaaggccaagattgtgaccgctgaaacacaaaactccagcttcatcatcgatggacctaatacccccgagtgcccgtctgcgtccagagcctggaacgtctgggaagtggaggactatggctttggcgtgttcacaaccaatatttggctcaaactgcgcgaagtctacacgcagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacatgcacctggcctaagtcccataccctgtggtctaatggcgtcctcgaaagcgatatgatcattcccaaatccctggcggggcctatcagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatttctgaaaaggaggagaatatggtcaaatccctggtgagcgccggatctggcaaggttgacaacttcaccatgggggtgctgtgcctcgccatcctgtttgaagaggtcatgcggggaaagttcggcaaaaagcatatgattgctggcgtgttctttacattcgttcttctgctcagcgggcagatcacctggcgcgatatggcccacacactgattatgatcggatccaatgcgagcgacagaatgggcatgggggtgacctacctggctcttatcgccacgtttaaaattcagcccttcctggccctcggatttttcctgcggaagctcacatctagagaaaacctgcttctgggcgtcgggctcgctatggccaccacactgcaactgcctgaggatatcgaacagatggctaatggaattgcccttggcctgatggcgctcaaactgatcacccagtttgagacctatcagctctggacagccctgatttcccttacgtgtagcaacaccatcttcacactgaccgtggcttggcgcacagccaccctcatcctggctggcgtgtccattctgccggtctgccaatctagctccatgcggaagtctgactggcttcccatgacggttgccgccatgggggtgcctcccctgcctctctttatcttcagcctgaaggatacactcaaaagacgctcctggcccctgaatgagggagtgatggctgtcggccttgtgtctattctggcgagctccctgctcagaaacgacgttcctatggccgggcccctggtggctggaggccttctgatcgcctgttacgtcattaccgggaccagcgccgatctcacagtggaaaaggctgccgacgttacctgggaggaagaggcggaacagacaggagtgtctcataacctgatgatcacggtcgacgatgacggcaccatgcggatcaaagatgacgagacagagaatattctcaccgtgctgcttaagacagctctgctgatcgtctccggcatttttccgtacagcatccctgccaccctcctggtgtggcacacgtggcagaaacagacccgcagatctggggttctttgggatgtgccctcccctcccgaaacacaaaaggccgagctggaagagggagtctatcggattaaacagcagggcatcttcgggaagacccaggtgggagttggcgtgcaaaaggagggggtctttcatacaatgtggcacgtgacccgcggagctgtgctcacatacaacggcaaaagactggaaccgaattgggccagcgttaagaaagacctcatttcttatggcgggggatggcggctgtccgcgcagtggcagaagggcgaggaagtccaagtgatcgctgtggagcctgggaaaaaccccaagaatttccagacgatgcctggaaccttccagacaaccaccggcgaaatcggggccattgcccttgattttaagcccggaacaagcggctcccccatcattaaccgcgagggcaaagtcgtggggctgtacggaaatggcgttgtgacgaagaacgggggatatgtcagcggcatcgctcagaccaatgccgagcctgacgggccgacacccgaactggaggaagagatgttcaaaaagagaaacctcaccattatggatctgcaccctggctctggaaaaacacggaagtaccttcccgctatcgtgcgcgaagccatcaagagacggctgagaaccctcattctggcgcctacgcgcgttgtggccgctgagatggaggaagccctcaaaggcctgcccatccggtatcaaacaaccgctaccaagagcgagcatacagggagagaaattgtcgaccttatgtgccacgccacctttacaatgcgcctgctgtcccctgtgcgggttccgaattacaacctcatcattatggatgaggcccatttcaccgaccccgcttctatcgcggccagaggatacatcagcacgcgcgtgggcatgggggaagctgccgccatttttatgacagctacccctcccggaacagccgatgcgttccctcagtccaatgctcccatccaggacgaggagcgggacattccggaaagatcttggaacagcggcaatgagtggatcaccgattttgccgggaaaacggtctggttcgtgccttccattaaggccggcaacgacatcgctaactgtctgcgcaaaaatggaaagaaggtgattcagctttctcggaaaacctttgatacagaatatcaaaagaccaaactgaacgactgggatttcgtcgttacaaccgacatcagcgagatgggcgccaattttaaggcggatagagtgatcgacccccggcgctgcctcaaacccgtgattctgacagatgggcctgagagagtcatcctggccggacccatgcctgtgaccgctgcctccgctgcccagcggcgcggcagagttgggcggaacccgcagaaggaaaatgaccagtacattttcacgggacaacccctcaacaatgatgaggaccacgctcattggacagaagccaagatgcttctggacaacatcaatacccctgagggcattatccccgcgctgttcgaacctgagagagagaaaagcgccgctatcgatggggaatatcgcctcaagggcgagtctcggaaaacctttgtggaactgatgagacgcggagaccttcccgtctggctggcccacaaggtggcttccgagggcattaaatacacagatcggaagtggtgcttcgacgggcagagaaacaatcagatcctcgaagagaacatggatgttgagatttggaccaaagaaggagagaagaagaaactgcgcccgcggtggctggacgccagaacatatagcgatcctctcgcccttaaggaatttaaagacttcgctgcgggccgcaagtctatcgccctggatctggtgacggagattgggagagtcccctcccacctcgctcatcggacccgcaatgccctggacaaccttgtgatgctgcacacaagcgaacatggaggcaaagcctacagacacgctgtcgaggagctccctgaaaccatggagacactgctgctccttggcctgatgatcctgctcaccgggggagccatgctgtttcttatctccggcaaggggattggaaagacgtctatcggcctgatttgtgtgatcgcgagctccgggatgctctggatggccgaaattcccctgcagtggatcgctagcgccattgttctggagttctttatgatggtgctccttatccctgagcccgaaaaacaacggaccccgcaggataatcagctggcttatgtggtcatcggcattctcacactcgccgcgatcattgccgctaacgagatgggactgcttgaaaccacaaagcgcgacctgggcatgtctaaagagcctggggttgtgtcccccaccagctacctcgatgtggacctgcaccccgcctctgcttggacgctgtacgccgtcgctacaaccgtgatcacacctatgctcagacataccattgaaaatagcaccgccaacgtttcccttgcggccatcgctaaccaagccgtggtcctgatgggactggacaagggctggccgatctctaaaatggatctcggggtgcccctgcttgctctgggatgctatagccaggtcaatcctctcacactgacggccgccgtgctgctccttattacccactacgcgatcattggccccgggctgcaggctaaggccacacgggaggctcagaagagaaccgccgccggaatcatgaaaaaccctacagttgacggcattatgaccatcgatctggaccccgtgatctatgattccaagttcgagaaacaactcggccaggtcatgctgcttgtgctgtgtgctgttcagctcctgctgatgcgcacgtcttgggccctctgcgaagcgcttacactggccaccgggcctattaccacactgtgggagggaagcccgggcaagttttggaataccacaatcgctgtgtccatggccaacattttccgggggagctacctcgctggagccggcctggcgttttctatcatgaaatccgtcgggacgggaaagagaggcaccggcagccagggggaaacacttggagagaagtggaaaaagaaactgaatcaactctcccgcaaggagttcgacctgtataaaaagtctggcattaccgaggtggatcggacagaggccaaagaagggctgaagagaggagagatcacccatcacgctgtgagccggggctccgccaagctccagtggtttgttgaacgcaacatggtcattcccgaggggagagtgatcgaccttggatgtggccggggcgggtggtcttactattgcgctggactgaaaaaggtgacggaagtccgcggctacaccaaagggggacctggccatgaggagcccgttcctatgagcacatacgggtggaatatcgtgaagctgatgtccggaaaagatgtgttctatctgcccccggaaaagtgtgacaccctgctttgcgatattggcgagagctctccttcccccacagtcgaagagagcagaaccatccgggtgctgaagatggttgagccctggctcaaaaacaatcagttctgtattaaggtgctgaacccttacatgcccacagtcatcgaacacctggagcgcctccagagaaaacacggcgggatgcttgtgcggaatcctctgtctcgcaactccacccatgaaatgtattggattagcaatggaacgggcaacatcgttgcctctgtgaatatggtcagcagactgctcctgaaccggtttacaatgacccacagacgcccgaccatcgagaaggacgtggatcttggggctggaacacggcatgtgaacgccgaacccgagacgcctaatatggacgtcattggcgagagaatcaaacgcattaaggaagaacacaactccacctggcactacgacgatgaaaatccctataagacatgggcgtaccatgggtcttatgaggttaaagccaccggaagcgcttccagcatgatcaacggcgtggtgaagctgctcacaaaaccttgggacgtcgtgcccatggttacccaaatggccatgacagataccacgccgttcggccagcagcgggtgtttaaggaaaaagtcgacaccagaacacctcgctccatgcccgggacccggagagtgatgggaattacagctgagtggctgtggcgcaccctgggccggaataagaagcctagactctgcacgcgcgaggagttcaccaaaaaggttcggaccaacgccgccatgggggcggtgtttacagaggaaaatcaatgggattctgctaaagccgccgtcgaggacgaagatttctggaagctggtggacagagagcgcgagcttcacaaactgggaaagtgtggcagctgcgtttacaacatgatggggaaaagagaaaagaagctcggcgagtttggaaaagctaagggctcccgggccatctggtacatgtggctgggggctcgctatcttgagttcgaggccctgggatttctcaatgaggatcattggttctctagagaaaacagctactccggcgtggagggggaaggactgcccaaactgggctatatcctccgggacatttctaagatccctgggggcgcgatgtacgccgatgacaccgctggatgggacacgagaattaccgaggatgacctgcacaatgaagagaaaatcacacagcagatggatcccgagcatcggcagcttgccaacgctatttttaagctgacctatcaaaataaggtcgtgaaagtccagcgcccgacacctaccggcacagtgatggacatcatcagcagaaaggatcagcgggggtccggacaggttggcacctacgggctcaacacgttcacaaatatggaagcccaactgattcgccagatggagggagaaggcgtgcttagcaaagcggacctggagaacccccacctctctgaaaagaaaatcacccagtggctggagaccaagggggtcgagagactgaagcggatggccatttccggcgatgactgcgtggtgaaacccatcgatgaccgctttgctaacgccctcctggctcttaatgatatgggaaaggttagaaaagacattcctcagtggcaaccgagcaagggctggcacgattggcaacaggtgcccttctgttctcatcacttccatgaactgatcatgaaagacgggcggaagctcgtcgtgccttgccgcccccaggacgagctgattggacgggcccggatctcccaaggcgctgggtggagccttcgcgaaacagcctgtctgggaaaggcgtatgcccagatgtggtctctcatgtactttcacagacgggatctgcgcctggcttccaacgccatctgcagcgccgttcctgtgcactgggtccccacctccagaacaacgtggagcattcatgctcaccatcagtggatgaccacagaggacatgctcaccgtgtggaatcgggtctggatcgaagataacccttggatggaggacaaaacacccgtgaccacgtgggagaatgttccgtacctgggcaagagagaagatcaatggtgtgggtctcttattggcctgaccagccgcgccacatgggcgcagaacatccctaccgctattcaacaggtgcggtccctcatcggaaatgaggagttcctggactatatgccctctatgaaaagatttcgcaaggaggaggaaagcgagggcgccatctggtga

SEQ ID NO: 20714 - RNA, 9873 nt, synthetic construct
  misc_feature 1..9873: note = derived and/or modified CDS sequence (opt5) from DENV-3__FJ390373__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggcagagggaaggcccataacggacggctgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcccgccggatggctatccttggagacacagcctgggatttcggctccgttgggggagtcctcaacagcctgggcaagatggtgcaccaaatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaggccgattcccccaagagactggcgacagccatcgctggcgcctgggagaatggagtgtgtggcattcgcagcaccacacggatggaaaaccttctctggaaacaaatcgctaatgagctgaactatatcctgtgggaaaataacattaagctcaccgtcgtggttggggacacgatcggagtgctggagcagggcaaaagaacccttacacctcagcccatggagctgaagtactcttggaaaacctgggggaaggccaagattgtcacagccgaaacccagaactccagcttcatcattgatggacctaatacacccgagtgcccgtctgcttcccgcgcgtggaacgtgtgggaagtggaggactatggctttggcgtcttcaccacgaatatctggctcaaactgcgggaagtttacacacaactgtgtgaccacagacttatgagcgccgctgtgaaggatgagcgcgccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcggcccggataccatacccagacggcgggcccttggcaccttgggaagctggagctcgactttaattattgcgagggaacaaccgttgtgattacagaaaactgtggcaccagaggcccctctctgcgcacaaccacggtctccgggaaactgatccacgagtggtgctgtcggagctgcacccttccgcctctcagatacatgggagaagatggctgttggtatgggatggagatccggcccatttctgaaaaggaggagaatatggtgaaatccctggttagcgctggatctggcaaggtggacaacttcacaatgggggtcctgtgcctcgccatcctgtttgaagaggtgatgcgcggaaagttcggcaaaaagcatatgattgccggcgttttctttaccttcgtgcttctgctcagcgggcaaatcacatggagagatatggctcacaccctgattatgatcggatccaatgccagcgaccggatgggcatgggggtcacgtacctggcgcttattgctacatttaaaatccagcccttcctggccctcggatttttcctgagaaagctcacctctcgcgaaaacctgcttctgggcgtggggctcgccatggctacaaccctgcagctgcctgaggatatcgaacaaatggccaatggaattgctcttggcctgatggccctcaaactgaccacacagtttgagacgtatcagctctggaccgcgctgatctcccttacatgtagcaacaccattttcacactgaccgtggcctggcggacggctacactcatcctggccggcgtctccctgcttccggtttgccagtctagctccatgagaaagaccgactggctgcccatgaccgtggctgccatgggggtgcctcccctccctctgtttattttctctctcaaggatacactgaaacgcagaagctggccccttaatgagggagtcatggccgtgggcctggtttccatcctggcttctagcctcctgcggaacgacgtgcctatggcggggccccttgtcgccggaggcctgctcatcgcttgttacgtgattaccgggacatccgccgatctgacggttgaaaaggccgctgacgtgacctgggaggaagaggccgaacaaacaggagtcagccataacctcatgatcaccgtggacgatgacggcacaatgcgcattaaagatgacgagaccgagaatatcctgacggtccttctgaagaccgcgctgctcattgtgtctggcatctttccgtactccatccctgctacactgcttgtttggcacacctggcagaaacagacacagagaagcggggtgctgtgggatgtcccctctcctcccgaaacccaaaaggccgagctcgaagagggagtgtatcggattaaacagcagggcatcttcgggaagacacaggttggagtgggcgtccaaaaggagggggtgtttcatacgatgtggcacgtgacccgcggagccgttctgacatacaacggcaaaagactcgaaccgaattgggcttccgtcaagaaagacctgattagctatggcgggggatggcggctttctgcccagtggcagaagggcgaggaagtgcaagtgatcgcggtcgagcctgggaaaaaccccaagaatttccagaccatgcctggaaccttccagacaacgaccggcgaaattggggctatcgccctggattttaagcccggaacatccggcagccccattatcaaccgcgagggcaaagtggttgggctgtacggaaatggcgtggtcaccaagaacgggggatatgtgtccggcatcgcccagacaaatgctgagcctgacgggccgacccccgaactcgaggaagagatgttcaaaaagagaaacctgacgattatggatcttcaccctggcagcggaaaaacacggaagtacctgcccgccatcgttcgcgaagctattaagagacggctcagaaccctgatcctcgcccctacccgcgtggtcgcggccgagatggaggaagctctgaaaggccttcccattcggtatcaaacaaccgccacaaagtctgagcataccgggagagaaatcgtggacctgatgtgccacgctacgtttacaatgcgcctgctcagccctgttcgggtgccgaattacaacctgatcattatggatgaggcccatttcaccgaccccgcctccatcgctgcgagaggatacatttctacacgcgtcggcatgggggaagccgctgccatctttatgaccgccacgcctcccggaaccgctgatgccttccctcagagcaatgcgcccattcaggacgaggagcgggacatcccggaaagatcctggaactctggcaatgagtggatcacagattttgctgggaaaaccgtgtggttcgtgcctagcattaaggccggcaacgacatcgccaactgtcttcgcaaaaatggaaagaaggtcattcagctgtcccggaaaacatttgataccgaatatcaaaagacaaaactcaacgactgggatttcgttgtgaccacggacatctctgagatgggcgctaattttaaggccgatagagtgattgacccccggcgctgcctgaaacccgtcatcctgacagatgggcctgagagagtgattctcgcgggacccatgcctgttaccgccgctagcgccgctcagcggcgcggcagagtggggcggaacccgcagaaggaaaatgaccagtacatcttcaccggacaaccccttaacaatgatgaggaccacgcccattggacagaagctaagatgctgctggacaacatcaatacccctgagggcattatccccgccctcttcgaacctgagagagagaaatccgcggccattgatggggaatatcgcctgaagggcgagagccggaaaacatttgtcgaacttatgagacgcggagctctgcccgtgtggctcgcccacaaggttgcttctgagggcatcaaatacacggaccggaagtggtgcttcgatgggcagagaaacaatcagattctggaagagaacatggacgtggagatctggaccaaagaaggagagaagaagaaactgcgcccgcggtggctcgatgccagaacatattccgaccctcttgccctgaaggaatttaaagatttcgctgcgggccgcaagagcatcgccctggacctcgtcaccgagattgggagagtgccctctcacctggctcatcggacacgcaatgcccttgataacctggtcatgctccacacctccgaacatggaggcaaagcctacagacacgctgtggaggagctgcctgaaacgatggagaccctgctccttctgggcctgatgatcctcctgacagggggagccatgctttttctgattagcggcaaggggatcggaaagacctccattggcctcatctgtgttatcgcgtctagcgggatgctgtggatggccgaaattcccctgcagtggatcgcttccgccattgtgctcgagttctttatgatggtgcttctgatccctgagcccgaaaaacaacggacaccgcaggacaatcagctggcttatgtcgttattggaatcctcaccctggccgcgattatcgccgctaacgagatgggccttctggaaacgacaaagcgcgatctcggcatgagcaaagagcctggggtggtgtctcccacctcctacctggacgtcgatctgcaccccgccagcgcttggacactctacgccgtggctaccaccgttatcacacctatgcttagacatacgattgaaaattctaccgccaacgtgagcctggcggccatcgctaaccaagccgtcgtgctgatgggactcgacaagggctggccgatttccaaaatggacctgggggtcccccttctggctctcggatgctattctcaggtgaatcctctgacactgaccgccgccgttctccttctgatcacacactacgcgattatcggccccgggctgcaggctaaggccacccgggaggctcagaagagaacggccgccggaatcatgaaaaaccctacagtggatggcattatgaccatcgacctcgatcccgtcatttatgacagcaagttcgagaaacaactgggccaggtgatgcttctggttctctgtgctgtgcagctgctgctcatgcgcacctcctgggccctttgcgaagcgctgacactggccaccgggcctatcacaacgctctgggagggatctccgggcaagttttggaataccacaattgctgtcagcatggccaacatcttccgggggtcctacctggctggagccggccttgcgtttagcatcatgaaatctgtggggaccggaaagagaggcacaggctcccagggggaaaccctgggagagaagtggaaaaagaaactcaatcaactgagccgcaaggaattcgatctgtataaaaagtccggcattacggaggtggaccggaccgaggccaaagaagggctcaagagaggagagatcacacatcacgctgtttctcggggcagcgccaagcttcagtggtttgtcgaacgcaacatggtgattcccgaggggagagtgatcgatctgggatgtggccggggcgggtggtcctactattgcgctggactgaaaaaggtcaccgaagttcgcggctacacaaaagggggacctggccatgaggagcccgtgcctatgtctacctacgggtggaatattgtgaagctcatgagcggaaaagacgtcttctatctgcccccggaaaagtgtgatacacttctgtgcgacatcggcgagtccagcccttctcccaccgtggaagagtccagaacgattcgggttctcaagatggtggagccctggctgaaaaacaatcagttctgtatcaaggtcctgaacccttacatgcccacagtgatcgaacacctcgagcgccttcagagaaaacacggcgggatgctggttcggaatcctctgagccgcaactctacccatgaaatgtattggatttccaatggaaccggcaacatcgtggccagcgtcaatatggtgtctagactcctgcttaaccggtttacaatgacgcacagacgcccgaccattgagaaggatgtggacctgggggctggaacacggcatgtcaacgccgaacccgagacccctaatatggatgttatcggcgagagaattaaacgcatcaaggaagagcacaacagcacatggcactacgacgacgaaaatccctataagacctgggcgtaccatgggtcctatgaggtgaaagccacaggatctgctagctccatgatcaacggcgtggtcaagctcctgaccaaaccttgggatgtggttcccatggtgacgcaaatggccatgaccgacacaaccccgttcggccagcagcgggtctttaaggaaaaagtggatacaagaacccctcgcagcatgcccgggacgcggagagttatgggaattacagctgagtggctgtggcgcaccctcggccggaataagaagcctagactgtgcacacgcgaggaattcaccaaaaaggtgcggacgaacgccgccatgggggcggtctttaccgaggaaaatcaatgggactccgctaaagccgccgtggaggatgaagacttctggaagcttgttgatagagagcgcgagctgcacaaactcggaaagtgtggctcttgcgtgtacaacatgatggggaaaagagaaaagaagctgggcgagtttggaaaagctaagggcagccgggccatctggtacatgtggcttggggctcgctatctggaattcgaggccctcggatttctgaatgaggaccattggttctccagagaaaactcttacagcggcgtcgagggggaaggactgcacaaactcggctatattctgcgggatatctccaagattcccgggggcgcgatgtacgccgacgatacagctggatgggacaccagaatcacagaggacgatcttcataatgaagagaaaatcacccagcagatggaccctgagcaccggcagctggccaacgctatttttaagctcacatatcaaaataaggtggtcaaagtgcagcgccccaccccgacgggcacagttatggatatcatttctagaaaggaccagcgggggagcggacaggtgggcacctacgggctgaacaccttcacaaatatggaagcccaacttatccgccagatggagggagaaggcgtcctgtccaaagcggatctcgagaaccctcacctgcccgaaaagaaaattacccagtggctggagacaaagggggtggagagactcaagcggatggccatcagcggcgacgattgcgtggttaaacccatcgacgatcgctttgctaacgccctgcttgctctgaatgacatgggaaaggtgagaaaagatattcctcagtggcaaccgtctaagggctggcatgactggcagcaggtccccttctgttcccaccatttccacgaactcatcatgaaagatgggcggaagctggtggttccttgccgcccccaggacgagcttattggaagagcccggatcagccaaggcgctgggtggtctctgcgcgaaacggcctgtctcggaaaggcgtatgcccagatgtggtccctgatgtactttcacagacgggacctgcgcctcgctagcaacgccatttgctctgccgtgcctgtccattgggtgcccacctccagaacaacctggagcatccacgctcatcaccagtggatgacaaccgaggatatgctgacggtctggaatcgggtgtggattgaagacaacccttggatggaggataaaacccccgttacaacctgggagaatgtgccgtaccttggcaagagagaagaccaatggtgtgggtccctgatcggcctcacaagccgcgccacctgggcgcagaacatccctacggctattcagcaggtccggtctctgatcggaaatgaggaattccttgattatatgcccagcatgaaaagatttcgcaaggaggaggaatccgagggcgccatttggtga

SEQ ID NO: 20715 - RNA, 9873 nt, synthetic construct
  misc_feature 1..9873: note = derived and/or modified CDS sequence (opt5) from DENV-3__FJ205871__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggcgagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagcctacacacagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggcggggcctatcagccagcacaactatcgccccggataccatacccaaacggctggcccttggcaccttgggaagctggagctcgactttaattattgcgagggaacaaccgtggttattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggtcaaatccctggtgagcgccggatctggcaaggttgacaacttcacaatgggggtgctgtgcctcgccatcctgtttgaagaggtcatgcggggaaagttcggcaaaaagcatatgattgctggcgtgttctttaccttcgttcttctgctcagcgggcagatcacatggcgcgatatggcccacaccctgattatgatcggatccaatgcgagcgacagaatgggcatgggggtgacgtacctggctcttattgccacatttaaaatccagcccttcctggccctcggatttttcctgcggaagctcacctctagagaaaacctgcttctgggcgtcgggctcgctatggccacaaccctgcaactgcctgaggatatcgaacagatggctaatggaattgcccttggcctgatggcgctcaaactgaccacacagtttgagacgtatcagctctggaccgccctgatctcccttacatgtagcaacaccattttcacactgaccgtggcttggcgcacggccacactcatcctggctggcgtgtccctgcttccggtctgccaatctagctccatgcggaagaccgactggctgcccatgaccgttgccgccatgggggtgcctcccctccctctgtttattttctctctcaaggatacactgaaaagacgcagctggccccttaatgagggagtgatggctgtcggcctggtgtccatcctggcgtctagcctcctgagaaacgacgttcctatggccgggccccttgtggctggaggcctgctcatcgcctgttacgtcattaccgggacatccgccgatctgacggtggaaaaggctgccgacgttacctgggaggaagaggcggaacagacaggagtgagccataacctcatgatcaccgtcgacgatgacggcacaatgcggattaaagatgacgagaccgagaatatcctgacggtgcttctgaagaccgctctgctcattgtctctggcatctttccgtactccatccctgccacactgcttgtgtggcacacctggcagaaacagacacaacgcagcggggttctgtgggatgtgccctctcctcccgaaacccagaaggccgagctcgaagagggagtctatagaattaaacagcagggcatcttcgggaagacacaagtgggagttggcgtgcagaaggagggggtctttcatacgatgtggcacgtgacccggggagctgtgctgacatacaacggcaaacgcctcgaaccgaattgggcctccgttaagaaagacctgattagctatggcgggggatggagactttctgcgcagtggcaaaagggcgaggaagtccaggtgatcgctgtggagcctgggaaaaaccccaagaatttccagaccatgcctggaaccttccagacaacgaccggcgaaattggggccatcgccctggattttaagcccggaacatccggcagccccattatcaaccgggagggcaaagtcgtggggctgtacggaaatggcgttgtgaccaagaacgggggatatgtctccggcatcgctcaaacaaatgccgagcctgacgggccgacccccgaactcgaggaagagatgttcaaaaagcgcaacctgacgattatggatcttcaccctggcagcggaaaaacaagaaagtacctgcccgctatcgtgcgggaagccattaagcgcagactccggaccctgatcctcgcgcctaccagagttgtggccgctgagatggaggaagccctgaaaggccttcccattcgctatcagacaaccgctacaaagtctgagcataccgggcgggaaatcgtcgacctgatgtgccacgccacgtttacaatgagactgctcagccctgtgcgcgttccgaattacaacctgatcattatggatgaggcccatttcaccgaccccgcttccatcgcggcccggggatacatttctacaagagtgggcatgggggaagctgccgccatctttatgaccgctacgcctcccggaaccgccgatgcgttccctcagagcaatgctcccattcaggacgaggagcgcgacatcccggaacggtcctggaactctggcaatgagtggatcacagattttgccgggaaaaccgtctggttcgtgcctagcattaaggccggcaacgacatcgctaactgtcttcgcaaaaatggaaagaaggtgattcaactgtccagaaaaacatttgataccgaatatcagaagacaaaactcaacgactgggatttcgtcgttaccacggacatctctgagatgggcgccaattttaaggcggatcgggtgattgaccccagacggtgcctgaaacccgtgatcctgacagatgggcctgagcgcgtcattctcgccggacccatgcctgtgaccgctgccagcgctgcccagagacggggccgcgttgggagaaacccgcagaaggaaaatgaccaatacatcttcaccggacagccccttaacaatgatgaggaccacgctcattggacagaagccaagatgctgctggacaacatcaatacccctgagggcattatccccgccctcttcgaacctgagcgggagaaatccgccgctattgatggggaatatagactgaagggcgagagccgcaaaacatttgtggaacttatgcggagaggagacctgcccgtctggctcgcccacaaggtggcttctgagggcatcaaatacacggatcgcaagtggtgcttcgacgggcagcggaacaatcagattctggaagagaacatggatgttgagatctggaccaaagaaggagagaagaagaaactgagaccgcgctggctcgacgcccggacatattccgatcctcttgccctgaaggaatttaaagacttcgctgcgggcagaaagagcatcgccctggatctcgtgaccgagattgggcgcgtcccctctcacctggctcatagaacacggaatgcccttgacaacctggtgatgctccacacctccgaacatggaggcaaagcctaccgccacgctgtcgaggagctgcctgaaacgatggagaccctgctccttctgggcctgatgatcctcctgacagggggagccatgctttttctgattagcggcaaggggatcggaaagacctccattggcctcatctgtgtgatcgcgtctagcgggatgctgtggatggccgaaattcccctgcaatggatcgcttccgccattgttctcgagttctttatgatggtgcttctgatccctgagcccgaaaaacagagaacaccgcaggataatcaactggcttatgtggtcattggaatcctcaccctggccgcgattatcgccgctaacgagatgggccttctggaaacgacaaagcgggacctcggcatgagcaaagagcctggggttgtgtctcccacctcctacctggatgtggacctgcaccccgccagcgcttggacactctacgccgtcgctaccaccgtgatcacacctatgcttcgccatacgattgaaaattctaccgccaacgttagcctggcggccatcgctaaccaggccgtggtcctgatgggactcgacaagggctggccgatttccaaaatggatctgggggtgccccttctggctctcggatgctattctcaggtcaatcctctgacactgaccgccgccgtgctccttctgatcacacactacgcgattatcggccccgggctgcaggctaaggccaccagagaggctcaaaagcggacggccgccggaatcatgaaaaaccctacagttgacggcattatgaccatcgatctcgaccccgtgatttatgatagcaagttcgagaaacagctgggccaggtcatgcttctggtgctctgtgctgttcagctgctgctcatgagaacctcctgggccctttgcgaagcgctgacactggccaccgggcctatcacaacgctctgggagggatctccgggcaagttttggaataccacaattgctgtgagcatggccaacatcttccgcgggtcctacctggctggagccggccttgcgtttagcatcatgaaatctgtcgggaccggaaagcggggcacaggctcccaaggggaaaccctgggagagaagtggaaaaagaaactcaatcagctgagcagaaaggagttcgacctgtataaaaagtccggcattacggaggtggatcgcaccgaggccaaagaagggctcaagcggggagagatcacacatcacgctgtgtctagaggcagcgccaaacttcagtggtttgttgaacggaacatggtcattcccgaggggcgcgtgatcgacctgggatgtggcagaggcgggtggtcctactattgcgctggactgaaaaaggtgaccgaagtccggggctacacaaaagggggacctggccatgaggagcccgttcctatgtctacctacgggtggaatattgtgaagctcatgagcggaaaagatgtgttctatctgcccccggaaaagtgtgacacacttctgtgcgatatcggcgagtccagcccttctcccaccgtcgaagagtcccgcacgattagagtgctcaagatggttgagccctggctgaaaaacaatcagttctgtatcaaggtgctgaacccttacatgcccacagtcatcgaacacctcgagcggcttcaacgcaaacacggcgggatgctggtgagaaatcctctgagccggaactctacccatgaaatgtattggatttccaatggaaccggcaacatcgttgccagcgtgaatatggtctctcgcctcctgcttaacagatttacaatgacgcaccggagaccgaccattgagaaggacgtggatctgggggctggaacacgccatgtgaacgccgaacccgagacccctaatatggacgtcatcggcgagcggattaaaagaatcaaggaagaacacaacagcacatggcactacgacgatgaaaatccctataagacctgggcgtaccatgggtcctatgaggttaaagccacaggatctgctagctccatgatcaacggcgtggtgaagctcctgaccaaaccttgggacgtcgtgcccatggttacgcagatggccatgaccgatacaaccccgttcggccagcaacgcgtgtttaaggaaaaagtcgacacacggacccctagaagcatgcccgggacgcgccgggtgatgggaattacagctgagtggctgtggagaaccctcggccgcaataagaagcctcggctgtgcacaagagaggagttcaccaaaaaggttcgcacgaacgccgccatgggggcggtgtttaccgaggaaaatcagtgggattccgctaaagccgccgtcgaggacgaagatttctggaaacttgtggaccgggagagagagctgcacaaactcggaaagtgtggctcttgcgtttacaacatgatggggaaacgcgaaaagaagctgggcgagtttggaaaagctaagggcagcagagccatctggtacatgtggcttggggctcggtatctggagttcgaggccctcggatttctgaatgaggatcattggttctcccgcgaaaactcttacagcggcgtggagggggaaggactgcacaaactcggctatattctgagagacatctccaagattcccgggggcgcgatgtacgccgatgacacagctggatgggacacccggatcacagaggatgaccttcataatgaagagaaaatcacccagcagatggatcctgagcacagacaactggccaacgctatttttaagctcacatatcagaataaggtcgtgaaagtccagcggcccaccccgacgggcacagtgatggacatcatttctcgcaaggatcagagagggagcggacaagttggcacctacgggctgaacaccttcacaaatatggaagcccagcttatccggcagatggagggagaaggcgtgctgtccaaagcggacctcgagaaccctcatctgcccgaaaagaaaattacccagtggctggagacaaagggggtcgagcgcctcaagagaatggccatcagcggcgatgactgcgtggtgaaacccatcgatgaccggtttgctaacgccctgcttgctctgaatgatatgggaaaggttcgcaaagacattcctcaatggcagccgtctaagggctggcatgattggcaacaggtgcccttctgttcccaccatttccacgaactcatcatgaaagacgggagaaagctggtcgtgccttgccggccccaagacgagcttattggacgcgccagaatcagccagggcgctgggtggtctctgcgggaaacggcctgtctcggaaaggcgtatgcccagatgtggtccctgatgtactttcaccgcagagatctgcggctcgctagcaacgccatttgctctgccgttcctgtgcattgggtccccacctcccgcacaacctggagcatccacgctcatcaccaatggatgacaaccgaggacatgctgacggtgtggaatagagtctggattgaagataacccttggatggaggacaaaacccccgtgacaacctgggagaatgttccgtaccttggcaagcgggaagatcagtggtgtgggtccctgatcggcctcacaagcagagccacctgggcgcagaacatccctacggctattcagcaagtgcgctctctgatcggaaatgaggagttccttgactatatgcccagcatgaaacggtttagaaaggaggaggaatccgagggcgccatttggtga

SEQ ID NO: 20716 - RNA, 9873 nt, synthetic construct
  misc_feature 1..9873: note = derived and/or modified CDS sequence (opt5) from DENV-3__FJ390375__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaaaatccagcccttcctggccctcggatttttcctgcggaagctcacctctagagaaaacctgcttctgggcgtggggctcgccatggctacaaccctgcaactgcctgaggatatcgaacagatggccaatggaattgctcttggcctgatggccctcaaactgaccacacagtttgagacgtatcagctctggaccgcgctgatctcccttacatgtagcaacaccattttcacactgaccgtggcctggcgcacggctacactcatcctggccggcgtctccctgcttccggtttgccaatctagctccatgcggaagaccgactggctgcccatgaccgtggctgccatgggggtgcctcccctccctctgtttattttctctctcaaggatacactgaaaagacgcagctggccccttaatgagggagtcatggccgtgggcctggtttccatcctggcttctagcctcctgagaaacgacgtgcctatggcggggccccttgtcgccggaggcctgctcatcgcttgttacgtgattaccgggacatccgccgatctgacggttgaaaaggccgctgacgtgacctgggaggaagaggccgaacagacaggagtcagccataacctcatgatcaccgtggacgatgacggcacaatgcggattaaagatgacgagaccgagaatatcctgacggtccttctgaagaccgcgctgctcattgtgtctggcatctttccgtactccatccctgctacactgcttgtttggcacacctggcagaaacagacacaacgcagcggggtgctgtgggatgtcccctctcctcccgaaacccagaaggccgagctcgaagagggagtgtatagaattaaacagcagggcatcttcgggaagacacaagttggagtgggcgtccagaaggagggggtgtttcatacgatgtggcacgtgacccggggagccgttctgacatacaacggcaaacgcctcgaaccgaattgggcttccgtcaagaaagacctgattagctatggcgggggatggagactttctgcccagtggcaaaagggcgaggaagtccaggtgatcgcggtcgagcctgggaaaaaccccaagaatttccagaccatgcctggaaccttccagacaacgaccggcgaaattggggctatcgccctggattttaagcccggaacatccggcagccccattatcaaccgggagggcaaagtggttgggctgtacggaaatggcgtggtcaccaagaacgggggatatgtgtccggcatcgcccaaacaaatgctgagcctgacgggccgacccccgaactcgaggaagagatgttcaaaaagcgcaacctgacgattatggatcttcaccctggcagcggaaaaacaagaaagtacctgcccgccatcgttcgggaagctattaagcgcagactccggaccctgatcctcgcccctaccagagtggtcgcggccgagatggaggaagctctgaaaggccttcccattcgctatcagacaaccgccacaaagtctgagcataccgggcgggaaatcgtggacctgatgtgccacgctacgtttacaatgagactgctcagccctgttcgcgtgccgaattacaacctgatcattatggatgaggcccatttcaccgaccccgcctccatcgctgcgcggggatacatttctacaagagtcggcatgggggaagccgctgccatctttatgaccgccacgcctcccggaaccgctgatgccttccctcagagcaatgcgcccattcaggacgaggagcgcgacatcccggaacggtcctggaactctggcaatgagtggatcacagattttgctgggaaaaccgtgtggttcgtgcctagcattaaggccggcaacgacatcgccaactgtcttcgcaaaaatggaaagaaggtcattcaactgtccagaaaaacatttgataccgaatatcagaagacaaaactcaacgactgggatttcgttgtgaccacggacatctctgagatgggcgctaattttaaggccgatcgggtgattgaccccagacggtgcctgaaacccgtcatcctgacagatgggcctgagcgcgtgattctcgcgggacccatgcctgttaccgccgctagcgccgctcagagacggggccgcgtggggagaaacccgcagaaggaaaatgaccaatacatcttcaccggacagccccttaacaatgatgaggaccacgcccattggacagaagctaagatgctgctggacaacatcaatacccctgagggcattatccccgccctcttcgaacctgagcgggagaaatccgcggccattgatggggaatatagactgaagggcgagagccgcaaaacatttgtcgaacttatgcggagaggagacctgcccgtgtggctcgctcacaaggttgcctctgagggcatcaaatacacggatcgcaagtggtgcttcgacgggcagcggaacaatcagattctggaagagaacatggatgtggagatctggaccaaagaaggagagaagaagaaactgagaccgcgctggctcgacgctcggacatattccgatcctcttgccctgaaggaatttaaagacttcgccgctggcagaaagagcatcgcgctggatctcgtcaccgagattgggcgcgtgccctctcacctggcccatagaacacggaatgctcttgacaacctggtcatgctccacacctccgaacatggaggcaaagcctaccgccacgccgtggaggagctgcctgaaacgatggagaccctgctccttctgggcctgatgatcctcctgacagggggagctatgctttttctgattagcggcaaggggatcggaaagacctccattggcctcatctgtgttatcgcctctagcgggatgctgtggatggcggaaattcccctgcaatggatcgcctccgctattgtgctcgagttctttatgatggtgcttctgatccctgagcccgaaaaacagagaacaccgcaggataatcaactggcctatgtcgttattggaatcctcaccctggctgccattatcgcggccaacgagatgggccttctggaaacgacaaagcgggacctcggcatgagcaaagagcctggggtggtgtctcccacctcctacctggatgtcgacctgcaccccgctagcgcctggacactctacgctgtggccaccaccgttatcacacctatgcttcgccatacgattgaaaattctaccgctaacgtgagcctggccgcgatcgccaaccaggctgtcgtgctgatgggactcgacaagggctggccgatttccaaaatggatctgggggtcccccttctggccctcggatgctattctcaggtgaatcctctgacactgaccgctgccgttctccttctgatcacacactacgccattatcggccccgggctgcaggcgaaggctaccagagaggcccaaaagcggacggctgccggaatcatgaaaaaccctacagtggacggcattatgaccatcgatctcgaccccgtcatttatgatagcaagttcgagaaacagctgggccaggtgatgcttctggttctctgtgccgtgcagctgctgctcatgagaacctcctgggctctttgcgaagccctgacactggcgaccgggcctatcacaacgctctgggagggatctccgggcaagttttggaataccacaattgccgtcagcatggctaacatcttccgcgggtcctacctggccggagctggccttgcctttagcatcatgaaatctgtggggaccggaaagcggggcacaggctcccaaggggaaaccctgggagagaagtggaaaaagaaactcaatcagctgagcagaaaggagttcgacctgtataaaaagtccggcattacggaggtggatcgcaccgaggcgaaagaagggctcaagcggggagagatcacacatcacgccgtttctagaggcagcgctaaacttcagtggtttgtcgaacggaacatggtgattcccgaggggcgcgtgatcgacctgggatgtggcagaggcgggtggtcctactattgcgccggactgaaaaaggtcaccgaagttcggggctacacaaaagggggacctggccatgaggagcccgtgcctatgtctacctacgggtggaatattgtgaagctcatgagcggaaaagatgtcttctatctgcccccggaaaagtgtgacacacttctgtgcgatatcggcgagtccagcccttctcccaccgtggaagagtcccgcacgattagagttctcaagatggtggagccctggctgaaaaacaatcagttctgtatcaaggtcctgaacccttacatgcccacagtgatcgaacacctcgagcggcttcaacgcaaacacggcgggatgctggttagaaatcctctgagccggaactctacccatgaaatgtattggatttccaatggaaccggcaacatcgtggctagcgtcaatatggtgtctcgcctcctgcttaacagatttacaatgacgcaccggagaccgaccattgagaaggacgtggatctgggggccggaacacgccatgtcaacgctgaacccgagacccctaatatggacgttatcggcgagcggattaaaagaatcaaggaagaacacaacagcacatggcactacgacgatgaaaatccctataagacctgggcctaccatgggtcctatgaggtgaaagcgacaggatctgccagctccatgatcaacggcgtggtcaagctcctgaccaaaccttgggacgtggttcccatggtgacgcagatggctatgaccgatacaaccccgttcggccagcaacgcgtctttaaggaaaaagtggacacacggacccctagaagcatgcccgggacgcgccgggttatgggaattacagccgagtggctgtggagaaccctcggccgcaataagaagcctcggctgtgcacaagagaggagttcaccaaaaaggtgcgcacgaacgctgccatgggggccgtctttaccgaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatctggtacatgtggcttggggcccggtatctggagttcgaggctctcggatttctgaatgaggatcattggttctcccgcgaaaactcttacagcggcgtcgagggggaaggactgcacaaactcggctatattctgagagacatctccaagattcccgggggcgccatgtacgcggatgacacagccggatgggacacccggatcacagaggatgaccttcataatgaagagaaaatcacccagcagatggatcctgagcacagacaactggctaacgccatttttaagctcacatatcagaataaggtggtcaaagtgcagcggcccaccccgacgggcacagttatggacatcatttctcgcaaggatcagagagggagcggacaagtgggcacctacgggctgaacaccttcacaaatatggaagctcagcttatccggcagatggagggagaaggcgtcctgtccaaagccgacctcgagaaccctcatctgcccgaaaagaaaattacccagtggctggagacaaagggggtggagcgcctcaagagaatggcgatcagcggcgatgactgcgtggttaaacccatcgatgaccggtttgccaacgctctgcttgccctgaatgatatgggaaaggtgcgcaaagacattcctcaatggcagccgtctaagggctggcatgattggcagcaggtccccttctgttcccaccatttccacgaactcatcatgaaagacgggagaaagctggtggttccttgccggccccaagacgagcttattggacgcgctagaatcagccagggcgccgggtggtctctgcgggaaacggcttgtctcggaaaggcctatgcgcagatgtggtccctgatgtactttcaccgcagagatctgcggctcgccagcaacgctatttgctctgccgtgcctgtccattgggtgcccacctcccgcacaacctggagcatccacgcccatcaccaatggatgacaaccgaggacatgctgacggtctggaatagagtgtggattgaagataacccttggatggaggacaaaacccccgttacaacctgggagaatgtgccgtaccttggcaagcgggaagatcagtggtgtgggtccctgatcggcctcacaagcagagctacctgggcccagaacatccctacggcgattcagcaagtccgctctctgatcggaaatgaggagttccttgactatatgcccagcatgaaacggtttagaaaggaggaggaatccgagggcgctatttggtga

SEQ ID NO: 20717 - RNA, 9873 nt, synthetic construct
  misc_feature 1..9873: note = derived and/or modified CDS sequence (opt5) from DENV-3__FJ390376__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaacgggaggagaatatggtgaagtccctggttagcgctggatctggcaaagtggacaacttcacaatgggggtcctgtgcctcgccatcctgtttgaagaggtgatgcgcggaaagttcggcaagaaacatatgattgccggcgttttctttaccttcgtgcttctgctcagcgggcagatcatttggagagatatggctcacacactgatcatgattggatccaatgccagcgaccggatgggcatgggggtcacctacctggcgcttatcgctacgtttaagatccagcccttcctggccctcggatttttcctgagaaaactcacatctcgcgaaaacctgcttctgggcgtggggctcgccatggctaccacactgcaactgcctgaggatattgaacagatggccaatggaatcgctcttggcctgatggccctcaagctgattacccagtttgagacctatcagctctggacagcgctgatctcccttacgtgtagcaacaccattttcacactgaccgtggcctggcggacagctaccctcatcctggccggcgtctccctgcttccggtttgccaatctagctccatgagaaaaacggactggctgcccatgacagtggctgccatgggggtgcctcccctccctctgtttatcttctctctcaaggataccctgaagcgcagaagctggccccttaatgagggagtcatggccgtgggcctggtttccattctggcttctagcctcctgcggaacgacgtgcctatggcggggccccttgtcgccggaggcctgctcatcgcttgttacgtgattaccgggacatccgccgatctgaccgttgaaaaagccgctgacgtgacatgggaggaagaggccgaacagacgggagtcagccataacctcatgatcaccgtggacgatgacggcacaatgcgcattaaggatgacgagaccgagaatatcctgacagtccttctgaaaaccgcgctgctcatcgtgtctggcatttttccgtactccatccctgctacgctgcttgtttggcacacctggcagaagcagacacaaagaagcggggtgctgtgggatgtcccctctcctcccgaaacccagaaagccgagctcgaagagggagtgtatcggattaagcagcagggcatcttcgggaaaacacaagttggagtgggcgtccagaaggagggggtgtttcataccatgtggcacgtgacacgcggagccgttctgacgtacaacggcaagagactcgaaccgaattgggcttccgtcaaaaaggacctgattagctatggcgggggatggcggctttctgcccagtggcaaaaaggcgaggaagtccaggtgatcgcggtcgagcctgggaagaaccccaaaaatttccagaccatgcctggaacattccagaccaccacaggcgaaattggggctatcgccctggattttaagcccggaacgtccggcagccccatcattaaccgcgagggcaaggtggttgggctgtacggaaatggcgtggtcaccaaaaacgggggatatgtgtccggcatcgcccaaacaaatgctgagcctgacgggccgacccccgaactcgaggaagagatgttcaagaaaagaaacctgacaattatggatcttcaccctggcagcggaaagacccggaaatacctgcccgccatcgttcgcgaagctattaagagacggctcagaacgctgatcctcgcccctacacgcgtggtcgcggccgagatggaggaagctctgaagggccttcccatccggtatcagaccaccgccacaaaatctgagcataccgggagagaaattgtggacctgatgtgccacgctacatttaccatgcgcctgctcagccctgttcgggtgccgaattacaacctgatcattatggatgaggcccatttcacggaccccgcctccatcgctgcgagaggatacatttctacacgcgtcggcatgggggaagccgctgccatctttatgaccgccacacctcccggaaccgctgatgccttccctcagagcaatgcgcccatccaggacgaggagcgggacattccggaaagatcctggaactctggcaatgagtggatcacggattttgctgggaagaccgtgtggttcgtgcctagcattaaagccggcaacgacatcgccaactgtcttcgcaagaatggcaaaaaggtcattcaactgtcccggaagacatttgataccgaatatcagaaaacaaagctcaacgactgggatttcgttgtgaccacagacatctctgagatgggagctaattttaaagccgatagagtgattgacccccggcgctgcctgaagcccgtcatcctgaccgatgggcctgagagagtgatcctcgcgggacccatgcctgttacggccgctagcgccgctcagcggcgcggcagagtggggcggaacccgcagaaagaaaatgaccaatacattttcacaggacagccccttaacaatgatgaggaccacgcccattggaccgaagctaagatgctgctggacaacatcaatacccctgagggcattatccccgccctcttcgaacctgagagagagaagtccgcggccattgatggggaatatcgcctgaaaggcgagagccggaagacatttgtcgaacttatgagacgcggagacctgcccgtgtggctcgctcacaaagttgcctctgagggcatcaagtacaccgatcggaaatggtgcttcgacgggcagagaaacaatcagatcctggaagagaacatggatgtggagatttggacaaaggaaggagagaaaaagaagctgcgcccgcggtggctcgacgctagaacgtattccgatcctcttgccctgaaagaatttaaggacttcgccgctggccgcaaaagcatcgcgctggatctcgtcaccgagattgggagagtgccctctcacctggcccatcggacacgcaatgctcttgacaacctggtcatgctccacacctccgaacatggaggcaaggcctacagacacgccgtggaggagctgcctgaaacaatggagaccctgctccttctgggcctgatgatcctcctgacagggggagctatgctttttctgattagcggcaaagggatcggaaagacctccatcggcctcatttgtgttatcgcctctagcgggatgctgtggatggcggaaattcccctgcaatggatcgcctccgctattgtgctcgagttctttatgatggtgcttctgatccctgagcccgaaaagcagcggacaccgcaggataatcaactggcctatgtcgttattggaatcctcaccctggctgccatcattgcggccaacgagatgggccttctggaaacaaccaaacgcgacctcggcatgagcaaggagcctggggtggtgtctcccacgtcctacctggatgtcgacctgcaccccgctagcgcctggacactctacgctgtggccaccacagttatcacccctatgcttagacataccattgaaaattctacagctaacgtgagcctggccgcgatcgccaaccaggctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaagctacccgggaggcccaaaagagaacagctgccggaatcatgaagaaccctaccgtggacggcattatgacgatcgatctcgaccccgtcatttatgatagcaaattcgagaagcagctgggccaggtgatgcttctggttctctgtgccgtgcagctgctgctcatgcgcacatcctgggctctttgcgaagccctgaccctggcgaccgggcctatcacaaccctctgggagggatctccgggcaaattttggaatacaacgatcgccgtcagcatggctaacattttccgggggtcctacctggccggagctggccttgcctttagcatcatgaagtctgtggggaccggaaaaagaggcacaggctcccaaggggaaaccctgggagagaagtggaagaaaaagctcaatcagctgagccgcaaagagttcgacctgtataagaaatccggcattacagaggtggatcggaccgaggcgaaggaagggctcaaaagaggagagatcacgcatcacgccgtttctcggggcagcgctaaacttcagtggtttgtcgaacgcaacatggtgattcccgaggggagagtgatcgacctgggatgtggccggggcgggtggtcctactattgcgccggactgaagaaagtcaccgaagttcgcggctacacaaaagggggacctggccatgaggagcccgtgcctatgtctacctacgggtggaatattgtgaaactcatgagcggaaaggatgtcttctatctgcccccggaaaaatgtgacacacttctgtgcgatatcggcgagtccagcccttctcccaccgtggaagagtccagaacaatccgggttctcaagatggtggagccctggctgaagaacaatcagttctgtattaaagtcctgaacccttacatgcccaccgtgatcgaacacctcgagcgccttcaaagaaagcacggcgggatgctggttcggaatcctctgagccgcaactctacgcatgaaatgtattggatttccaatggaacaggcaacatcgtggctagcgtcaatatggtgtctagactcctgcttaaccggtttaccatgacccacagacgcccgacaattgagaaagacgtggatctgggggccggaacgcggcatgtcaacgctgaacccgagacccctaatatggacgttatcggcgagagaatcaagcgcattaaagaagaacacaacagcacatggcactacgacgatgaaaatccctataagacctgggcctaccatgggtcctatgaggtgaaggcgacaggatctgccagctccatgatcaacggcgtggtcaaactcctgaccaagccttgggacgtggttcccatggtgacacagatggctatgaccgatacgaccccgttcggccagcaacgggtctttaaagaaaaggtggacacaagaacccctcgcagcatgcccgggacacggagagttatgggaattaccgccgagtggctgtggcgcacgctcggccggaataaaaagcctagactgtgcacacgcgaggagttcaccaagaaagtgcggacaaacgctgccatgggggccgtctttaccgaggaaaatcagtgggattccgcgaaggctgccgtggaggacgaagatttctggaaacttgttgacagagagcgcgagctgcacaagctcggaaaatgtggctcttgcgtgtacaacatgatggggaagagagagaagaagctgggcgagtttggaaaggccaaaggcagccgggctatctggtacatgtggcttggggcccgctatctggagttcgaggctctcggatttctgaatgaggatcattggttctccagagaaaactcttacagcggcgtcgagggggaaggactgcacaagctcggctatattctgcgggacatctccaaaatccccgggggcgccatgtacgcggatgacacggccggatgggacaccagaattacagaggatgaccttcataatgaagagaagatcacccagcagatggatcctgagcaccggcaactggctaacgccatttttaaactcacatatcagaataaggtggtcaaggtgcagcgccccaccccgacaggcaccgttatggacatcatttctagaaaagatcagcgggggagcggacaagtgggcacgtacgggctgaacacattcaccaatatggaagctcagcttatccgccagatggagggagaaggcgtcctgtccaaggccgacctcgagaaccctcatctgcccgagaagaagatcacccagtggctggagacaaaaggggtggagagactcaagcggatggcgattagcggcgatgactgcgtggttaagcccatcgatgaccgctttgccaacgctctgcttgccctgaatgatatgggaaaagtgagaaaggacattcctcaatggcagccgtctaaaggctggcatgattggcagcaggtccccttctgttcccaccatttccacgaactcatcatgaaggacgggcggaaactggtggttccttgccgcccccaagacgagcttattggacgggctcggatcagccagggcgccgggtggtctctgcgcgaaaccgcttgtctcggaaaggcctatgcgcagatgtggtccctgatgtactttcacagacgggatctgcgcctcgccagcaacgctatttgctctgccgtgcctgtccattgggtgcccacatccagaacgacctggagcatccacgcccatcaccaatggatgacaaccgaggacatgctgacagtctggaatcgggtgtggatcgaagataacccttggatggaggacaagacccccgttacgacctgggagaatgtgccgtaccttggcaaaagagaagatcagtggtgtgggtccctgattggcctcacaagccgcgctacctgggcccagaacatccctacagcgattcagcaagtccggtctctgatcggaaatgaggagttccttgactatatgcccagcatgaagagatttcgcaaagaggaggaatccgagggcgctatttggtga

SEQ ID NO: 20718 - RNA, 9873 nt, synthetic construct
  misc_feature 1..9873: note = derived and/or modified CDS sequence (opt5) from DENV-3__FJ390377__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcaaggtggacaacttcacaatgggggtcctgtgcctcgccatcctgtttgaagaggtgatgcggggaaagttcggcaaaaagcatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaaaatccagcccttcctggccctcggatttttcctgcggaagctcacctctagagaaaacctgcttctgggcgtggggctcgccatggctacaaccctgcaactgcctgaggatatcgaacagatggccaatggaattgctcttggcctgatggccctcaaactgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaagacagactggctgcccatgaccgtggctgccatgggggtgcctcccctccctctgtttatcttctctctcaaggataccctgaaaagacgcagctggccccttaatgagggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgaaaaggccgctgacgtgacgtgggaggaagaggccgaacagaccggagtcagccataacctcatgattacagtggacgatgacggcaccatgcggatcaaagatgacgagacagagaatattctgaccgtccttctgaagacggcgctgctcatcgtgtctggcatctttccgtactccattcctgctaccctgcttgtttggcacacatggcagaaacagacccaacgcagcggggtgctgtgggatgtcccctctcctcccgaaacacagaaggccgagctcgaagagggagtgtatagaatcaaacagcagggcattttcgggaagacccaagttggagtgggcgtccagaaggagggggtgtttcatacaatgtggcacgtgacgcggggagccgttctgacctacaacggcaaacgcctcgaaccgaattgggcttccgtcaagaaagacctgatcagctatggcgggggatggagactttctgcccagtggcaaaagggcgaggaagtccaggtgattgcggtcgagcctgggaaaaaccccaagaatttccagacaatgcctggaaccttccagaccacaacgggcgaaatcggggctattgccctggattttaagcccggaacctccggcagccccatcatcaaccgggagggcaaagtggttgggctgtacggaaatggcgtggtcacaaagaacgggggatatgtgtccggcattgcccaaaccaatgctgagcctgacgggccgacacccgaactcgaggaagagatgttcaaaaagcgcaacctgaccatcatggatcttcaccctggcagcggaaaaacgagaaagtacctgcccgccattgttcgggaagctatcaagcgcagactccggacactgattctcgcccctaccagagtggtcgcggccgagatggaggaagctctgaaaggccttcccatccgctatcagaccacagccaccaagtctgagcatacagggcgggaaatcgtggacctgatgtgccacgctacctttacgatgagactgctcagccctgttcgcgtgccgaattacaacctgattatcatggatgaggcccatttcacagaccccgcctccattgctgcgcggggatacatctctaccagagtcggcatgggggaagccgctgccatttttatgacagccacccctcccggaacggctgatgccttccctcagagcaatgcgcccatccaggacgaggagcgcgacatcccggaacggtcctggaactctggcaatgagtggattaccgattttgctgggaaaacagtgtggttcgtgcctagcatcaaggccggcaacgacattgccaactgtcttcgcaaaaatggaaagaaggtcatccaactgtccagaaaaacctttgatacagaatatcagaagaccaaactcaacgactgggatttcgttgtgacaaccgacatttctgagatgggcgctaattttaaggccgatcgggtgatcgaccccagacggtgcctgaaacccgtcattctgacggatgggcctgagcgcgtgatcctcgcgggacccatgcctgttacagccgctagcgccgctcagagacggggccgcgtggggagaaacccgcagaaggaaaatgaccaatacatcttcaccggacagccccttaacaatgatgaggaccacgcccattggaccgaagctaagatgctgctggacaacattaatacacctgagggcatcattcccgccctcttcgaacctgagcgggagaaatccgcggccatcgatggggaatatagactgaagggcgagagccgcaaaacctttgtcgaacttatgcggagaggagacctgcccgtgtggctcgctcacaaggttgcctctgagggcattaaatacacagatcgcaagtggtgcttcgacgggcagcggaacaatcagatcctggaagagaacatggatgtggagatctggacgaaagaaggagagaagaagaaactgagaccgcgctggctcgacgctcggacctattccgatcctcttgccctgaaggaatttaaagacttcgccgctggcagaaagagcattgcgctggatctcgtcacagagatcgggcgcgtgccctctcacctggcccatagaacccggaatgctcttgacaacctggtcatgctccacacatccgaacatggaggcaaagcctaccgccacgccgtggaggagctgcctgaaaccatggagacgctgctccttctgggcctgatgattctcctgaccgggggagctatgctttttctgatcagcggcaaggggattggaaagacatccatcggcctcatctgtgttattgcctctagcgggatgctgtggatggcggaaatccccctgcaatggattgcctccgctatcgtgctcgagttctttatgatggtgcttctgattcctgagcccgaaaaacagagaaccccgcaggataatcaactggcctatgtcgttatcggcattctcacactggctgccatcatcgcggccaacgagatgggccttctggaaaccacgaagcgggacctcggcatgagcaaagagcctggggtggtgtctcccacatcctacctggatgtcgacctgcaccccgctagcgcctggaccctctacgctgtggccacaaccgttattacccctatgcttcgccatacaatcgaaaattctacggctaacgtgagcctggccgcgattgccaaccaggctgtcgtgctgatgggactcgacaagggctggccgatctccaaaatggatctgggggtcccccttctggccctcggatgctattctcaggtgaatcctctgaccctgacagctgccgttctccttctgattacccactacgccatcatcggccccgggctgcaggcgaaggctacaagagaggcccaaaagcggaccgctgccggaattatgaaaaaccctacggtggacggcatcatgacaattgatctcgaccccgtcatctatgatagcaagttcgagaaacagctgggccaggtgatgcttctggttctctgtgccgtgcagctgctgctcatgagaacctcctgggctctttgcgaagccctgaccctggcgacagggcctattaccacactctgggagggatctccgggcaagttttggaatacgaccatcgccgtcagcatggctaacatcttccgcgggtcctacctggccggagctggccttgcctttagcattatgaaatctgtggggacaggaaagcggggcaccggctcccaaggggaaacactgggagagaagtggaaaaagaaactcaatcagctgagcagaaaggagttcgacctgtataaaaagtccggcatcaccgaggtggatcgcacggaggcgaaagaagggctcaagcggggagagattacccatcacgccgtttctagaggcagcgctaaacttcagtggtttgtcgaacggaacatggtgatccccgaggggcgcgtgattgacctgggatgtggcagaggcgggtggtcctactattgcgccggactgaaaaaggtcacagaagttcggggctacaccaaagggggacctggccatgaggagcccgtgcctatgtctacatacgggtggaatatcgtgaagctcatgagcggaaaagatgtcttctatctgcccccggaaaagtgtgacacccttctgtgcgatattggcgagtccagcccttctcccacagtggaagagtcccgcaccatcagagttctcaagatggtggagccctggctgaaaaacaatcagttctgtatcaaggtcctgaacccttacatgcccacggtgattgaacacctcgagcggcttcaacgcaaacacggcgggatgctggttagaaatcctctgagccggaactctacacatgaaatgtattggatctccaatggaaccggcaacattgtggctagcgtcaatatggtgtctcgcctcctgcttaacagatttaccatgacacaccggagaccgacgatcgagaaggacgtggatctgggggccggaacccgccatgtcaacgctgaacccgagacacctaatatggacgttattggcgagcggatcaaaagaatcaaggaagaacacaacagcacctggcactacgacgatgaaaatccctataagacatgggcctaccatgggtcctatgaggtgaaagcgaccggatctgccagctccatgattaacggcgtggtcaagctcctgacaaaaccttgggacgtggttcccatggtgacccagatggctatgacggataccacaccgttcggccagcaacgcgtctttaaggaaaaagtggacacccggacacctagaagcatgcccgggacccgccgggttatgggaatcacggccgagtggctgtggagaacactcggccgcaataagaagcctcggctgtgcaccagagaggagttcaccaagaaggtgcgcaccaacgctgccatgggggccgtctttacggaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtcgagggggaaggactgcacaaactcggctatatcctgagagacatttccaagatccccgggggcgccatgtacgcggatgacaccgccggatgggacacacggatcaccgaggatgaccttcataatgaagagaaaattacacagcagatggatcctgagcacagacaactggctaacgccatctttaagctcacctatcagaataaggtggtcaaagtgcagcggcccacaccgaccggcacggttatggacattatctctcgcaaggatcagagagggagcggacaagtgggcacatacgggctgaacaccttcaccaatatggaagctcagcttattcggcagatggagggagaaggcgtcctgtccaaagccgacctcgagaaccctcatctgcccgaaaagaaaatcacacagtggctggagaccaagggggtggagcgcctcaagagaatggcgatcagcggcgatgactgcgtggttaaacccattgatgaccggtttgccaacgctctgcttgccctgaatgatatgggaaaggtgcgcaaagacatccctcaatggcagccgtctaagggctggcatgattggcagcaggtccccttctgttcccaccatttccacgaactcattatgaaagacgggagaaagctggtggttccttgccggccccaagacgagcttatcggacgcgctagaattagccagggcgccgggtggtctctgcgggaaacagcttgtctcggaaaggcctatgcgcagatgtggtccctgatgtactttcaccgcagagatctgcggctcgccagcaacgctatctgctctgccgtgcctgtccattgggtgcccacgtcccgcaccacatggagcattcacgcccatcaccaatggatgaccacagaggacatgctgaccgtctggaatagagtgtggatcgaagataacccttggatggaggacaaaacgcccgttaccacatgggagaatgtgccgtaccttggcaagcgggaagatcagtggtgtgggtccctgatcggcctcaccagcagagctacatgggcccagaacattcctaccgcgatccagcaagtccgctctctgattggaaatgaggagttccttgactatatgcccagcatgaaacggtttagaaaggaggaggaatccgagggcgctatctggtga

SEQ ID NO: 20719 - RNA, 9873 nt, synthetic construct
  misc_feature 1..9873: note = derived and/or modified CDS sequence (opt5) from DENV-3__FJ547069__SS-prME
  source 1..9873: mol_type = other RNA
accagcctgtgcctgatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaatctcgggggcacctccattttcgccggacatctcaagtgtcgcctgaaaatggacaaacttgagctgaaaggcatgagctacgctatgtgcacaaacacgtttgtgctcaagaaagaggtctctgaaacccagcacgggacaatcctgatcaaggtggagtacaagggagaagatgttccctgtaaaattcctttctccaccgaggacggccaagggaaggcccataacggaagactgatcacagcgaatcccgtggtcaccaaaaaggaggaacccgtgaacattgaggctgaacctccgttcggcgagagcaatatcgtgattgggatcggcgataacgcccttaaaatcaattggtataagaagggatcctctattggcaaaatgtttgaagccacggctagaggggctagacgcatggctatcctcggagacacagcctgggatttcggcagcgttgggggagtcctgaactccctgggcaagatggtgcaccagatttttgggagcgcgtacaccgccctcttctctggcgtgtcctgggtcatgaaaatcggaattggcgtgctgcttacctggatcgggctgaatagcaagaacacatctatgagcttttcctgcattgctatcggaatcattaccctctatctgggcgccgttgtgcaggctgacatggggtgtgtcatcaattggaaaggaaaggagctgaagtgcggctctgggattttcgtgacaaacgaggttcatacgtggaccgaacagtacaaatttcaagccgatagccccaagcggcttgcgacagccatcgctggcgcctgggagaatggagtgtgtggcattagatccaccacacgcatggaaaacctcctgtggaaacagatcgctaatgagctgaactatatcctctgggaaaataacattaagctgaccgtcgtggttggggacatcattggagtgcttgagcagggcaaacggacgctgacccctcagcccatggagctcaagtacagctggaaaacatgggggaaggccaagatcgtcaccgccgaaacacaaaactcttccttcattatcgatggacctaatacccccgagtgcccgagcgcttctagagcgtggaacgtgtgggaagtggaggactatggctttggcgtcttcacaaccaatatctggctgaaactgcgcgaagtttacacgcagctttgtgaccaccggctcatgtccgccgctgtgaaggatgagagagccgtgcacgccgacatggggtactggattgagagccagaaaaacggatcctggaagctggaaaaggcttctctgatcgaggtcaagacatgcacctggcctaagagccataccctctggtccaatggcgtgctggaatctgatatgattatccccaaaagccttgccgggcctatttcccagcacaactatcgccccggataccatacacaaaccgcgggcccttggcacctggggaagctcgagctggactttaattattgcgagggaacgacagttgtgatcaccgaaaactgtggcacacggggccccagcctgagaaccacaaccgtctctgggaaacttatccacgagtggtgctgtcgctcctgcacgctcccgcctctgcggtacatgggagaagatggctgttggtatgggatggagattagacccatcagcgaaaaggaggagaatatggtgaaatctctggtttccgctggaagcggcaaggtggacaacttcaccatgggggtcctctgcctggccattctttttgaagaggtgatgcggggaaagttcggcaaaaagcatatgatcgccggcgttttctttacattcgtgctgctcctgtctgggcagattacctggcgcgatatggctcacacactgatcatgattggaagcaatgcctccgacagaatgggcatgggggtcacctaccttgcgctgatcgctacgtttaaaatccagcccttcctcgccctgggatttttcctccggaagctgacaagcagagaaaaccttctgctcggcgtggggctggccatggctaccacactgcaacttcctgaggatattgaacagatggccaatggaatcgctctgggcctcatggccctgaaactcattacccagtttgagacctatcagctgtggacagcgcttatctctctgacgtgttccaacaccattttcacactcaccgtggcctggcgcacagctaccctgatcctggccggcgtcagccttctgccggtttgccaatcctctagcatgcggaagacggactggctccccatgacagtggctgccatgggggtgcctcccctgcctctctttatcttctccctgaaggatacccttaaaagacgctcttggcccctgaatgagggagtcatggccgtgggcctggttagcattctcgcttcctctctgcttagaaacgacgtgcctatggcggggcccctggtcgccggaggcctcctgatcgcttgttacgtgattaccgggacaagcgccgatctcaccgttgaaaaggccgctgacgtgacatgggaggaagaggccgaacagacgggagtctcccataacctgatgatcaccgtggacgatgacggcacaatgcggattaaagatgacgagaccgagaatatccttacagtcctgctgaagaccgcgctcctgatcgtgagcggcatttttccgtactctatccctgctacgcttctggtttggcacacctggcagaaacagacacaacgctccggggtgctctgggatgtccccagccctcccgaaacccagaaggccgagctggaagagggagtgtatagaattaaacagcagggcatcttcgggaagacacaagttggagtgggcgtccagaaggagggggtgtttcataccatgtggcacgtgacacggggagccgttctcacgtacaacggcaaacgcctggaaccgaattgggcttctgtcaagaaagaccttatttcctatggcgggggatggagactgagcgcccagtggcaaaagggcgaggaagtccaggtgatcgcggtcgagcctgggaaaaaccccaagaatttccagaccatgcctggaacattccagaccaccacaggcgaaattggggctatcgccctggattttaagcccggaacgtctggctcccccatcattaaccgggagggcaaagtggttgggctctacggaaatggcgtggtcaccaagaacgggggatatgtgagcggcatcgcccaaacaaatgctgagcctgacgggccgacccccgaactggaggaagagatgttcaaaaagcgcaaccttacaattatggatctgcaccctggctccggaaaaaccagaaagtacctccccgccatcgttcgggaagctattaagcgcagactgcggacgctcatcctggcccctacaagagtggtcgcggccgagatggaggaagctcttaaaggcctgcccatccgctatcagaccaccgccacaaagagcgagcataccgggcgggaaattgtggacctgatgtgccacgctacatttaccatgagactcctgtctcctgttcgcgtgccgaattacaaccttatcattatggatgaggcccatttcacggaccccgccagcatcgctgcgcggggatacatttccacaagagtcggcatgggggaagccgctgccatctttatgaccgccacacctcccggaaccgctgatgccttccctcagtctaatgcgcccatccaggacgaggagcgcgacattccggaacggagctggaactccggcaatgagtggatcacggattttgctgggaaaaccgtgtggttcgtgccttctattaaggccggcaacgacatcgccaactgtctgcgcaaaaatggaaagaaggtcattcaactcagcagaaaaacatttgataccgaatatcagaagacaaaactgaacgactgggatttcgttgtgaccacagacatctccgagatgggcgctaattttaaggccgatcgggtgattgaccccagacggtgcctgaaacccgtcatcctcaccgatgggcctgagcgcgtgatccttgcgggacccatgcctgttacggccgcttctgccgctcagagacggggccgcgtggggagaaacccgcagaaggaaaatgaccaatacattttcacaggacagcccctgaacaatgatgaggaccacgcccattggaccgaagctaagatgctgctcgacaacatcaatacccctgagggcattatccccgccctgttcgaacctgagcgggagaaaagcgcggccattgatggggaatatagacttaagggcgagtcccgcaaaacatttgtcgaactgatgcggagaggagacctccccgtgtggctggctcacaaggttgccagcgagggcatcaaatacaccgatcgcaagtggtgcttcgacgggcagcggaacaatcagatcctggaagagaacatggatgtggagatttggacaaaagaaggagagaagaagaaactcagaccgcgctggcttgacgctcggacgtattctgatcctctggccctgaaggaatttaaagacttcgccgctggcagaaagtccatcgcgctcgatctggtcaccgagattgggcgcgtgcccagccaccttgcccatagaacacggaatgctctggacaacctcgtcatgctgcacacctctgaacatggaggcaaagcctaccgccacgccgtggaggagctgcctgaaacaatggagaccctccttctgctgggcctcatgatcctgcttacagggggagctatgctgtttctcatttccggcaaggggatcggaaagaccagcatcggcctgatttgtgttatcgcctcctctgggatgctgtggatggcggaaattcccctccaatggatcgccagcgctattgtgcttgagttctttatgatggtgctgctgatccctgagcccgaaaaacagagaacaccgcaggataatcaactcgcctatgtcgttattggaatcctgacccttgctgccatcattgcggccaacgagatgggcctgctcgaaacaaccaagcgggacctgggcatgtccaaagagcctggggtggtgagccccacgtcttacctggatgtcgacctccaccccgcttccgcctggacactttacgctgtggccaccacagttatcacccctatgctgcgccataccattgaaaatagcacagctaacgtgtctctggccgcgatcgccaaccaggctgtcgtgctcatgggactggacaagggctggccgattagcaaaatggatcttggggtccccctgctcgccctgggatgctattcccaggtgaatcctctgacgctcaccgctgccgttcttctgctgatcacacactacgccatcattggccccgggctccaggcgaaggctaccagagaggcccaaaagcggacagctgccggaatcatgaaaaaccctaccgtggacggcattatgacgatcgatctggaccccgtcatttatgattctaagttcgagaaacagcttggccaggtgatgctgctcgttctgtgtgccgtgcagctgctccttatgagaacaagctgggctctgtgcgaagccctgaccctcgcgaccgggcctatcacaaccctgtgggagggatccccgggcaagttttggaatacaacgatcgccgtctctatggctaacattttccgcgggagctaccttgccggagctggcctggccttttccatcatgaaaagcgtggggaccggaaagcggggcacaggctctcaaggggaaaccctcggagagaagtggaaaaagaaactgaatcagctgtccagaaaggagttcgacctctataaaaagagcggcattacagaggtggatcgcaccgaggcgaaagaagggcttaagcggggagagatcacgcatcacgccgtttccagaggctctgctaagctgcagtggtttgtcgaacggaacatggtgattcccgaggggcgcgtgatcgacctgggatgtggcagaggcgggtggagctactattgcgccggactcaaaaaggtcaccgaagttcggggctacacaaaagggggacctggccatgaggagcccgtgcctatgtccacctacgggtggaatattgtgaagctgatgtctggaaaagatgtcttctatcttcccccggaaaagtgtgacacactgctctgcgatatcggcgagagctcccctagccccaccgtggaagagtctcgcacaatcagagttctgaagatggtggagccctggctgaaaaacaatcagttctgtattaaggtcctcaacccttacatgcccaccgtgatcgaacaccttgagcggctgcaacgcaaacacggcgggatgctggttagaaatcctctctcccggaacagcacgcatgaaatgtattggatttctaatggaacaggcaacatcgtggcttccgtcaatatggtgagccgcctgcttctgaacagatttaccatgacccaccggagaccgacaattgagaaggacgtggatctcggggccggaacgcgccatgtcaacgctgaacccgagacccctaatatggacgttatcggcgagcggatcaaaagaattaaggaagaacacaactctacatggcactacgacgatgaaaatccctataagacctgggcctaccatgggagctatgaggtgaaagcgacaggatccgcctctagcatgatcaacggcgtggtcaagctgctgaccaaaccttgggacgtggttcccatggtgacacagatggctatgaccgatacgaccccgttcggccagcaacgcgtctttaaggaaaaagtggacacacggacccctagatccatgcccgggacacgccgggttatgggaattaccgccgagtggctctggagaacgctgggccgcaataagaagcctcggctttgcacaagagaggagttcaccaaaaaggtgcgcacaaacgctgccatgggggccgtctttaccgaggaaaatcagtgggatagcgcgaaagctgccgtggaggacgaagatttctggaagctggttgaccgggagagagagctccacaaactgggaaagtgtggctcctgcgtgtacaacatgatggggaaacgcgaaaagaaacttggcgagtttggaaaagccaagggctctagagctatctggtacatgtggctgggggcccggtatctcgagttcgaggctctgggatttctgaatgaggatcattggttcagccgcgaaaactcctactctggcgtcgagggggaaggactccacaaactgggctatattcttagagacatcagcaagatccccgggggcgccatgtacgcggatgacacggccggatgggacacccggattacagaggatgacctgcataatgaagagaaaatcacccagcagatggatcctgagcacagacaactcgctaacgccatttttaagctgacatatcagaataaggtggtcaaagtgcagcggcccaccccgacaggcaccgttatggacatcatttcccgcaaggatcagagagggtctggacaagtgggcacgtacgggcttaacacattcaccaatatggaagctcagctgatccggcagatggagggagaaggcgtcctcagcaaagccgacctggagaaccctcatctgcccgaaaagaaaatcacccagtggctcgagacaaagggggtggagcgcctgaagagaatggcgatttccggcgatgactgcgtggttaaacccatcgatgaccggtttgccaacgcccttctggccctcaatgatatgggaaaggtgcgcaaagacattcctcaatggcagccgagcaagggctggcatgattggcagcaggtccccttctgttctcaccatttccacgaactgatcatgaaagacgggagaaaacttgtggttccttgccggccccaagacgagctgattggacgcgctagaatctcccagggcgccgggtggagcctccgggaaaccgcttgtctgggaaaggcctatgcgcagatgtggtctctgatgtactttcaccgcagagatctccggctggcctccaacgctatttgcagcgccgtgcctgtccattgggtgcccacatctcgcacgacctggtccatccacgcccatcaccaatggatgacaaccgaggacatgcttacagtctggaatagagtgtggatcgaagataacccttggatggaggacaaaacccccgttacgacctgggagaatgtgccgtacctgggcaagcgggaagatcagtggtgtgggagcctcattggcctgacatccagagctacctgggcccagaacatccctacagcgattcagcaagtccgcagccttatcggaaatgaggagttcctggactatatgccctctatgaaacggtttagaaaggaggaggaaagcgagggcgctatttggtga

SEQ ID NO: 20720 - RNA, 9873 nt, synthetic construct
  misc_feature 1..9873: note = derived and/or modified CDS sequence (opt5) from DENV-3__FJ562107__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaatatcagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcagaaggaaaatgaccaatacattttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtttggctcgcctacaaggtggcttctgagggcatcaaatataccgatcgcaagtggtgcttcgacgggcagcggaacaatcagatcctggaagagaacatggatgtcgagatttggacaaaagaaggagagaagaagaaactgagaccgcgctggctcgacgcccggacgtactccgatcctcttgctctgaaggaatttaaagacttcgccgccggcagaaagagcatcgctctggatctcgtgaccgagattgggcgcgtcccctctcacctggcgcacagaacacggaatgcccttgacaacctggtgatgctccatacctccgaacacggaggcaaggcttatcgccatgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaaacagagaacaccgcaggataatcaactggcttacgttgtgattggaatcctcaccctggccgctatcattgccgcgaacgagatgggccttctggaaacaaccaagcgggacctcggcatgagcaaagagcctggggtggtctctcccacgtcctacctggatgtggacctgcaccccgccagcgcttggacactctatgccgttgctaccacagtgatcacccctatgcttcgccacaccattgaaaattctacagccaacgtcagcctggctgccatcgcgaaccaggccgtggtcctgatgggactcgacaagggctggccgatttccaaaatggatctgggggtgccccttctggctctcggatgctactctcaggttaatcctctgacgctgaccgccgctgtgctccttctgatcacacattatgccatcattggccccgggctgcaggccaaggcgaccagagaggctcaaaagcggacagccgctggaatcatgaaaaaccctaccgtcgacggcattatgacgatcgatctcgaccccgtgatttacgatagcaagttcgagaaacagctgggccaggttatgcttctggtgctctgtgccgtccagctgctgctcatgagaacatcctgggccctttgcgaagctctgaccctggccaccgggcctatcacaaccctctgggagggatctccgggcaagttttggaatacaacgatcgcggtgagcatggccaacattttccgcgggtcctatctggctggagccggccttgcttttagcatcatgaaatctgtggggaccggaaagcggggcacaggctcccaaggggaaaccctgggagagaagtggaaaaagaaactcaatcagctgagcagaaaggagttcgacctgtacaaaaagtccggcattacagaggttgatcgcaccgaggccaaagaagggctcaagcggggagagatcacgcaccatgcggtctctagaggcagcgccaaacttcagtggtttgtggaacggaacatggtgattcccgaggggcgcgtcatcgacctgggatgtggcagaggcgggtggtcctattactgcgctggactgaaaaaggttaccgaagtgcggggctacacaaaagggggacctggccacgaggagcccgtgcctatgtctacctatgggtggaatattgtcaagctcatgagcggaaaagatgtgttctacctgcccccggaaaagtgtgacacacttctgtgcgatatcggcgagtccagcccttctcccaccgttgaagagtcccgcacaatcagagtgctcaagatggtcgagccctggctgaaaaacaatcagttctgtattaaggtgctgaacccttatatgcccaccgttatcgaacatctcgagcggcttcaacgcaaacacggcgggatgctggtgagaaatcctctgagccggaactctacgcacgaaatgtactggatttccaatggaacaggcaacatcgtcgccagcgtgaatatggtgtctcgcctcctgcttaacagatttaccatgacccatcggagaccgacaattgagaaggacgtcgatctgggggctggaacgcgccacgttaacgccgaacccgagacccctaatatggacgtgatcggcgagcggatcaaaagaattaaggaagaacacaacagcacatggcactatgacgatgaaaatccctacaagacctgggcttatcacgggtcctacgaggtgaaagccacaggatctgcgagctccatgatcaacggcgtcgtgaagctcctgaccaaaccttgggacgttgtgcccatggtcacacagatggccatgaccgatacgaccccgttcggccagcaacgcgtgtttaaggaaaaagttgacacacggacccctagaagcatgcccgggacacgccgggtgatgggaattaccgctgagtggctgtggagaacgctcggccgcaataagaagcctcggctgtgcacaagagaggagttcaccaaaaaggtccgcacaaacgccgctatgggggccgtgtttaccgaggaaaatcagtgggattccgccaaagcggctgttgaggacgaagatttctggatccttgtggaccgggagagagagctgcataagctcggaaaatgtggctcttgcgtctacaacatgatggggaagcgcgagaaaaagctgggcgagtttggaaaggccaaaggcagcagagccatttggtatatgtggcttggggctcggtacctggagttcgaggccctcggatttctgaatgaggatcactggttctcccgcgaaaactcttatagcggcgtggagggggaaggactgcataagctcggctacatcctgagagacatctccaaaattcccgggggcgctatgtatgccgatgacacggcgggatgggacacccggatcacagaggatgaccttcacaatgaagagaagattacccagcagatggatcctgagcatagacaactggccaacgctatctttaaactcacataccagaataaggtcgtgaaggttcagcggcccaccccgacaggcaccgtgatggacattatctctcgcaaagatcagagagggagcggacaagtcggcacgtatgggctgaacacattcaccaatatggaagcccagcttatccggcagatggagggagaaggcgtgctgtccaaggctgacctcgagaaccctcatctgcccgagaaaaagattacccagtggctggagacaaaaggggtggagcgcctcaagagaatggccatcagcggcgatgactgcgttgtgaagcccattgatgaccggtttgcgaacgccctgcttgctctgaatgatatgggaaaagtccgcaaggacatccctcaatggcagccgtctaaaggctggcacgattggcaacaggtgcccttctgttcccatcacttccatgaactcattatgaaggacgggagaaaactggttgtgccttgccggccccaagacgagcttatcggacgcgccagaattagccagggcgctgggtggtctctgcgggaaaccgcctgtctcggaaaggcttacgcccagatgtggtccctgatgtactttcaccgcagagatctgcggctcgcgagcaacgccatctgctctgctgtccctgtgcactgggtccccacatcccgcacgacctggagcatccatgcccaccatcaatggatgacaaccgaggacatgctgacagtgtggaatagagtttggattgaagataacccttggatggaggacaagacccccgtgacgacctgggagaatgtcccgtatcttggcaaacgggaagatcagtggtgtgggtccctgatcggcctcacaagcagagccacctgggctcagaacattcctacagccatccagcaagtgcgctctctgattggaaatgaggagttccttgactacatgcccagcatgaagcggtttagaaaagaggaggaatccgagggcgcgatctggtga

SEQ ID NO: 20721 - RNA, 9873 nt, synthetic construct
  misc_feature 1..9873: note = derived and/or modified CDS sequence (opt5) from DENV-3__FJ547071__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatgacagtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaagacagccgacgtgacgtgggaggaagaggctgaacagaccggagtcagccataacctcatgatcacagtggacgatgacggcaccatgcggattaaagatgacgagacagagaatatcctgaccgtccttctgaagacggccctgctcatcgtgtctggcatttttccgtactccatccctgcgaccctgcttgtttggcacacatggcagaaacagacccaacgcagcggggtgctgtgggatgtcccctctcctcccgaaacacagaaggctgagctcgaagagggagtgtatagaattaaacagcagggcatcttcgggaagacccaagttggagtgggcgtccagaaggagggggtgtttcatacaatgtggcacgtgacgcggggagccgttctgacctacaacggcaaacgcctcgaaccgaattgggcctccgtcaagaaagacctgattagctatggcgggggatggagactttctgctcagtggcaaaagggcgaggaagtccaggtgatcgccgtcgagcctgggaaaaaccccaagaatttccagacaatgcctggaaccttccagaccacaacgggcgaaattggggcgatcgctctggattttaagcccggaacctccggcagccccatcattaaccgggagggcaaagtggttgggctgtacggaaatggcgtggtcacaaagaacgggggatatgtgtccggcatcgcccaaaccaatgccgagcctgacgggccgacacccgaactcgaggaagagatgttcaaaaagcgcaacctgaccattatggatcttcaccctggcagcggaaaaacgagaaagtacctgcccgctatcgttcgggaagccattaagcgcagactccggacactgatcctcgctcctaccagagtggtcgccgcggagatggaggaagccctgaaaggccttcccatccgctatcagaccacagctaccaagtctgagcatacagggcgggaaattgtggacctgatgtgccacgccacctttacgatgagactgctcagccctgttcgcgtgccgaattacaacctgatcattatggatgaggctcatttcacagaccccgcctccatcgccgctcggggatacatttctaccagagtcggcatgggggaagcggccgctatctttatgacagccacccctcccggaacggccgatgctttccctcagagcaatgcccccatccaggacgaggagcgcgacattccggaacggtcctggaactctggcaatgagtggatcaccgattttgcggggaaaacagtgtggttcgtgcctagcattaaggctggcaacgacatcgccaactgtcttcgcaaaaatggaaagaaggtcattcaactgtccagaaaaacctttgatacagaatatcagaagaccaaactcaacgactgggatttcgttgtgacaaccgacatctctgagatgggcgccaattttaaggctgatcgggtgattgaccccagacggtgcctgaaacccgtcatcctgacggatgggcctgagcgcgtgatcctcgccggacccatgcctgttacagcggccagcgctgcccagagacggggccgcgtggggagaaacccgcagaaggaaaatgaccaatacattttcaccggacagccccttaacaatgatgaggaccacgctcattggaccgaagccaagatgctgctggacaacatcaatacacctgagggcattatccccgctctcttcgaacctgagcgggagaaatccgccgcgattgatggggaatatagactgaagggcgagagccgcaaaacctttgtcgaacttatgcggagaggagacctgcccgtgtggctcgcccacaaggttgcttctgagggcatcaaatacacagatcgcaagtggtgcttcgacgggcagcggaacaatcagatcctggaagagaacatggatgtggagatttggacgaaagaaggagagaagaagaaactgagaccgcgctggctcgacgcccggacctattccgatcctcttgctctgaaggaatttaaagacttcgccgccggcagaaagagcatcgctctggatctcgtcacagagattgggcgcgtgccctctcacctggcgcatagaacccggaatgcccttgacaacctggtcatgctccacacatccgaacatggaggcaaggcttaccgccacgccgtggaggagctgcctgaaaccatggagacgctgctccttctgggcctgatgatcctcctgaccgggggagccatgctttttctgattagcggcaaggggatcggaaagacatccatcggcctcatttgtgttatcgcttctagcgggatgctgtggatggccgaaattcccctgcaatggatcgcgtccgccattgtgctcgagttctttatgatggtgcttctgatccctgagcccgaaaaacagagaaccccgcaggataatcaactggcttatgtcgttattggaatcctcacactggccgctatcattgccgcgaacgagatgggccttctggaaaccacgaagcgggacctcggcatgagcaaagagcctggggtggtgtctcccacatcctacctggatgtcgacctgcaccccgccagcgcttggaccctctacgccgtggctacaaccgttatcacccctatgcttcgccatacaattgaaaattctacggccaacgtgagcctggctgccatcgcgaaccaggccgtcgtgctgatgggactcgacaagggctggccgatttccaaaatggatctgggggtcccccttctggctctcggatgctattctcaggtgaatcctctgaccctgacagccgctgttctccttctgatcacccactacgccatcattggccccgggctgcaggccaaggcgacaagagaggctcaaaagcggaccgccgctggaatcatgaaaaaccctacggtggacggcattatgacaatcgatctcgaccccgtcatttatgatagcaagttcgagaaacagctgggccaggtgatgcttctgatcctctgtgccgttcagctgctgctcatgagaacctcctgggccctttgcgaagctctgaccctggccacagggcctatcaccacactctgggagggatctccgggcaagttttggaatacgaccattgcggtgagcatggccaacatcttccgcgggtcctacctggctggagccggccttgcttttagcattatgaaatctgtcgggacaggaaagcggggcaccggctcccaaggggaaacactgggagagaagtggaaaaagaaactcaatcagctgagcagaaaggagttcgacctgtataaaaagtccggcatcaccgaggtggatcgcacggaggccaaagaagggctcaagcggggagagattacccatcacgcggtgtctagaggcagcgccaaacttcagtggtttgttgaacggaacatggtcatccccgaggggcgcgtgattgacctgggatgtggcagaggcgggtggtcctactattgcgctggactgaaaaaggtgacagaagtccggggctacaccaaagggggacctggccatgaggagcccgttcctatgtctacatacgggtggaatatcgtgaagctcatgagcggaaaagatgtgttctatctgcccccggaaaagtgtgacacccttctgtgcgatatcggcgagtccagcccttctcccacagtcgaagagtcccgcaccattagagtgctcaagatggttgagccctggctgaaaaacaatcagttctgtatcaaggtgctgaacccttacatgcccacggtcattgaacacctcgagcggcttcaacgcaaacacggcgggatgctggtgagaaatcctctgagccggaactctacacatgaaatgtattggatctccaatggaaccggcaacattgttgccagcgtgaatatggtctctcgcctcctgcttaacagatttaccatgacacaccggagaccgacgatcgagaaggacgtggatctgggggctggaacccgccatgtgaacgccgaacccgagacacctaatatggacgtcatcggcgagcggattaaaagaatcaaggaagaacacaacagcacctggcactacgacgatgaaaatccctataagacatgggcttaccatgggtcctatgaggttaaagccaccggatctgcgagctccatgattaacggcgtggtgaagctcctgacaaaaccttgggacgtcgtgcccatggttacccagatggccatgacggataccacaccgttcggccagcaacgcgtgtttaaggaaaaagtcgacacccggacacctagaagcatgcccgggacccgccgggtgatgggaatcacggctgagtggctgtggagaacactcggccgcaataagaagcctcggctgtgcaccagagaggagttcaccaagaaggttcgcaccaacgccgctatgggggccgtgtttacggaggaaaatcagtgggattccgccaaagcggctgtcgaggacgaagatttctggaaacttgtggaccgggagagagagctgcacaaactcggaaagtgtggctcttgcgtttacaacatgatggggaaacgcgaaaagaagctgggcgagtttggaaaagccaagggcagcagagccatttggtacatgtggcttggggctcggtatctggagttcgaggccctcggatttctgaatgaggatcattggttctcccgcgaaaactcttacagcggcgtggagggggaaggactgcacaaactcggctatatcctgagagacatctccaagattcccgggggcgctatgtacgccgatgacaccgcgggatgggacacacggatcaccgaggatgaccttcataatgaagagaaaattacacagcagatggatcctgagcacagacaactggccaacgctatctttaagctcacctatcagaataaggtcgtgaaagtccagcggcccacaccgaccggcacggtgatggacattatctctcgcaaggatcagagagggagcggacaagttggcacatacgggctgaacaccttcaccaatatggaagcccagcttatccggcagatggagggagaaggcgtgctgtccaaagctgacctcgagaaccctcatctgcccgaaaagaaaattacacagtggctggagaccaagggggtcgagcgcctcaagagaatggccatcagcggcgatgactgcgtggtgaaacccattgatgaccggtttgcgaacgccctgcttgctctgaatgatatgggaaaggttcgcaaagacatccctcaatggcagccgtctaagggctggcatgattggcaacaggtgcccttctgttcccaccatttccacgaactcattatgaaagacgggagaaagctggtcgtgccttgccggccccaagacgagcttatcggacgcgccagaattagccagggcgctgggtggtctctgcgggaaacagcctgtctcggaaaggcttatgcccagatgtggtccctgatgtactttcaccgcagagatctgcggctcgcgagcaacgccatctgctctgctgttcctgtgcattgggtccccacgtcccgcaccacatggagcatccacgcccatcaccaatggatgaccacagaggacatgctgaccgtgtggaatagagtctggattgaagataacccttggatggaggacaaaacgcccgtgaccacatgggagaatgttccgtaccttggcaagcgggaagatcagtggtgtgggtccctgatcggcctcaccagcagagccacatgggctcagaacattcctaccgccatccagcaagtgcgctctctgattggaaatgaggagttccttgactatatgcccagcatgaaacggtttagaaaggaggaggaatccgagggcgcgatctggtga

SEQ ID NO: 20722 - RNA, 9873 nt, synthetic construct
  misc_feature 1..9873: note = derived and/or modified CDS sequence (opt5) from DENV-3__FJ410176__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggcaagtctctcctgtttaagacggcgtccggcatcaatatgtgtacccttattgctatggatctgggggagatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggatcttccctgagaacaaccacggtcagcgggaaactgatccacgagtggtgctgtcgctcttgcacccttcccccgctccggtacatgggagaagatggctgttggtatgggatggagatcagacctatttccgaaaaggaggagaatatggtgaaaagcctggtttctgctggaagcggcaaggtggacaacttcacaatgggggtcctgtgcctcgccatcctgtttgaagaggtgatgcggggaaagttcggcaaaaagcatatgattgccggcgttcttttcacctttgtgctgctcctgtccgggcagatcacatggcgcgatatggctcacaccctgattatgatcggaagcaatgcctctgacagaatgggcatgggggtcacgtaccttgcgctgattgctacattcaaaatccagccctttctcgccctgggattctttctccggaagctgacctccagagaaaaccttctgctcggcgtggggctggccatggctacaaccctgcaacttcccgaggatatcgaacagatggccaatggaattgctctgggcctcatggccctgaaactcaccacacagttcgagacgtatcagctgtggaccgcgcttatcagcctgacatgttccaacaccatttttacactcaccgtggcctggcgcacggctacactgatcctggccggcgtctctcttctgcctgtttgccaaagctcctctatgcggaagaccgactggctcccgatgaccgtggctgccatgggggtgccccctctgcccctcttcatttttagcctgaaggatacacttaaaagacgctcctggcctctgaatgagggagtcatggccgtgggcctggtttctatcctcgctagctccctgcttagaaacgacgtgcccatggcggggcctctggtcgccggaggcctcctgatcgcttgttacgtgattaccgggacaagcgccgatctcacggttgaaaaggccgctgacgtgacctgggaggaagaggccgaacagacaggagtctctcataacctgatgatcaccgtggacgatgacggcacaatgcggattaaagatgacgagaccgagaatatccttacggtcctgctgaagaccgcgctcctgattgtgtccggcatcttcccctacagcatcccggctacacttctggtttggcacacctggcagaaacagacacaacgctctggggtgctctgggatgtcccttctccccctgaaacccagaaggccgagctggaagagggagtgtatagaattaaacagcagggcatctttgggaagacacaagttggagtgggcgtccagaaggagggggtgttccatacgatgtggcacgtgacccggggagccgttctcacatacaacggcaaacgcctggaacccaattgggctagcgtcaagaaagaccttattagctatggcgggggatggagactgtccgcccagtggcaaaagggcgaggaagtccaggtgatcgcggtcgagccggggaaaaaccctaagaattttcagaccatgcccggaaccttccagacaacgaccggcgaaattggggctatcgccctggatttcaagcctggaacaagcggctcccccattatcaaccgggagggcaaagtggttgggctctacggaaatggcgtggtcaccaagaacgggggatatgtgagcggcatcgcccaaacaaatgctgagcccgacgggcctaccccggaactggaggaagagatgtttaaaaagcgcaaccttacgattatggatctgcaccccggctctggaaaaacaagaaagtacctccctgccatcgttcgggaagctattaagcgcagactgcggaccctcatcctggcccccaccagagtggtcgcggccgagatggaggaagctcttaaaggcctgcctattcgctatcagacaaccgccacaaagagcgagcataccgggcgggaaatcgtggacctgatgtgccacgctacgttcacaatgagactcctgtcccccgttcgcgtgcctaattacaaccttatcattatggatgaggcccattttaccgacccggcctctatcgctgcgcggggatacattagcacaagagtcggcatgggggaagccgctgccatcttcatgaccgccacgccccctggaaccgctgatgcctttccccagtccaatgcgcctattcaggacgaggagcgcgacatccccgaacggtcttggaacagcggcaatgagtggatcacagatttcgctgggaaaaccgtgtggtttgtgccgtccattaaggccggcaacgacatcgccaactgtctgcgcaaaaatggaaagaaggtcattcaactctctagaaaaacattcgataccgaatatcagaagacaaaactgaacgactgggattttgttgtgaccacggacatcagcgagatgggcgctaatttcaaggccgatcgggtgattgaccctagacggtgcctgaaacccgtcatcctcacagatgggcccgagcgcgtgattcttgcgggacctatgcccgttaccgccgcttccgccgctcagagacggggccgcgtggggagaaaccctcagaaggaaaatgaccaatacatctttaccggacagccgctgaacaatgatgaggaccacgcccattggacagaagctaagatgctgctcgacaacatcaatacccccgagggcattatccctgccctgttcgaacccgagcgggagaaaagcgcggccattgatggggaatatagacttaagggcgagtctcgcaaaacattcgtcgaactgatgcggagaggagacctccctgtgtggctggctcacaaggttgcctccgagggcatcaaatacacggatcgcaagtggtgctttgacgggcagcggaacaatcagattctggaagagaacatggatgtggagatctggaccaaagaaggagagaagaagaaactcagaccccgctggcttgacgctcggacatatagcgatccgctggccctgaaggagttcaaagactttgccgctggcagaaagtctatcgcgctcgatctggtcaccgagattgggcgcgtgccttcccaccttgcccatagaacacggaatgctctggacaacctcgtcatgctgcacaccagcgaacatggaggcaaagcctaccgccacgccgtggaggagctgcccgaaacgatggagaccctccttctgctgggcctcatgatcctgcttacagggggagctatgctgttcctcatttccggcaaggggatcggaaagacctctattggcctgatctgtgttatcgccagctccgggatgctgtggatggcggaaattcctctccaatggatcgccagcgctattgtgcttgagtttttcatgatggtgctgctgatccccgagcctgaaaaacagagaacaccccaggataatcaactcgcctatgtcgttattggaatcctgacccttgctgccattatcgcggccaacgagatgggcctgctcgaaacgacaaagcgggacctgggcatgtctaaagagccgggggtggtgtcccctaccagctacctggatgtcgacctccaccccgcttctgcctggacactttacgctgtggccaccaccgttatcacacccatgctgcgccatacgattgaaaatagcaccgctaacgtgtccctggccgcgatcgccaaccaggctgtcgtgctcatgggactggacaagggctggcctatttctaaaatggatcttggggtcccgctgctcgccctgggatgctatagccaggtgaatcccctgacactcaccgctgccgttcttctgctgatcacacactacgccattatcggccctgggctccaggcgaaggctaccagagaggcccaaaagcggacggctgccggaatcatgaaaaaccccacagtggacggcattatgaccatcgatctggaccctgtcatttatgattccaagtttgagaaacagcttggccaggtgatgctgctcgttctgtgtgccgtgcagctgctccttatgagaacctcttgggctctgtgcgaagccctgacactcgcgaccgggcccatcacaacgctgtgggagggaagccctggcaagttctggaataccacaattgccgtctccatggctaacatctttcgcgggagctaccttgccggagctggcctggccttctctatcatgaaatccgtggggaccggaaagcggggcacaggcagccaaggggaaaccctcggagagaagtggaaaaagaaactgaatcagctgtccagaaaggaatttgacctctataaaaagtctggcattacggaggtggatcgcaccgaggcgaaagaagggcttaagcggggagagatcacacatcacgccgttagcagaggctccgctaagctgcagtggttcgtcgaacggaacatggtgattccggaggggcgcgtgatcgacctgggatgtggcagaggcgggtggtcttactattgcgccggactcaaaaaggtcaccgaagttcggggctacacaaaagggggacccggccatgaggagcctgtgcccatgagcacctacgggtggaatattgtgaagctgatgtccggaaaagatgtcttttatcttcctcccgaaaagtgtgacacactgctctgcgatatcggcgagagctctccgtcccctaccgtggaagagagccgcacgattagagttctgaagatggtggagccctggctgaaaaacaatcagttctgtatcaaggtcctcaacccctacatgcctacagtgatcgaacaccttgagcggctgcaacgcaaacacggcgggatgctggttagaaatcccctctctcggaactccacccatgaaatgtattggattagcaatggaaccggcaacatcgtggcttctgtcaatatggtgagccgcctgcttctgaacagattcacaatgacgcaccggagacctaccattgagaaggacgtggatctcggggccggaacacgccatgtcaacgctgaaccggagacccccaatatggacgttatcggcgagcggattaaaagaatcaaggaagaacacaactccacatggcactacgacgatgaaaatccttataagacctgggcctaccatgggtcttatgaggtgaaagcgacaggaagcgcctccagcatgatcaacggcgtggtcaagctgctgaccaaaccctgggacgtggttcctatggtgacgcagatggctatgaccgatacaaccccctttggccagcaacgcgtcttcaaggaaaaagtggacacacggaccccgagatccatgcctgggacgcgccgggttatgggaattacagccgagtggctctggagaaccctgggccgcaataagaagccccggctttgcacaagagaggaatttaccaaaaaggtgcgcacgaacgctgccatgggggccgtcttcaccgaggaaaatcagtgggattctgcgaaagctgccgtggaggacgaagatttttggaagctggttgaccgggagagagagctccacaaactgggaaagtgtggcagctgcgtgtacaacatgatggggaaacgcgaaaagaaacttggcgagttcggaaaagccaagggctccagagctatctggtacatgtggctgggggcccggtatctcgaatttgaggctctgggattcctgaatgaggatcattggttttctcgcgaaaacagctactccggcgtcgagggggaaggactccacaaactgggctatattcttagagacatctctaagattcctgggggcgccatgtacgcggatgacacagccggatgggacacccggatcacagaggatgacctgcataatgaagagaaaatcacccagcagatggatcccgagcacagacaactcgctaacgccattttcaagctgacatatcagaataaggtggtcaaagtgcagcggcctacccccacgggcacagttatggacatcattagccgcaaggatcagagagggtccggacaagtgggcacctacgggcttaacacctttacaaatatggaagctcagctgatccggcagatggagggagaaggcgtcctcagcaaagccgacctggagaacccgcatctgcctgaaaagaaaattacccagtggctcgagacaaagggggtggagcgcctgaagagaatggcgatctctggcgatgactgcgtggttaaacccatcgatgaccggttcgccaacgcccttctggccctcaatgatatgggaaaggtgcgcaaagacattccccaatggcagccttccaagggctggcatgattggcagcaggtcccgttttgtagccaccatttccacgaactgatcatgaaagacgggagaaaacttgtggttccctgccggcctcaagacgagctgattggacgcgctagaatctctcagggcgccgggtggtccctccgggaaacggcttgtctgggaaaggcctatgcgcagatgtggagcctgatgtacttccaccgcagagatctccggctggcctctaacgctatttgctccgccgtgcccgtccattgggtgcctaccagccgcacaacctggtccatccacgcccatcaccaatggatgacaaccgaggacatgcttacggtctggaatagagtgtggattgaagataacccctggatggaggacaaaacccctgttacaacctgggagaatgtgccctacctgggcaagcgggaagatcagtggtgtgggagcctcatcggcctgacatctagagctacctgggcccagaacatcccgacggcgattcagcaagtccgcagccttatcggaaatgaggaatttctggactatatgccttccatgaaacggttcagaaaggaggaggaatctgagggcgctatttggtga

SEQ ID NO: 20723 - RNA, 9873 nt, synthetic construct
  misc_feature 1..9873: note = derived and/or modified CDS sequence (opt5) from DENV-3__FJ410177__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcaccggcgggccctctctgcggacaaccacggtctccggaaaactgatccacgagtggtgctgtagaagctgcacccttccgcctctccgctacatgggcgaagatgggtgttggtatggaatggagatccggcccatttctgaaaaggaggagaatatggtgaaatccctggttagcgctggctctgggaaggtggacaacttcacaatgggagtcctgtgcctcgccatcctgtttgaagaggtgatgagaggcaagttcggcaaaaagcatatgattgccggggttttctttaccttcgtgcttctgctcagcggacagatcacatggcgggatatggctcacaccctgattatgatcggctccaatgccagcgaccgcatggggatgggagtcacgtacctggcgcttattgctacatttaaaatccagcccttcctggccctcggctttttcctgagaaagctcacctctcgggaaaacctgcttctgggggtgggactcgccatggctacaaccctgcaactgcctgaggatatcgaacagatggccaatggcattgctcttggcctgatggccctcaaactgaccacacagtttgagacgtatcagctctggaccgcgctgatctcccttacatgtagcaacaccattttcacactgaccgtggcctggagaacggctacactcatcctggccggggtctccctgcttccggtttgccaatctagctccatgcgcaagaccgactggctgcccatgaccgtggctgccatgggagtgcctcccctccctctgtttattttctctctcaaggatacactgaaacggagaagctggccccttaatgagggcgtcatggccgtggggctggtttccatcctggcttctagcctcctgcgcaacgacgtgcctatggcgggaccccttgtcgccggcgggctgctcatcgcttgttacgtgattaccggaacatccgccgatctgacggttgaaaaggccgctgacgtgacctgggaggaagaggccgaacagacaggcgtcagccataacctcatgatcaccgtggacgatgacggcacaatgagaattaaagatgacgagaccgagaatatcctgacggtccttctgaagaccgcgctgctcattgtgtctgggatctttccgtactccatccctgctacactgcttgtttggcacacctggcagaaacagacacaacggagcggagtgctgtgggatgtcccctctcctcccgaaacccagaaggccgagctcgaagagggcgtgtatcgcattaaacagcaggggatcttcggaaagacacaagttggcgtgggggtccagaaggagggagtgtttcatacgatgtggcacgtgaccagaggcgccgttctgacatacaacggcaaacggctcgaaccgaattgggcttccgtcaagaaagacctgattagctatgggggaggctggcgcctttctgcccagtggcaaaagggggaggaagtgcaggtgatcgcggtcgagcctggaaaaaaccccaagaatttccagaccatgcctggcaccttccagacaacgaccggggaaattggagctatcgccctggattttaagcccggcacatccggcagccccattatcaacagagaggggaaagtggttggactgtacggcaatggggtggtcaccaagaacggaggctatgtgtccgggatcgcccaaacaaatgctgagcctgacggcccgacccccgaactcgaggaagagatgttcaaaaagcggaacctgacgattatggatcttcaccctggaagcggcaaaacacgcaagtacctgcccgccatcgttagagaagctattaagcggcgcctcagaaccctgatcctcgcccctacccgggtggtcgcggccgagatggaggaagctctgaaagggcttcccattagatatcagacaaccgccacaaagtctgagcataccggacgcgaaatcgtggacctgatgtgccacgctacgtttacaatgcggctgctcagccctgttagagtgccgaattacaacctgatcattatggatgaggcccatttcaccgaccccgcctccatcgctgcgcgcggctacatttctacacgggtcgggatgggagaagccgctgccatctttatgaccgccacgcctcccggcaccgctgatgccttccctcagagcaatgcgcccattcaggacgaggagagagacatcccggaacgctcctggaactctgggaatgagtggatcacagattttgctggcaaaaccgtgtggttcgtgcctagcattaaggccggaaacgacatcgccaactgtcttcggaaaaatggcaagaaggtcattcaactgtccagaaaaacatttgataccgaatatcagaagacaaaactcaacgactgggatttcgttgtgaccacggacatctctgagatgggggctaattttaaggccgatcgcgtgattgacccccggagatgcctgaaacccgtcatcctgacagatggacctgagcgggtgattctcgcgggccccatgcctgttaccgccgctagcgccgctcagcgcagagggcgggtgggacgcaacccgcagaaggaaaatgaccaatacatcttcaccggccagccccttaacaatgatgaggaccacgcccattggacagaagctaagatgctgctggacaacatcaatacccctgaggggattatccccgccctcttcgaacctgagagagagaaatccgcggccattgatggcgaatatcggctgaagggagagagcagaaaaacatttgtcgaacttatgcgccggggcgacctgcccgtgtggctcgctcacaaggttgcctctgaggggatcaaatacacggatagaaagtggtgcttcgacggacagcgcaacaatcagattctggaagagaacatggatgtggagatctggaccaaagaaggcgagaagaagaaactgcggccgagatggctcgacgctcgcacatattccgatcctcttgccctgaaggaatttaaagacttcgccgctgggcggaagagcatcgcgctggatctcgtcaccgagattggaagagtgccctctcacctggcccatcgcacaagaaatgctcttgacaacctggtcatgctccacacctccgaacatggcggcaaagcctaccggcacgccgtggaggagctgcctgaaacgatggagaccctgctccttctggggctgatgatcctcctgacaggaggcgctatgctttttctgattagcgggaagggaatcggcaagacctccattgggctcatctgtgttatcgcctctagcggaatgctgtggatggcggaaattcccctgcaatggatcgcctccgctattgtgctcgagttctttatgatggtgcttctgatccctgagcccgaaaaacagcgcacaccgcaggataatcaactggcctatgtcgttattggcatcctcaccctggctgccattatcgcggccaacgagatgggccttctggaaacgacaaagagagacctcgggatgagcaaagagcctggagtggtgtctcccacctcctacctggatgtcgacctgcaccccgctagcgcctggacactctacgctgtggccaccaccgttatcacacctatgcttcggcatacgattgaaaattctaccgctaacgtgagcctggccgcgatcgccaaccaggctgtcgtgctgatgggcctcgacaaggggtggccgatttccaaaatggatctgggagtcccccttctggccctcggctgctattctcaggtgaatcctctgacactgaccgctgccgttctccttctgatcacacactacgccattatcgggcccggactgcaggcgaaggctacccgcgaggcccaaaagagaacggctgccggcatcatgaaaaaccctacagtggacggcattatgaccatcgatctcgaccccgtcatttatgatagcaagttcgagaaacagctggggcaggtgatgcttctggttctctgtgccgtgcagctgctgctcatgcggacctcctgggctctttgcgaagccctgacactggcgaccggacctatcacaacgctctgggagggctctccggggaagttttggaataccacaattgccgtcagcatggctaacatcttcagaggatcctacctggccggcgctgggcttgcctttagcatcatgaaatctgtgggaaccggcaagcgcggcacagggtcccaaggagaaaccctgggcgagaagtggaaaaagaaactcaatcagctgagccggaaggaattcgacctgtataaaaagtccgggattacggaggtggatagaaccgaggcgaaagaaggactcaagcgcggcgagatcacacatcacgccgtttctcgggggagcgctaagcttcagtggtttgtcgaaagaaacatggtgattcccgagggacgggtgatcgacctgggctgtggccgcgggggatggtcctactattgcgccggcctgaaaaaggtcaccgaagttagagggtacacaaaaggaggccctgggcatgaggagcccgtgcctatgtctacctacggatggaatattgtgaagctcatgagcggcaaagatgtcttctatctgcccccggaaaagtgtgacacacttctgtgcgatatcggcgagtccagcccttctcccaccgtggaagagtcccggacgattcgcgttctcaagatggtggagccctggctgaaaaacaatcagttctgtatcaaggtcctgaacccttacatgcccacagtgatcgaacacctcgagagacttcaacggaaacacgggggaatgctggttcgcaatcctctgagcagaaactctacccatgaaatgtattggatttccaatggcaccgggaacatcgtggctagcgtcaatatggtgtctcggctcctgcttaaccgctttacaatgacgcacagacggccgaccattgagaaggacgtggatctgggagccggcacaagacatgtcaacgctgaacccgagacccctaatatggacgttatcggggagcgcattaaacggatcaaggaagagcacaacagcacatggcactacgacgatgaaaatccctataagacctgggcctaccatggatcctatgaggtgaaagcgacaggctctgccagctccatgatcaacggcgtggtcaagctcctgaccaaaccttgggacgtggttcccatggtgacgcagatggctatgaccgatacaaccccgttcgggcagcaaagagtctttaaggaaaaagtggacacacgcacccctcggagcatgcccggaacgagacgcgttatgggcattacagccgagtggctgtggcggaccctcgggagaaataagaagcctcgcctgtgcacacgggaggaattcaccaaaaaggtgagaacgaacgctgccatgggagccgtctttaccgaggaaaatcagtgggattccgcgaaagctgccgtggaggacgaagatttctggaagcttgttgaccgcgagcgggagctgcacaaactcggcaagtgtgggtcttgcgtgtacaacatgatgggcaaaagagaaaagaagctgggagagtttggcaaagccaaggggagccgcgctatctggtacatgtggcttggagccagatatctggaattcgaggctctcggctttctgaatgaggatcattggttctcccgggaaaactcttacagcggggtcgagggagaaggcctgcacaaactcgggtatattctgcgcgacatctccaagattcccggcggagccatgtacgcggatgacacagccggctgggacaccagaatcacagaggatgaccttcataatgaagagaaaatcacccagcagatggatcctgagcaccggcaactggctaacgccatttttaagctcacatatcagaataaggtggtcaaagtgcagagacccaccccgacggggacagttatggacatcatttctcggaaggatcagcgcggaagcggccaagtggggacctacggactgaacaccttcacaaatatggaagctcagcttatcagacagatggagggcgaaggggtcctgtccaaagccgacctcgagaaccctcacctgcccgaaaagaaaattacccagtggctggagacaaagggcgtggagcggctcaagcgcatggcgatcagcggagatgactgcgtggttaaacccatcgatgacagatttgccaacgctctgcttgccctgaatgatatgggcaaggtgcggaaagacattcctcaatggcagccgtctaaggggtggcatgattggcagcaggtccccttctgttcccaccatttccacgaactcatcatgaaagacggacgcaagctggtggttccttgcagaccccaagacgagcttattggccgggctcgcatcagccagggggccggatggtctctgagagaaacggcttgtctcggcaaggcctatgcgcagatgtggtccctgatgtactttcaccggcgcgatctgagactcgccagcaacgctatttgctctgccgtgcctgtccattgggtgcccacctcccggacaacctggagcatccacgcccatcaccaatggatgacaaccgaggacatgctgacggtctggaatcgcgtgtggattgaagataacccttggatggaggacaaaacccccgttacaacctgggagaatgtgccgtaccttgggaagagagaagatcagtggtgtggctccctgatcggactcacaagccgggctacctgggcccagaacatccctacggcgattcagcaagtcagatctctgatcggcaatgaggaattccttgactatatgcccagcatgaaacgctttcggaaggaggaggaatccgagggggctatttggtga

SEQ ID NO: 20724 - RNA, 9873 nt, synthetic construct
  misc_feature 1..9873: note = derived and/or modified CDS sequence (opt5) from DENV-3__FJ547072__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaagatctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaaaagatctgtggccctggctcctcatgtcgggatgggactggatacccggacacaaacctggatgagcgccgagggcgcttggcgccaggtggaaaaggttgagacatgggccctcagacaccccggcttcaccatcctggcgctttttctggcccattacatcgggacgtccctcacacagaaagtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaagaataagcccacgctggacattgagctccagaaaaccgaagctacacaactggccacccttagaaagctgtgtatcgagggaaaaattacaaacatcaccacggattcccggtgccctacacagggcgaagcggtgctcccggaggaacaggaccagaattatgtgtgtaagcacacctacgtcgatcgcggctgggggaacggatgcggcctgttcgggaaaggaagccttgtgacctgcgccaagtttcaatgtctggagcccattgagggcaaggttgtgcagtatgaaaatctcaaatacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaagaacaaagcctggatggtccatcggcagtggtttttcgatctccccctgccgtggacaagcggcgccaccacagaaacccctacgtggaatcgcaaggagcttctggtgacatttaaaaacgctcacgcgaagaaacaagaagtcgtggttctcgggtctcaggagggagccatgcacaccgctctgacaggcgccaccgaaatccagaattccgggggcaccagcattttcgccggacatctgaagtgtagactcaagatggacaaactggagcttaagggcatgtcttacgctatgtgcacaaacacgtttgtgctgaaaaaggaggtctccgaaacccagcacgggacaatcctcatcaaagtggagtacaagggagaagatgttccctgtaagattcctttcagcaccgaggacggccaagggaaagcccataacggacggctgatcacagcgaatcccgtggtcaccaagaaagaggaacccgtgaacattgaggctgaacctccgttcggcgagtccaatatcgtgattgggatcggcgataacgccctgaagatcaattggtataaaaagggatctagcattggcaagatgtttgaagccacggctagaggggcccgccggatggctatccttggagacacagcctgggatttcggctccgttgggggagtcctcaacagcctgggcaaaatggtgcaccagatttttgggtctgcgtacaccgccctgttctccggcgtgagctgggtcatgaagatcggaattggcgtgctcctgacctggatcgggcttaattctaaaaacacaagcatgtccttttcttgcattgttatcggaatcattaccctgtatctcggcgctgtggtccaggccgacatggggtgtgtgatcaattggaagggaaaagagctgaagtgcggcagcgggattttcgttacaaacgaggtgcatacgtggaccgaacagtacaagtttcaagctgattcccccaaaagactggccacagcgatcgccggcgcttgggagaatggagtctgtggcattcgcagcaccacacggatggaaaaccttctctggaagcagatcgccaatgagctgaactatatcctgtgggaaaataacattaaactcaccgtggttgtgggggacatcattggagtcctggagcagggcaagagaacgcttacccctcagcccatggagctgaaatactcttggaagacatgggggaaagctaagatcgtgaccgccgaaacacaaaactccagcttcattatcgatggacctaatacccccgagtgcccgtctgcctcccgcgcttggaacgtgtgggaagtcgaggactatggctttggcgttttcacaaccaatatctggctcaagctgcgggaagtgtacacgcagctgtgtgaccacagacttatgagcgcggccgtgaaagatgagcgcgctgtccacgccgacatggggtactggattgagtcccagaagaacggatcttggaaactcgaaaaggccagcctgatcgaggtgaaaacatgcacctggcctaagtcccataccctgtggtctaatggcgttctcgaaagcgatatgattatccccaagtccctggctgggcctattagccagcacaactatcggcccggataccatacacaaaccgccggcccttggcaccttgggaaactggagctcgactttaattattgcgagggaacgacagtggtcatcaccgaaaactgtggcacaagaggcccctctctgcgcaccacaaccgtgtccgggaagctgatccacgagtggtgctgtcggagctgcacgcttccgcctctcagatacatgggagaagatggctgttggtatgggatggagattcggcccatctctgaaaaagaggagaatatggttaagtccctggtgagcgcgggatctggcaaagtcgacaacttcaccatgggggtgctgtgcctcgctattctgtttgaagaggttatgcgcggaaagttcggcaagaaacatatgatcgccggcgtgttctttacattcgtccttctgctcagcgggcagattacctggagagatatggcccacacactgatcatgattggatccaatgctagcgaccggatgggcatgggggtgacctacctggcccttatcgcgacgtttaagatccagcccttcctggctctcggatttttcctgagaaaactcacatctcgcgaaaacctgcttctgggcgtggggctcgccatggccaccacactgcaactgcctgaggatattgaacagatggctaatggaatcgcccttggcctgatggctctcaagctgattacccagtttgagacctatcagctctggacagccctgatctcccttacgtgtagcaacaccattttcacactgaccgtcgcgtggcggacagccaccctcatcctggctggcgtttccctgcttccggtgtgccaatctagctccatgagaaaaacggactggctgcccatgacagtggccgctatgggggtccctcccctccctctgtttatcttctctctcaaggataccctgaagcgcagaagctggccccttaatgagggagtgatggccgttggcctggtgtccattctggcctctagcctcctgcggaacgacgtccctatggctgggccccttgtggcgggaggcctgctcatcgcctgttacgttattaccgggacatccgctgatctgaccgtggaaaaagccgccgacgtcacatgggaggaagaggctgaacagacgggagtgagccataacctcatgatcaccgtcgacgatgacggcacaatgcgcattaaggatgacgagaccgagaatatcctgacagtgcttctgaaaaccgccctgctcatcgtttctggcatttttccgtactccatccctgcgacgctgcttgtgtggcacacctggcagaagcagacacaaagaagcggggtcctgtgggatgtgccctctcctcccgaaacccagaaagctgagctcgaagagggagtttatcggattaagcagcagggcatcttcgggaaaacacaagtgggagtcggcgtgcagaaggagggggtgtttcataccatgtggcacgttacacgcggagccgtcctgacgtacaacggcaagagactcgaaccgaattgggcctccgtgaaaaaggacctgattagctatggcgggggatggcggctttctgctcagtggcaaaaaggcgaggaagtgcaggtcatcgccgtggagcctgggaagaaccccaaaaatttccagaccatgcctggaacattccagaccaccacaggcgaaattggggcgatcgctctggattttaagcccggaacgtccggcagccccatcattaaccgcgagggcaaggttgtggggctgtacggaaatggcgtcgtgaccaaaaacgggggatatgtttccggcatcgcccaaacaaatgccgagcctgacgggccgacccccgaactcgaggaagagatgttcaagaaaagaaacctgacaattatggatcttcaccctggcagcggaaagacccggaaatacctgcccgctatcgtgcgcgaagccattaagagacggctcagaacgctgatcctcgctcctacacgcgtcgtggccgcggagatggaggaagccctgaagggccttcccatccggtatcagaccaccgctacaaaatctgagcataccgggagagaaattgttgacctgatgtgccacgccacatttaccatgcgcctgctcagccctgtgcgggtcccgaattacaacctgatcattatggatgaggctcatttcacggaccccgcctccatcgccgctagaggatacatttctacacgcgtgggcatgggggaagcggccgctatctttatgaccgccacacctcccggaaccgccgatgctttccctcagagcaatgcccccatccaggacgaggagcgggacattccggaaagatcctggaactctggcaatgagtggatcacggattttgcggggaagaccgtgtggttcgtccctagcattaaagctggcaacgacatcgccaactgtcttcgcaagaatggaaaaaaggttattcaactgtcccggaagacatttgataccgaatatcagaaaacaaagctcaacgactgggatttcgtggtgaccacagacatctctgagatgggcgccaattttaaagctgatagagtcattgacccccggcgctgcctgaagcccgtgatcctgaccgatgggcctgagagagttatcctcgccggacccatgcctgtgacggcggccagcgctgcccagcggcgcggcagagtcgggcggaacccgcagaaagaaaatgaccaatacattttcacaggacagccccttaacaatgatgaggaccacgctcattggaccgaagccaagatgctgctggacaacatcaatacccctgagggcattatccccgctctcttcgaacctgagagagagaagtccgccgcgattgatggggaatatcgcctgaaaggcgagagccggaagacatttgtggaacttatgagacgcggagacctgcccgtttggctcgcccacaaagtggcttctgagggcatcaagtacaccgatcggaaatggtgcttcgacgggcagagaaacaatcagatcctggaagagaacatggatgtcgagatttggacaaaggaaggagagaaaaagaagctgcgcccgcggtggctcgacgccagaacgtattccgatcctcttgctctgaaagaatttaaggacttcgccgccggccgcaaaagcatcgctctggatctcgtgaccgagattgggagagtcccctctcacctggcgcatcggacacgcaatgcccttgacaacctggtgatgctccacacctccgaacatggaggcaaggcttacagacacgccgttgaggagctgcctgaaacaatggagaccctgctccttctgggcctgatgatcctcctgacggggggagccatgctttttctgattagcggcaaagggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaagcagcggacaccgcaggataatcaactggcttatgttgtgattggaatcctcaccctggccgctatcattgccgcgaacgagatgggccttctggaaacaaccaaacgcgacctcggcatgagcaaggagcctggggtggtctctcccacgtcctacctggatgtggacctgcaccccgccagcgcttggacactctacgccgttgctaccacagtgatcacccctatgcttagacataccattgaaaattctacagccaacgtcagcctggctgccatcgcgaaccaggccgtggtcctgatgggactcgacaaaggctggccgatttccaagatggatctgggggtgccccttctggctctcggatgctattctcaggttaatcctctgacgctgaccgccgctgtgctccttctgatcacacactacgccatcattggccccgggctgcaggccaaagcgacccgggaggctcaaaagagaacagccgctggaatcatgaagaaccctaccgtcgacggcattatgacgatcgatctcgaccccgtgatttatgatagcaaattcgagaagcagctgggccaggttatgcttctggtgctctgtgccgtccagctgctgctcatgcgcacatcctgggccctttgcgaagctctgaccctggccaccgggcctatcacaaccctctgggagggatctccgggcaaattttggaatacaacgatcgcggtgagcatggccaacattttccgggggtcctacctggctggagccggccttgcttttagcatcatgaagtctgtggggaccggaaaaagaggcacaggctcccaaggggaaaccctgggagagaagtggaagaaaaagctcaatcagctgagccgcaaagaattcgacctgtataagaaatccggcattacagaggttgatcggaccgaggccaaggaagggctcaaaagaggagagatcacgcatcacgcggtctctcggggcagcgccaagcttcagtggtttgtggaacgcaacatggtgattcccgaggggagagtcatcgacctgggatgtggccggggcgggtggtcctactattgcgctggactgaagaaagttaccgaagtgcgcggctacacaaaggggggacctggccatgaggagcccgtgcctatgtctacctacgggtggaatattgtcaaactcatgagcggaaaggatgtgttctatctgcccccggaaaaatgtgacacacttctgtgcgatatcggcgagtccagcccttctcccaccgttgaagagtccagaacaatccgggtgctcaagatggtcgagccctggctgaagaacaatcagttctgtattaaagtgctgaacccttacatgcccaccgttatcgaacacctcgagcgccttcaaagaaagcacggcgggatgctggtgcggaatcctctgagccgcaactctacgcatgaaatgtattggatttccaatggaacaggcaacatcgtcgccagcgtgaatatggtgtctagactcctgcttaaccggtttaccatgacccacagacgcccgacaattgagaaagacgtcgatctgggggctggaacgcggcatgttaacgccgaacccgagacccctaatatggacgtgatcggcgagagaatcaagcgcattaaagaagagcacaacagcacatggcactacgacgatgaaaatccctataagacctgggcttaccatgggtcctatgaggtgaaggccacaggatctgcgagctccatgatcaacggcgtcgtgaaactcctgaccaagccttgggacgttgtgcccatggtcacacagatggccatgaccgatacgaccccgttcggccagcaacgggtgtttaaagaaaaggttgacacaagaacccctcgcagcatgcccgggacacggagagtgatgggaattaccgctgagtggctgtggcgcacgctcggccggaataaaaagcctagactgtgcacacgcgaggaattcaccaagaaagtccggacaaacgccgctatgggggccgtgtttaccgaggaaaatcagtgggattccgccaaggcggctgttgaggacgaagatttctggatccttgtggacagagagcgcgagctgcacaaactcggaaagtgtggctcttgcgtctacaacatgatggggaaaagagaaaagaaactgggcgagtttggaaaggccaagggcagccgggccatttggtacatgtggcttggggctcgctatctggaattcgaggccctcggatttctgaatgaggatcattggttctccagagaaaactcttacagcggcgtggagggggaaggactgcacaaactcggctatatcctgcgggacatctccaagattcccgggggcgctatgtacgccgatgacacggcgggatgggacaccagaatcacagaggatgaccttcataatgaagagaaaattacccagcagatggatcctgagcaccggcaactggccaacgctatctttaagctcacatatcagaataaagtcgtgaaggttcagcgccccaccccgacaggcaccgtgatggacattatctctagaaaggatcagcgggggagcggacaagtcggcacgtacgggctgaacacattcaccaatatggaagcccagcttatccgccagatggagggagaaggcgtgctgtccaaagctgacctcgagaaccctcacctgcccgaaaagaaaattacccagtggctggagacaaagggggtggagagactcaaacggatggccatcagcggcgatgactgcgttgtgaagcccattgatgaccgctttgcgaacgccctgcttgctctgaatgatatgggaaaggtcagaaaagacatccctcaatggcagccgtctaagggctggcatgattggcagcaggtgcccttctgttcccaccatttccacgaactcattatgaaagacgggcggaagctggttgtgccttgccgcccccaagacgagcttatcggaagagcccggattagccagggcgctgggtggtctctgcgcgaaaccgcctgtctcggaaaagcttatgcccagatgtggtccctgatgtactttcacagacgggatctgcgcctcgcgagcaacgccatctgctctgctgtccctgtgcattgggtccccacatccagaacgacctggagcatccacgcccatcaccaatggatgacaaccgaggacatgctgacagtgtggaatcgggtttggattgaagataacccttggatggaggacaagacccccgtgacgacctgggagaatgtcccgtaccttggcaagagagaagatcagtggtgtgggtccctgatcggcctcacaagccgcgccacctgggctcagaacattcctacagccatccagcaagtgcggtctctgattggaaatgaggaattccttgactatatgcccagcatgaaaagatttcgcaaggaggaggaatccgagggcgcgatctggtga

SEQ ID NO: 20725 - RNA, 9873 nt, synthetic construct
  misc_feature 1..9873: note = derived and/or modified CDS sequence (opt5) from DENV-3__FJ547073__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaatatcagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcagaaggaaaatgaccaatacattttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtttggctcgcccacaaggtggcttctgagggcatcaaatacaccgatcgcaagtggtgcttcgacgggcagcggaacaatcagatcctggaagagaacatggatgtcgagatttggacaaaagaaggagagaagaagaaactgagaccgcgctggctcgacgcccggacgtattccgatcctcttgctctgaaggaatttaaagacttcgccgccggcagaaagagcatcgctctggatctcgtgaccgagattgggcgcgtcccctctcacctggcgcatagaacacggaatgcccttgacaacctggtgatgctccacacctccgaacatggaggcaaggcttaccgctatgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaaacagagaacaccgcaggataatcaactggcttacgttgtgattggaatcctcaccctggccgctatcattgccgcgaacgagatgggccttctggaaacaaccaagcgggacctcggcatgagcaaagagcctggggtggtctctcccacgtcctacctggatgtggacctgcaccccgccagcgcttggacactctatgccgttgctaccacagtgatcacccctatgcttcgccacaccattgaaaattctacagccaacgtcagcctggctgccatcgcgaaccaggccgtggtcctgatgggactcgacaagggctggccgatttccaaaatggatctgggggtgccccttctggctctcggatgctactctcaggttaatcctctgacgctgaccgccgctgtgctccttctgatcacacattatgccatcattggccccgggctgcaggccaaggcgaccagagaggctcaaaagcggacagccgctggaatcatgaaaaaccctaccgtcgacggcattatgacgatcgatctcgaccccgtgatttacgatagcaagttcgagaaacagctgggccaggttatgcttctggtgctctgtgccgtccagctgctgctcatgagaacatcctgggccctttgcgaagctctgaccctggccaccgggcctatcacaaccctctgggagggatctccgggcaagttttggaatacaacgatcgcggtgagcatggccaacattttccgcgggtcctatctggctggagccggccttgcttttagcatcatgaaatctgtggggaccggaaagcggggcacaggctcccaaggggaaaccctgggagagaagtggaaaaagaaactcaatcagctgagcagaaaggagttcgacctgtacaaaaagtccggcattacagaggttgatcgcaccgaggccaaagaagggctcaagcggggagagatcacgcaccatgcggtctctagaggcagcgccaaacttcagtggtttgtggaacggaacatggtgattcccgaggggcgcgtcatcgacctgggatgtggcagaggcgggtggtcctattactgcgctggactgaaaaaggttaccgaagtgcggggctacacaaaagggggacctggccacgaggagcccgtgcctatgtctacctatgggtggaatattgtcaagctcatgagcggaaaagatgtgttctacctgcccccggaaaagtgtgacacacttctgtgcgatatcggcgagtccagcccttctcccaccgttgaagagtcccgcacaatcagagtgctcaagatggtcgagccctggctgaaaaacaatcagttctgtattaaggtgctgaacccttatatgcccaccgttatcgaacatctcgagcggcttcaacgcaaacacggcgggatgctggtgagaaatcctctgagccggaactctacgcacgaaatgtactggatttccaatggaacaggcaacatcgtcgccagcgtgaatatggtgtctcgcctcctgcttaacagatttaccatgacccatcggagaccgacaattgagaaggacgtcgatctgggggctggaacgcgccacgttaacgccgaacccgagacccctaatatggacgtgatcggcgagcggatcaaaagaattaaggaagaacacaacagcacatggcactatgacgatgaaaatccctacaagacctgggcttatcacgggtcctacgaggtgaaagccacaggatctgcgagctccatgatcaacggcgtcgtgaagctcctgaccaaaccttgggacgttgtgcccatggtcacacagatggccatgaccgatacgaccccgttcggccagcaacgcgtgtttaaggaaaaagttgacacacggacccctagaagcatgcccgggacacgccgggtgatgggaattaccgctgagtggctgtggagaacgctcggccgcaataagaagcctcggctgtgcacaagagaggagttcaccaaaaaggtccgcacaaacgccgctatgggggccgtgtttaccgaggaaaatcagtgggattccgccaaagcggctgttgaggacgaagatttctggatccttgtggaccgggagagagagctgcataagctcggaaaatgtggctcttgcgtctacaacatgatggggaagcgcgagaaaaagctgggcgagtttggaaaggccaaaggcagcagagccatttggtatatgtggcttggggctcggtacctggagttcgaggccctcggatttctgaatgaggatcactggttctcccgcgaaaactcttatagcggcgtggagggggaaggactgcataagctcggctacatcctgagagacatctccaaaattcccgggggcgctatgtatgccgatgacacggcgggatgggacacccggatcacagaggatgaccttcacaatgaagagaagattacccagcagatggatcctgagcatagacaactggccaacgctatctttaaactcacataccagaataaggtcgtgaaggttcagcggcccaccccgacaggcaccgtgatggacattatctctcgcaaagatcagagagggagcggacaagtcggcacgtatgggctgaacacattcaccaatatggaagcccagcttatccggcagatggagggagaaggcgtgctgtccaaggctgacctcgagaaccctcatctgcccgagaaaaagattacccagtggctggagacaaaaggggtggagcgcctcaagagaatggccatcagcggcgatgactgcgttgtgaagcccattgatgaccggtttgcgaacgccctgcttgctctgaatgatatgggaaaagtccgcaaggacatccctcaatggcagccgtctaaaggctggcacgattggcaacaggtgcccttctgttcccatcacttccatgaactcattatgaaggacgggagaaaactggttgtgccttgccggccccaagacgagcttatcggacgcgccagaattagccagggcgctgggtggtctctgcgggaaaccgcctgtctcggaaaggcttacgcccagatgtggtccctgatgtactttcaccgcagagatctgcggctcgcgagcaacgccatctgctctgctgtccctgtgcactgggtccccacatcccgcacgacctggagcatccatgcccaccatcaatggatgacaaccgaggacatgctgacagtgtggaatagagtttggattgaagataacccttggatggaggacaagacccccgtgacgacctgggagaatgtcccgtatcttggcaaacgggaagatcagtggtgtgggtccctgatcggcctcacaagcagagccacctgggctcagaacattcctacagccatccagcaagtgcgctctctgattggaaatgaggagttccttgactacatgcccagcatgaagcggtttagaaaagaggaggaatccgagggcgcgatctggtga

SEQ ID NO: 20726 - RNA, 9873 nt, synthetic construct
  misc_feature 1..9873: note = derived and/or modified CDS sequence (opt5) from DENV-3__FJ547074__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgctcctacaagagtcgtggccgcggagatggaggaagccctgaaaggccttcccatccgctatcagaccaccgctacaaagtctgagcataccgggcgggaaattgttgacctgatgtgccacgccacatttaccatgagactgctcagccctgtgcgcgtcccgaattacaacctgatcattatggatgaggctcatttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaatatcagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcagaaggaaaatgaccaatacattttcacaggacagccccttaacaatgatgaggaccacgctcattggaccgaagccaagatgctgctggacaacatcaatacccctgagggcattatccccgctctcttcgaacctgagcgggagaaatccgccgcgattgatggggaatatagactgaagggcgagagccgcaaaacatttgtggaacttatgcggagaggagacctgcccgtttggctcgcccacaaggtggcttctgagggcatcaaatacaccgatcgcaagtggtgcttcgacgggcagcggaacaatcagatcctggaagagaacatggatgtcgagatttggacaaaagaaggagagaagaagaaactgagaccgcgctggctcgacgcccggacgtattccgatcctcttgctctgaaggaatttaaagacttcgccgccggcagaaagagcatcgctctggatctcgtgaccgagattgggcgcgtcccctctcacctggcgcatagaacacggaatgcccttgacaacctggtgatgctccacacctccgaacatggaggcaaggcttaccgccacgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcaatggatcgcgtccgccattgtgctcgagttctttatgatggtccttctgatccctgagcccgaaaaacagagaacaccgcaggataatcaactggcttatgttgtgattggaatcctcaccctggccgctatcattgccgcgaacgagatgggccttctggaaacaaccaagcgggacctcggcatgagcaaagagcctggggtggtctctcccacgtcctacctggatgtggacctgcaccccgccagcgcttggacactctacgccgttgctaccacagtgatcacccctatgcttcgccataccattgaaaattctacagccaacgtcagcctggctgccatcgcgaaccaggccgtggtcctgatgggactcgacaagggctggccgatttccaaaatggatctgggggtgccccttctggctctcggatgctattctcaggttaatcctctgacgctgaccgccgctgtgctccttctgatcacacactacgccatcattggccccgggctgcaggccaaggcgaccagagaggctcaaaagcggacagccgctggaatcatgaaaaaccctaccgtcgacggcattatgacgatcgatctcgaccccgtgatttatgatagcaagttcgagaaacagctgggccaggttatgcttctggtgctctgtgccgtccagctgctgctcatgagaacatcctgggccctttgcgaagctctgaccctggccaccgggcctatcacaaccctctgggagggatctccgggcaagttttggaatacaacgatcgcggtgagcatggccaacattttccgcgggtcctacctggctggagccggccttgcttttagcatcatgaaatctgtggggaccggaaagcggggcacaggctcccaaggggaaaccctgggagagaagtggaaaaagaaactcaatcagctgagcagaaaggagttcgacctgtataaaaagtccggcattacagaggttgatcgcaccgaggccaaagaagggctcaagcggggagagatcacgcatcacgcggtctctagaggcagcgccaaacttcagtggtttgtggaacggaacatggtgattcccgaggggcgcgtcatcgacctgggatgtggcagaggcgggtggtcctactattgcgctggactgaaaaaggttaccgaagtgcggggctacacaaaagggggacctggccatgaggagcccgtgcctatgtctacctacgggtggaatattgtcaagctcatgagcggaaaagatgtgttctatctgcccccggaaaagtgtgacacacttctgtgcgatatcggcgagtccagcccttctcccaccgttgaagagtcccgcacaatcagagtgctcaagatggtcgagccctggctgaaaaacaatcagttctgtattaaggtgctgaacccttacatgcccaccgttatcgaacacctcgagcggcttcaacgcaaacacggcgggatgctggtgagaaatcctctgagccggaactctacgcatgaaatgtattggatttccaatggaacaggcaacatcgtcgccagcgtgaatatggtgtctcgcctcctgcttaacagatttaccatgacctaccggagaccgacaattgagaaggacgtcgttctgggggctggaacgcgccacgtgaacgccgaacccgagacccctaatatggatgtgatcggcgagcggatcaaaagaattaaggaagaacacaacagcacatggcactatgacgacgaaaatccctacaagacctgggcttatcacgggtcctacgaggtcaaagccacaggatctgcgagctccatgatcaacggcgtggttaagctcctgaccaaaccttgggatgtggtccccatggtgacacagatggccatgaccgacacgaccccgttcggccagcaacgcgtttttaaggaaaaagtggatacacggacccctagaagcatgcccgggacacgccgggtcatgggaattaccgctgagtggctgtggagaacgctcggccgcaataagaagcctcggctgtgcacaagagaggagttcaccaaaaaggtgcgcacaaacgccgctatgggggccgtttttaccgaggaaaatcagtgggactccgccaaagcggctgtggaggatgaagacttctggatccttgtcgatcgggagagagagctgcataagctcggaaaatgtggctcttgcgtgtacaacatgatggggaagcgcgagaaaaagctgggcgagtttggaaaggccaaaggcagcagagccatttggtatatgtggcttggggctcggtacctggagttcgaggccctcggatttctgaatgaggaccactggttctcccgcgaaaactcttatagcggcgtcgagggggaaggactgcataagctcggctacatcctgagagatatctccaaaattcccgggggcgctatgtatgccgacgatacggcgggatgggacacccggatcacagaggacgatcttcacaatgaagagaagattacccagcagatggaccctgagcatagacaactggccaacgctatctttaaactcacataccagaataaggtggttaaggtgcagcggcccaccccgacaggcaccgtcatggatattatctctcgcaaagaccagagagggagcggacaagtgggcacgtatgggctgaacacattcaccaatatggaagcccagcttatccggcagatggagggagaaggcgtgctgtccaaggctgatctcgagaaccctcatctgcccgagaaaaagattacccagtggctggagacaaaaggggttgagcgcctcaagagaatggccatcagcggcgacgattgcgtggtcaagcccattgacgatcggtttgcgaacgccctgcttgctctgaatgacatgggaaaagtgcgcaaggatatccctcaatggcagccgtctaaaggctggcacgactggcagcaggttcccttctgttcccatcacttccatgaactcattatgaaggatgggagaaaactggtggtcccttgccggccccaagacgagcttatcggacgcgccagaattagccagggcgctgggtggtctctgcgggaaaccgcctgtctcggaaaggcttacgcccagatgtggtccctgatgtactttcaccgcagagacctgcggctcgcgagcaacgccatctgctctgctgtgcctgtccactgggtgcccacatcccgcacgacctggagcatccatgcccaccatcaatggatgacaaccgaggatatgctgacagtttggaatagagtgtggattgaagacaacccttggatggaggataagacccccgtcacgacctgggagaatgtgccgtatcttggcaaacgggaagaccagtggtgtgggtccctgatcggcctcacaagcagagccacctgggctcagaacattcctacagccatccagcaagttcgctctctgattggaaatgaggagttccttgattacatgcccagcatgaagcggtttagaaaagaggaggaatccgagggcgcgatctggtga

SEQ ID NO: 20727 - RNA, 9873 nt, synthetic construct
  misc_feature 1..9873: note = derived and/or modified CDS sequence (opt5) from DENV-3__FJ547075__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgttatcggaatcattaccctgtatctcggcgctgtggtccaggccgacatggggtgtgtgatcaattggaaaggaaaggagctgaagtgcggcagcgggattttcgttacaaacgaggtgcatacgtggaccgaacagtacaaatttcaagctgattcccccaagcggctggccacagcgatcgccggcgcttgggagaatggagtctgtggcattagaagcaccacacgcatggaaaaccttctctggaaacagatcgccaatgagctgaactatatcctgtgggaaaataacattaagctcaccgtggttgtgggggacatcattggagtcctggagcagggcaaacggacgcttacccctcagcccatggagctgaagtactcttggaaaacatgggggaaggctaagatcgtgaccgccgaaacacaaaactccagcttcattatcgatggacctaatacccccgagtgcccgtctgcctccagagcttggaacgtgtgggaagtcgaggactatggctttggcgttttcacaaccaatatctggctcaaactgcgcgaagtgtacacgcagctgtgtgaccaccggcttatgagcgcggccgtgaaggatgagagagctgtccacgccgacatggggtactggattgagtcccagaaaaacggatcttggaagctcgaaaaagccagcctgatcgaggtgaagacatgcacctggcctaagtcccataccctgtggtctaatggcgttctcgaaagcgatatgattatccccaaatccctggctgggcctattagccagcacaactatcgccccggataccatacacaaaccgccggcccttggcaccttgggaagctggagctcgactttaattattgcgagggaacgacagtggtcatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcatatgatcgccggcgtgttctttacattcgtccttctgctcagcgggcagattacctggcgcgatatggcccacacactgatcatgattggatccaatgctagcgacagaatgggcatgggggtgacctacctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctatcagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttacgttattaccgggacatccgctgatctgaccgtggaaaaggccgccgacgtcacatgggaggaagaggctgaacagacgggagtgagccataacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcacacctggcagaaacagacacaacgcagcggggtcctgtgggatgtgccctctcctcccgaaacccagaaggctgagctcgaagagggagtttatagaattaaacagcagggcatcttcgggaagacacaagtgggagtcggcgtgcagaaggagggggtgtttcataccatgtggcacgttacacggggagccgtcctgacgtacaacggcaaacgcctcgaaccgaattgggcctccgtgaagaaagacctgattagctatggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtacggaaatggcgtcgtgaccaagaacgggggatatgtttccggcatcgcccaaacaaatgccgagagcgacgggcctaccccggaactcgaggaagagatgttcaaaaagcgcaacctgacaattatggatcttcaccccggctctggaaaaaccagaaagtacctgcctgctatcgtgcgggaagccattaagcgcagactccggacgctgatcctcgctcccacaagagtcgtggccgcggagatggaggaagccctgaaaggccttcctatccgctatcagaccaccgctacaaagagcgagcataccgggcgggaaattgttgacctgatgtgccacgccacatttaccatgagactgctctcccccgtgcgcgtccctaattacaacctgatcattatggatgaggctcatttcacggacccggcctctatcgccgctcggggatacattagcacaagagtgggcatgggggaagcggccgctatctttatgaccgccacaccccctggaaccgccgatgctttcccccagtccaatgcccctatccaggacgaggagcgcgacattcccgaacggtcttggaacagcggcaatgagtggatcacggattttgcggggaaaaccgtgtggttcgtcccgtccattaaggctggcaacgacatcgccaactgtcttcgcaaaaatggaaagaaggttattcaactgtctagaaaaacatttgataccgaatatcagaagacaaaactcaacgactgggatttcgtggtgaccacagacatcagcgagatgggcgccaattttaaggctgatcgggtcattgaccctagacggtgcctgaaacccgtgatcctgaccgatgggcccgagcgcgttatcctcgccggacctatgcccgtgacggcggcctccgctgcccagagacggggccgcgtcgggagaaaccctcagaaggaaaatgaccaatacattttcacaggacagccgcttaacaatgatgaggaccacgctcattggaccgaagccaagatgctgctggacaacatcaatacccccgagggcattatccctgctctcttcgaacccgagcgggagaaaagcgccgcgattgatggggaatatagactgaagggcgagtctcgcaaaacatttgtggaacttatgcggagaggagacctgcctgtttggctcgcccacaaggtggcttccgagggcatcaaatacaccgatcgcaagtggtgcttcgacgggcagcggaacaatcagatcctggaagagaacatggatgtcgagatttggacaaaagaaggagagaagaagaaactgagaccccgctggctcgacgcccggacgtatagcgatccgcttgctctgaaggaatttaaagacttcgccgccggcagaaagtctatcgctctggatctcgtgaccgagattgggcgcgtcccttcccacctggcgcatagaacacggaatgcccttgacaacctggtgatgctccacaccagcgaacatggaggcaaggcttaccgccacgccgttgaggagctgcccgaaacaatggagaccctgctccttctgggcctgatgatcctcctgacagggggagccatgctttttctgatttccggcaaggggatcggaaagacctctatcggcctcatttgtgtgatcgctagctccgggatgctgtggatggccgaaattcctctgcaatggatcgcgagcgccattgtgctcgagttctttatgatggtccttctgatccccgagcctgaaaaacagagaacaccccaggataatcaactggcttatgttgtgattggaatcctcaccctggccgctatcattgccgcgaacgagatgggccttctggaaacaaccaagcgggacctcggcatgtctaaagagccgggggtggtctcccctacgagctacctggatgtggacctgcaccccgcctctgcttggacactctacgccgttgctaccacagtgatcacccccatgcttcgccataccattgaaaatagcacagccaacgtctccctggctgccatcgcgaaccaggccgtggtcctgatgggactcgacaagggctggcctatttctaaaatggatctgggggtgccgcttctggctctcggatgctatagccaggttaatcccctgacgctgaccgccgctgtgctccttctgatcacacactacgccatcattggccctgggctgcaggccaaggcgaccagagaggctcaaaagcggacagccgctggaatcatgaaaaaccccaccgtcgacggcattatgacgatcgatctcgaccctgtgatttatgattccaagttcgagaaacagctgggccaggttatgcttctggtgctctgtgccgtccagctgctgctcatgagaacatcttgggccctttgcgaagctctgaccctggccaccgggcccatcacaaccctctgggagggaagccctggcaagttttggaatacaacgatcgcggtgtccatggccaacattttccgcgggagctacctggctggagccggccttgctttttctatcatgaaatccgtggggaccggaaagcggggcacaggcagccaaggggaaaccctgggagagaagtggaaaaagaaactcaatcagctgtccagaaaggagttcgacctgtataaaaagtctggcattacagaggttgatcgcaccgaggccaaagaagggctcaagcggggagagatcacgcatcacgcggtcagcagaggctccgccaaacttcagtggtttgtggaacggaacatggtgattccggaggggcgcgtcatcgacctgggatgtggcagaggcgggtggtcttactattgcgctggactgaaaaaggttaccgaagtgcggggctacacaaaagggggacccggccatgaggagcctgtgcccatgagcacctacgggtggaatattgtcaagctcatgtccggaaaagatgtgttctatctgcctcccgaaaagtgtgacacacttctgtgcgatatcggcgagagctctccgtcccctaccgttgaagagagccgcacaatcagagtgctcaagatggtcgagccctggctgaaaaacaatcagttctgtattaaggtgctgaacccctacatgcctaccgttatcgaacacctcgagcggcttcaacgcaaacacggcgggatgctggtgagaaatcccctgtctcggaactccacgcatgaaatgtattggattagcaatggaacaggcaacatcgtcgcctctgtgaatatggtgagccgcctcctgcttaacagatttaccatgacccaccggagacctacaattgagaaggacgtcgatctgggggctggaacgcgccatgttaacgccgaaccggagacccccaatatggacgtgatcggcgagcggatcaaaagaattaaggaagaacacaactccacatggcactacgacgatgaaaatccttataagacctgggcttaccatgggtcttatgaggtgaaagccacaggaagcgcgtccagcatgatcaacggcgtcgtgaagctcctgaccaaaccctgggacgttgtgcctatggtcacacagatggccatgaccgatacgacccccttcggccagcaacgcgtgtttaaggaaaaagttgacacacggaccccgagatccatgcctgggacacgccgggtgatgggaattaccgctgagtggctgtggagaacgctcggccgcaataagaagccccggctgtgcacaagagaggagttcaccaaaaaggtccgcacaaacgccgctatgggggccgtgtttaccgaggaaaatcagtgggattctgccaaagcggctgttgaggacgaagatttctggatccttgtggaccgggagagagagctgcacaagctcggaaaatgtggcagctgcgtctacaacatgatggggaagcgcgagaaaaagctgggcgagtttggaaaggccaaaggctccagagccatttggtacatgtggcttggggctcggtatctggagttcgaggccctcggatttctgaatgaggatcattggttctctcgcgaaaacagctactccggcgtggagggggaaggactgcacaagctcggctatatcctgagagacatctctaaaattcctgggggcgctatgtacgccgatgacacggcgggatgggacacccggatcacagaggatgaccttcataatgaagagaagattacccagcagatggatcccgagcacagacaactggccaacgctatctttaaactcacatatcagaataaggtcgtgaaggttcagcggcctacccccacaggcaccgtgatggacattatcagccgcaaagatcagagagggtccggacaagtcggcacgtacgggctgaacacattcaccaatatggaagcccagcttatccggcagatggagggagaaggcgtgctgagcaaggctgacctcgagaacccgcatctgcctgagaaaaagattacccagtggctggagacaaaaggggtggagcgcctcaagagaatggccatctctggcgatgactgcgttgtgaagcccattgatgaccggtttgcgaacgccctgcttgctctgaatgatatgggaaaagtccgcaaggacatcccccaatggcagccttccaaaggctggcatgattggcaacaggtgccgttctgtagccaccatttccacgaactcattatgaaggacgggagaaaactggttgtgccctgccggcctcaagacgagcttatcggacgcgccagaatttctcagggcgctgggtggtccctgcgggaaaccgcctgtctcggaaaggcttatgcccagatgtggagcctgatgtactttcaccgcagagatctgcggctcgcgtctaacgccatctgctccgctgtccccgtgcattgggtccctacaagccgcacgacctggtccatccacgcccatcaccaatggatgacaaccgaggacatgctgacagtgtggaatagagtttggattgaagataacccctggatggaggacaagacccctgtgacgacctgggagaatgtcccctaccttggcaaacgggaagatcagtggtgtgggagcctgatcggcctcacatctagagccacctgggctcagaacattccgacagccatccagcaagtgcgcagcctgattggaaatgaggagttccttgactatatgccttccatgaagcggtttagaaaagaggaggaatctgagggcgcgatctggtga

SEQ ID NO: 20728 - RNA, 9873 nt, synthetic construct
  misc_feature 1..9873: note = derived and/or modified CDS sequence (opt5) from DENV-3__FJ547076__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccgtgtctgaaaaggaggagaatatggttaaatccctggtgagcgctggatctggcaaggtcgacaacttcaccatgggggtgctgtgcctcgccatcctgtttgaagaggttatgcggggaaagttcggcaaaaagcatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaaaatccagcccttcctggccctcggatttttcctgcggaagctcacatctagagaaaacctgcttctgggcgtggggctcgccatggctaccacactgcaactgcctgaggatatcgaacagatggccaatggaattgctcttggcctgatggccctcaaactgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaagacggactggctgcccatgacagtggctgccatgggggtccctcccctccctctgtttatcttctctctcaaggataccctgaaaagacgcagctggccccttaatgagggagtgatggccgttggcctggtgtccatcctggcttctagcctcctgagaaacgacgtccctatggcggggccccttgtggccggaggcctgctcattgcttgttacgttatcaccgggacatccgccgatctgaccgtggaaaaggccgctgacgtcacatgggaggaagaggccgaacagacgggagtgagccataacctcatgattaccgtcgacgatgacggcacaatgcggatcaaagatgacgagaccgagaatattctgacagtgcttctgaagaccgcgctgctcatcgtttctggcatctttccgtactccattcctgctacgctgcttgtgtggcacacctggcagaaacagacacaacgcagcggggtcctgtgggatgtgccctctcctcccgaaacccagaaggccgagctcgaagagggagtttatagaatcaaacagcagggcattttcgggaagacacaagtgggagtcggcgtgcagaaggagggggtgtttcataccatgtggcacgttacacggggagccgtcctgacgtacaacggcaaacgcctcgaaccgaattgggcttccgtgaagaaagacctgatcagctatggcgggggatggagactttctgcccagtggcaaaagggcgaggaagtgcaggtcattgcggtggagcctgggaaaaaccccaagaatttccagaccatgcctggaacattccagaccaccacaggcgaaatcggggctattgccctggattttaagcccggaacgtccggcagccccatcatcaaccgggagggcaaagttgtggggctgtacggaaatggcgtcgtgaccaagaacgggggatatgtttccggcattgcccaaacaaatgctgagcctgacgggccgacccccgaactcgaggaagagatgttcaaaaagcgcaacctgacaatcatggatcttcaccctggcagcggaaaaaccagaaagtacctgcccgccattgtgcgggaagctatcaagcgcagactccggacgctgattctcgcccctacaagagtcgtggcggccgagatggaggaagctctgaaaggccttcccatccgctatcagaccaccgccacaaagtctgagcataccgggcgggaaatcgttgacctgatgtgccacgctacatttaccatgagactgctcagccctgtgcgcgtcccgaattacaacctgattatcatggatgaggcccatttcacggaccccgcctccattgctgcgcggggatacatctctacaagagtgggcatgggggaagccgctgccatttttatgaccgccacacctcccggaaccgctgatgccttccctcagagcaatgcgcccatccaggacgaggagcgcgacatcccggaacggtcctggaactctggcaatgagtggattacggattttgctgggaaaaccgtgtggttcgtccctagcatcaaggccggcaacgacattgccaactgtcttcgcaaaaatggaaagaaggttatccaactgtccagaaaaacatttgataccgaatatcagaagacaaaactcaacgactgggatttcgtggtgaccacagacatttctgagatgggcgctaattttaaggccgatcgggtcatcgaccccagacggtgcctgaaacccgtgattctgaccgatgggcctgagcgcgttatcctcgcgggacccatgcctgtgacggccgctagcgccgctcagagacggggccgcgtcgggagaaacccgcagaaggaaaatgaccaatacatcttcacaggacagccccttaacaatgatgaggaccacgcccattggaccgaagctaagatgctgctggacaacattaatacccctgagggcatcattcccgccctcttcgaacctgagcgggagaaatccgcggccatcgatggggaatatagactgaagggcgagagccgcaaaacatttgtggaacttatgcggagaggagacctgcccgtttggctcgctcacaaggtggcctctgagggcattaaatacaccgatcgcaagtggtgcttcgacgggcagcggaacaatcagatcctggaagagaacatggatgtcgagatctggacaaaagaaggagagaagaagaaactgagaccgcgctggctcgacgctcggacgtattccgatcctcttgccctgaaggaatttaaagacttcgccgctggcagaaagagcattgcgctggatctcgtgaccgagatcgggcgcgtcccctctcacctggcccatagaacacggaatgctcttgacaacctggtgatgctccacacctccgaacatggaggcaaagcctaccgccacgccgttgaggagctgcctgaaacaatggagaccctgctccttctgggcctgatgattctcctgacagggggagctatgctttttctgatcagcggcaaggggattggaaagacctccatcggcctcatctgtgtgattgcctctagcgggatgctgtggatggcggaaatccccctgcaatggattgcctccgctatcgtgctcgagttctttatgatggtccttctgattcctgagcccgaaaaacagagaacaccgcaggataatcaactggcctatgttgtgatcggcattctcaccctggctgccatcatcgcggccaacgagatgggccttctggaaacaaccaagcgggacctcggcatgagcaaagagcctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaagggctggccgatctccaaaatggatctgggggtgccccttctggccctcggatgctattctcaggttaatcctctgacgctgaccgctgccgtgctccttctgattacacactacgccatcatcggccccgggctgcaggcgaaggctaccagagaggcccaaaagcggacagctgccggaattatgaaaaaccctaccgtcgacggcatcatgacgattgatctcgaccccgtgatctatgatagcaagttcgagaaacagctgggccaggttatgcttctggtgctctgtgccgtccagctgctgctcatgagaacatcctgggctctttgcgaagccctgaccctggcgaccgggcctattacaaccctctgggagggatctccgggcaagttttggaatacaacgatcgccgtgagcatggctaacatcttccgcgggtcctacctggccggagctggccttgcctttagcattatgaaatctgtggggaccggaaagcggggcacaggctcccaaggggaaaccctgggagagaagtggaaaaagaaactcaatcagctgagcagaaaggagttcgacctgtataaaaagtccggcatcacagaggttgatcgcaccgaggcgaaagaagggctcaagcggggagagattacgcatcacgccgtctctagaggcagcgctaaacttcagtggtttgtggaacggaacatggtgatccccgaggggcgcgtcattgacctgggatgtggcagaggcgggtggtcctactattgcgccggactgaaaaaggttaccgaagtgcggggctacacaaaagggggacctggccatgaggagcccgtgcctatgtctacctacgggtggaatatcgtcaagctcatgagcggaaaagatgtgttctatctgcccccggaaaagtgtgacacacttctgtgcgatattggcgagtccagcccttctcccaccgttgaagagtcccgcacaatcagagtgctcaagatggtcgagccctggctgaaaaacaatcagttctgtatcaaggtgctgaacccttacatgcccaccgttattgaacacctcgagcggcttcaacgcaaacacggcgggatgctggtgagaaatcctctgagccggaactctacgcatgaaatgtattggatctccaatggaacaggcaacattgtcgctagcgtgaatatggtgtctcgcctcctgcttaacagatttaccatgacccaccggagaccgacaatcgagaaggacgtcgatctgggggccggaacgcgccatgttaacgctgaacccgagacccctaatatggacgtgattggcgagcggatcaaaagaatcaaggaagaacacaacagcacatggcactacgacgatgaaaatccctataagacctgggcctaccatgggtcctatgaggtgaaagcgacaggatctgccagctccatgattaacggcgtcgtgaagctcctgaccaaaccttgggacgttgtgcccatggtcacacagatggctatgaccgatacgaccccgttcggccagcaacgcgtgtttaaggaaaaagttgacacacggacccctagaagcatgcccgggacacgccgggtgatgggaatcaccgccgagtggctgtggagaacgctcggccgcaataagaagcctcggctgtgcacaagagaggagttcaccaaaaaggtccgcacaaacgctgccatgggggccgtgtttaccgaggaaaatcagtgggattccgcgaaagctgccgttgaggacgaagatttctggaaacttgtggaccgggagagagagctgcacaaactcggaaagtgtggctcttgcgtctacaacatgatggggaaacgcgaaaagaagctgggcgagtttggaaaagccaagggcagcagagctatttggtacatgtggcttggggcccggtatctggagttcgaggctctcggatttctgaatgaggatcattggttctcccgcgaaaactcttacagcggcgtggagggggaaggactgcacaaactcggctatatcctgagagacatttccaagatccccgggggcgccatgtacgcggatgacacggccggatgggacacccggatcacagaggatgaccttcataatgaagagaaaattacccagcagatggatcctgagcacagacaactggctaacgccatctttaagctcacatatcagaataaggtcgtgaaagttcagcggcccaccccgacaggcaccgtgatggacattatctctcgcaaggatcagagagggagcggacaagtcggcacgtacgggctgaacacattcaccaatatggaagctcagcttattcggcagatggagggagaaggcgtgctgtccaaagccgacctcgagaaccctcatctgcccgaaaagaaaatcacccagtggctggagacaaagggggtggagcgcctcaagagaatggcgatcagcggcgatgactgcgttgtgaaacccattgatgaccggtttgccaacgctctgcttgccctgaatgatatgggaaaggtccgcaaagacatccctcaatggcagccgtctaagggctggcatgattggcaacaggtgcccttctgttcccaccatttccacgaactcattatgaaagacgggagaaagctggttgtgccttgccggccccaagacgagcttatcggacgcgctagaattagccagggcgccgggtggtctctgcgggaaaccgcttgtctcggaaaggcctatgcgcagatgtggtccctgatgtactttcaccgcagagatctgcggctcgccagcaacgctatctgctctgccgtccctgtgcattgggtccccacatcccgcacgacctggagcattcacgcccatcaccaatggatgacaaccgaggacatgctgacagtgtggaatagagtttggatcgaagataacccttggatggaggacaaaacccccgtgacgacctgggagaatgtcccgtaccttggcaagcgggaagatcagtggtgtgggtccctgatcggcctcacaagcagagctacctgggcccagaacattcctacagcgatccagcaagtgcgctctctgattggaaatgaggagttccttgactatatgcccagcatgaaacggtttagaaaggaggaggaatccgagggcgctatctggtga

SEQ ID NO: 20729 - RNA, 9873 nt, synthetic construct
  misc_feature 1..9873: note = derived and/or modified CDS sequence (opt5) from DENV-3__FJ547077__SS-prME
  source 1..9873: mol_type = other RNA
acaagcctgtgcctcatgatgatcctgcccgcggctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcaaggttgacaacttcaccatgggggtgctgtgcctcgccattctgtttgaagaggtcatgcggggaaagttcggcaaaaagcatatgatcgctggcgtgttctttacattcgttcttctgctcagcgggcagattacctggcgcgatatggcccacacactgatcatgattggatccaatgcgagcgacagaatgggcatgggggtgacctacctggctcttatcgccacgtttaaaatccagcccttcctggccctcggatttttcctgcggaagctcacatctagagaaaacctgcttctgggcgtcgggctcgctatggccaccacactgcaactgcctgaggatattgaacagatggctaatggaatcgcccttggcctgatggcgctcaaactgattacccagtttgagacctatcagctctggacagccctgatctcccttacgtgtagcaacaccattttcacactgaccgtggcttggcgcacagccaccctcatcctggctggcgtgtccctgcttccggtctgccaatctagctccatgcggaagacggactggctgcccatgacagttgccgccatgggggtgcctcccctccctctgtttatcttctctctcaaggataccctgaaaagacgcagctggccccttaatgagggagtgatggctgtcggcctggtgtccattctggcgtctagcctcctgagaaacgacgttcctatggccgggccccttgtggctggaggcctgctcatcgcctgttacgtcattaccgggacatccgccgatctgaccgtggaaaaggctgccgacgttacatgggaggaagaggcggaacagacgggagtgagccataacctcatgatcaccgtcgacgatgacggcacaatgcggattaaagatgacgagaccgagaatatcctgacagtgcttctgaagaccgctctgctcatcgtctctggcatttttccgtactccatccctgccacgctgcttgtgtggcacacctggcagaaacagacacaacgcagcggggttctgtgggatgtgccctctcctcccgaaacccagaaggccgagctcgaagagggagtctatagaattaaacagcagggcatcttcgggaagacacaagtgggagttggcgtgcagaaggagggggtctttcataccatgtggcacgtgacacggggagctgtgctgacgtacaacggcaaacgcctcgaaccgaattgggcctccgttaagaaagacctgattagctatggcgggggatggagactttctgcgcagtggcaaaagggcgaggaagtccaggtgatcgctgtggagcctgggaaaaaccccaagaatttccagaccatgcctggaacattccagaccaccacaggcgaaattggggccatcgccctggattttaagcccggaacgtccggcagccccatcattaaccgggagggcaaagtcgtggggctgtacggaaatggcgttgtgaccaagaacgggggatatgtctccggcatcgctcaaacaaatgccgagcctgacgggccgacccccgaactcgaggaagagatgttcaaaaagcgcaacctgacaattatggatcttcaccctggcagcggaaaaaccagaaagtacctgcccgctatcgtgcgggaagccattaagcgcagactccggacgctgatcctcgcgcctacaagagttgtggccgctgagatggaggaagccctgaaaggccttcccatccgctatcagaccaccgctacaaagtctgagcataccgggcgggaaattgtcgacctgatgtgccacgccacatttaccatgagactgctcagccctgtgcgcgttccgaattacaacctgatcattatggatgaggcccatttcacggaccccgcttccatcgcggcccggggatacatttctacaagagtgggcatgggggaagctgccgccatctttatgaccgctacacctcccggaaccgccgatgcgttccctcagagcaatgctcccatccaggacgaggagcgcgacattccggaacggtcctggaactctggcaatgagtggatcacggattttgccgggaaaaccgtctggttcgtgcctagcattaaggccggcaacgacatcgctaactgtcttcgcaaaaatggaaagaaggtgattcaactgtccagaaaaacatttgataccgaatatcagaagacaaaactcaacgactgggatttcgtcgttaccacagacatctctgagatgggcgccaattttaaggcggatcgggtgattgaccccagacggtgcctgaaacccgtgatcctgaccgatgggcctgagcgcgtcatcctcgccggacccatgcctgtgacggctgccagcgctgcccagagacggggccgcgttgggagaaacccgcagaaggaaaatgaccaatacattttcacaggacagccccttaacaatgatgaggaccacgctcattggaccgaagccaagatgctgctggacaacatcaatacccctgagggcattatccccgccctcttcgaacctgagcgggagaaatccgccgctattgatggggaatatagactgaagggcgagagccgcaaaacatttgtggaacttatgcggagaggagacctgcccgtctggctcgcccacaaggtggcttctgagggcatcaaatacaccgatcgcaagtggtgcttcgacgggcagcggaacaatcagatcctggaagagaacatggatgttgagatttggacaaaagaaggagagaagaagaaactgagaccgcgctggctcgacgcccggacgtattccgatcctcttgccctgaaggaatttaaagacttcgctgcgggcagaaagagcatcgccctggatctcgtgaccgagattgggcgcgtcccctctcacctggctcatagaacacggaatgcccttgacaacctggtgatgctccacacctccgaacatggaggcaaagcctaccgccacgctgtcgaggagctgcctgaaacaatggagaccctgctccttctgggcctgatgatcctcctgacagggggagccatgctttttctgattagcggcaaggggatcggaaagacctccatcggcctcatttgtgtgatcgcgtctagcgggatgctgtggatggccgaaattcccctgcaatggatcgcttccgccattgttctcgagttctttatgatggtgcttctgatccctgagcccgaaaaacagagaacaccgcaggataatcaactggcttatgtggtcattggaatcctcaccctggccgcgacaatcgccgctaacgagatgggccttctggaaaccacgaagcgggacctcggcatgagcaaagagcctggggttgtgtctcccacatcctacctggatgtggacctgcaccccgccagcgcttggaccctctacgccgtcgctacaaccgtgattacccctatgcttcgccatacaatcgaaaattctacggccaacgttagcctggcggccattgctaaccaggccgtggtcctgatgggactcgacaagggctggccgatctccaaaatggatctgggggtgccccttctggctctcggatgctattctcaggtcaatcctctgaccctgacagccgccgtgctccttctgattacccactacgcgatcatcggccccgggctgcaggctaaggccacaagagaggctcaaaagcggaccgccgccggaattatgaaaaaccctacggttgacggcatcatgacaattgatctcgaccccgtgatctatgatagcaagttcgagaaacagctgggccaggtcatgcttctggtgctctgtgctgttcagctgctgctcatgagaacctcctgggccctttgcgaagcgctgaccctggccacagggcctattaccacactctgggagggatctccgggcaagttttggaatacgaccatcgctgtgagcatggccaacatcttccgcgggtcctacctggctggagccggccttgcgtttagcattatgaaatctgtcgggacaggaaagcggggcaccggctcccaaggggaaacactgggagagaagtggaaaaagaaactcaatcagctgagcagaaaggagttcgacctgtataaaaagtccggcatcaccgaggtggatcgcacggaggccaaagaagggctcaagcggggagagattacccatcacgctgtgtctagaggcagcgccaaacttcagtggtttgttgaacggaacatggtcatccccgaggggcgcgtgattgacctgggatgtggcagaggcgggtggtcctactattgcgctggactgaaaaaggtgacagaagtccggggctacaccaaagggggacctggccatgaggagcccgttcctatgtctacatacgggtggaatatcgtgaagctcatgagcggaaaagatgtgttctatctgcccccggaaaagtgtgacacccttctgtgcgatattggcgagtccagcccttctcccacagtcgaagagtcccgcaccatcagagtgctcaagatggttgagccctggctgaaaaacaatcagttctgtatcaaggtgctgaacccttacatgcccacggtcattgaacacctcgagcggcttcaacgcaaacacggcgggatgctggtgagaaatcctctgagccggaactctacacatgaaatgtattggatctccaatggaaccggcaacattgttgccagcgtgaatatggtctctcgcctcctgcttaacagatttaccatgacacaccggagaccgacgatcgagaaggacgtggatctgggggctggaacccgccatgtgaacgccgaacccgagacacctaatatggacgtcattggcgagcggatcaaaagaatcaaggaagaacacaacagcacctggcactacgacgatgaaaatccctataagacatgggcgtaccatgggtcctatgaggttaaagccaccggatctgctagctccatgattaacggcgtggtgaagctcctgacaaaaccttgggacgtcgtgcccatggttacccagatggccatgacggataccacaccgttcggccagcaacgcgtgtttaaggaaaaagtcgacacccggacacctagaagcatgcccgggacccgccgggtgatgggaatcacggctgagtggctgtggagaacactcggccgcaataagaagcctcggctgtgcaccagagaggagttcaccaagaaggttcgcaccaacgccgccatgggggcggtgtttacggaggaaaatcagtgggattccgctaaagccgccgtcgaggacgaagatttctggaaacttgtggaccgggagagagagctgcacaaactcggaaagtgtggctcttgcgtttacaacatgatggggaaacgcgaaaagaagctgggcgagtttggaaaagctaagggcagcagagccatttggtacatgtggcttggggctcggtatctggagttcgaggccctcggatttctgaatgaggatcattggttctcccgcgaaaactcttacagcggcgtggagggggaaggactgcacaaactcggctatatcctgagagacatttccaagatccccgggggcgcgatgtacgccgatgacaccgctggatgggacacacggatcaccgaggatgaccttcataatgaagagaaaattacacagcagatggatcctgagcacagacaactggccaacgctatctttaagctcacctatcagaataaggtcgtgaaagtccagcggcccacaccgaccggcacggtgatggacattatctctcgcaaggatcagagagggagcggacaagttggcacatacgggctgaacaccttcaccaatatggaagcccagcttattcggcagatggagggagaaggcgtgctgtccaaagcggacctcgagaaccctcatctgcccgaaaagaaaatcacacagtggctggagaccaagggggtcgagcgcctcaagagaatggccatcagcggcgatgactgcgtggtgaaacccattgatgaccggtttgctaacgccctgcttgctctgaatgatatgggaaaggttcgcaaagacatccctcaatggcagccgtctaagggctggcatgattggcaacaggtgcccttctgttcccaccatttccacgaactcattatgaaagacgggagaaagctggtcgtgccttgccggccccaagacgagcttatcggacgcgccagaattagccagggcgctgggtggtctctgcgggaaacagcctgtctcggaaaggcgtatgcccagatgtggaacctgatgtactttcaccgcagagatctgcggctcgcttccaatgccatctgcagcgccgttcctgtgcattgggtccccacgtctcgcaccacatggtccattcacgctcatcaccaatggatgaccacagaggacatgctgaccgtgtggaacagagtctggatcgaagataatccttggatggaggacaaaacgcccgtgaccacatgggagaacgttccgtaccttggcaagcgggaagatcagtggtgtgggagcctgatcggcctcacctccagagccacatgggcgcagaatattcctaccgctatccagcaagtgcgcagcctgattggaaacgaggagttccttgactatatgccctctatgaaacggtttagaaaggaggaggaaagcgagggcgccatctggtga

SEQ ID NO: 20730 - RNA, 9873 nt, synthetic construct
  misc_feature 1..9873: note = derived and/or modified CDS sequence (opt5) from DENV-3__FJ547078__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctggattgatgtggtgctggagcacggcgggtgcgtcaccacaatggccaagaataaacccacgctggacatcgagctccagaagaccgaagctacacagctggccacccttcgcaaactgtgtattgagggaaagatcacaaacattaccacggattccagatgccctacacagggcgaagcggttctcccggaggaacaggaccagaattatgtgtgtaaacacacctacgtggatcggggctgggggaacggatgcggcctgttcgggaagggaagccttgtgacctgcgccaagtttcaatgtctggagcccatcgagggcaaagtggttcagtatgaaaatctcaagtacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgtgccctgtaaaatccctttcagcaccgaggacggccaagggaaggcccataacggaagactgattacagcgaatcccgttgtgaccaaaaaggaggaacccgtcaacatcgaggctgaacctccgttcggcgagtccaatattgtgatcgggatcggcgataacgccctgaaaattaattggtataagaagggatctagcatcggcaaaatgtttgaagccacggctagaggggccagacgcatggctattcttggagacacagcctgggatttcggctccgtcgggggagttctcaacagcctgggcaagatggtccaccagatctttgggtctgcgtacaccgccctgttctccggcgtgagctgggtgatgaaaattggaatcggcgtcctcctgacctggattgggcttaattctaagaacacaagcatgtccttttcttgcatcgctatcggaattatcaccctgtatctcggcgccgtggttcaggctgacatggggtgtgtgattaattggaaaggaaaggagctgaagtgcggcagcgggatcttcgtcacaaacgaggtgcatacgtggaccgaacagtacaaatttcaagccgattcccccaagcggctggcgacagccattgctggcgcctgggagaatggagtttgtggcatcagaagcaccacacgcatggaaaaccttctctggaaacagatcgctaatgagctgaactatattctgtgggaaaataacatcaagctcaccgtggtcgtgggggacattatcggagttctggagcagggcaaacggacgcttacccctcagcccatggagctgaagtactcttggaaaacatgggggaaggccaagattgtgaccgccgaaacacaaaactccagcttcatcatcgatggacctaatacccccgagtgcccgtctgcttccagagcgtggaacgtctgggaagtggaggactatggctttggcgtgttcacaaccaatatttggctcaaactgcgcgaagtctacacgcagctgtgtgaccaccggcttatgagcgccgctgttaaggatgagagagccgtgcacgccgacatggggtactggatcgagtcccagaaaaacggatcttggaagctcgaaaaagctagcctgattgaggtgaagacatgcacctggcctaagtcccataccctgtggtctaatggcgtcctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggttatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatttctgaaaaggaggagaatatggtcaaatccctggtgagcgctggatctggcaaggttgacaacttcaccatgggggtgctgtgcctcgccatcctgtttgaagaggtcatgcggggaaagttcggcaaaaagcatatgattgccggcgtgttctttacattcgttcttctgctcagcgggcagatcacctggcgcgatatggctcacacactgattatgatcggatccaatgccagcgacagaatgggcatgggggtgacctacctggcgcttatcgctacgtttaaaattcagcccttcctggccctcggatttttcctgcggaagctcacatctagagaaaacctgcttctgggcgtcgggctcgccatggctaccacactgcaactgcctgaggatatcgaacagatggccaatggaattgctcttggcctgatggccctcaaactgatcacccagtttgagatttatcagctctggaccgcgctgatctcccttacatgtagcaacacgatcttcaccctgacagtggcctggcgcaccgctacactcattctggccggcgtgtccctgcttccggtctgccaatctagctccatgcggaagaccgactggctgcccatgacggttgctgccatgggggtgcctcccctccctctgtttatcttctctctcaaggatacactgaaaagacgcagctggccccttaatgagggagtgatggccgtcggcctggtgtccattctggcttctagcctcctgagaaacgacgttcctatggcggggccccttgtggccggaggcctgctcatcgcttgttacgtcattaccgggacctccgccgatctgacagtggaaaaggccgctgacgttacctgggaggaagaggccgaacagacaggagtgagccataacctcatgatcacggtcgacgatgacggcaccatgcggatcaaagatgacgagacagagaatattctgaccgtgcttctgaagacagcgctgctcatcgtctctggcatttttccgtactccatccctgctaccctgcttgtgtggcacacgtggcagaaacagacccaacgcagcggggttctgtgggatgtgccctctcctcccgaaacacagaaggccgagctcgaagagggagtctatagaattaaacagcagggcatcttcgggaagacccaagtgggagttggcgtgcagaaggagggggtctttcatacaatgtggcacgtgacccggggagccgtgctgacatacaacggcaaacgcctcgaaccgaattgggcttccgttaagaaagacctgattagctatggcgggggatggagactttctgcccagtggcaaaagggcgaggaagtccaggtgatcgcggtggagcctgggaaaaaccccaagaatttccagacgatgcctggaaccttccagacaaccaccggcgaaatcggggctattgccctggattttaagcccggaacatccggcagccccatcattaaccgggagggcaaagtcgtggggctgtacggaaatggcgttgtgacgaagaacgggggatatgtctccggcatcgcccaaaccaatgctgagcctgacgggccgacacccgaactcgaggaagagatgttcaaaaagcgcaacctgaccattatggatcttcaccctggcagcggaaaaacaagaaagtacctgcccgccatcgtgcgggaagctatcaagcgcagactccggaccctgattctcgcccctacgagagttgtggcggccgagatggaggaagctctgaaaggccttcccatccgctatcagacaaccgccaccaagtctgagcatacagggcgggaaattgtcgacctgatgtgccacgctacctttacaatgagactgctcagccctgtgcgcgttccgaattacaacctgatcattatggatgaggcccatttcaccgaccccgcctccatcgctgcgcggggatacatctctacgagagtgggcatgggggaagccgctgccatttttatgacagccacccctcccggaacagctgatgccttccctcagagcaatgcgcccatccaggacgaggagcgcgacattccggaacggtcctggaactctggcaatgagtggatcaccgattttgctgggaaaacggtctggttcgtgcctagcattaaggccggcaacgacatcgccaactgtcttcgcaaaaatggaaagaaggtgattcaactgtccagaaaaacctttgatacagaatatcagaagaccaaactcaacgactgggatttcgtcgttacaaccgacatctctgagatgggcgctaattttaaggccgatcgggtgatcgaccccagacggtgcctgaaacccgtgattctgacagatgggcctgagcgcgtcatcctcgcgggacccatgcctgtgaccgccgctagcgccgctcagagacggggccgcgttgggagaaacccgcagaaggaaaatgaccaatacattttcacgggacagccccttaacaatgatgaggaccacgcccattggacagaagctaagatgctgctggacaacatcaatacccctgagggcattatccccgccctcttcgaacctgagcgggagaaatccgcggccatcgatggggaatatagactgaagggcgagagccgcaaaacctttgtggaacttatgcggagaggagacctgcccgtctggctcgctcacaaggtggcctctgagggcattaaatacacagatcgcaagtggtgcttcgacgggcagcggaacaatcagatcctggaagagaacatggatgttgagatttggaccaaagaaggagagaagaagaaactgagaccgcgctggctcgacgctcggacatattccgatcctcttgccctgaaggaatttaaagacttcgccgctggcagaaagagcatcgcgctggatctcgtgacggagattgggcgcgtcccctctcacctggcccatagaacccggaatgctcttgacaacctggtgatgctccacacatccgaacatggaggcaaagcctaccgccacgccgtcgaggagctgcctgaaaccatggagacactgctccttctgggcctgatgatcctcctgaccgggggagctatgctttttctgatcagcggcaaggggattggaaagacgtccatcggcctcatttgtgtgatcgcctctagcgggatgctgtggatggcggaaattcccctgcaatggatcgcctccgctattgttctcgagttctttatgatggtgcttctgatccctgagcccgaaaaacagagaaccccgcaggataatcaactggcctatgtggtcatcggcattctcacactggctgccatcattgcggccaacgagatgggccttctggaaaccacaaagcgggacctcggcatgagcaaagagcctggggttgtgtctcccacctcctacctggatgtggacctgcaccccgctagcgcctggacgctctacgctgtcgccacaaccgtgatcacacctatgcttcgccataccattgaaaattctaccgctaacgttagcctggccgcgatcgccaaccaggctgtggtcctgatgggactcgacaagggctggccgatctccaaaatggatctgggggtgccccttctggccctcggatgctattctcaggtcaatcctctgacactgacggctgccgtgctccttctgattacccactacgccatcattggccccgggctgcaggcgaaggctacaagagaggcccaaaagcggaccgctgccggaatcatgaaaaaccctacagttgacggcattatgaccatcgatctcgaccccgtgatctatgatagcaagttcgagaaacagctgggccaggtcatgcttctggtgctctgtgccgttcagctgctgctcatgagaacgtcctgggctctttgcgaagccctgacactggcgaccgggcctattaccacactctgggagggatctccgggcaagttttggaataccacaatcgccgtgagcatggctaacattttccgcgggtcctacctggccggagctggccttgcctttagcatcatgaaatctgtcgggacgggaaagcggggcaccggctcccaaggggaaacactgggagagaagtggaaaaagaaactcaatcagctgagcagaaaggagttcgacctgtataaaaagtccggcattaccgaggtggatcgcacagaggcgaaagaagggctcaagcggggagagatcacccatcacgccgtgtctagaggcagcgctaaacttcagtggtttgttgaacggaacatggtcattcccgaggggcgcgtgatcgacctgggatgtggcagaggcgggtggtcctactattgcgccggactgaaaaaggtgacggaagtccggggctacaccaaagggggacctggccatgaggagcccgttcctatgtctacatacgggtggaatatcgtgaagctcatgagcggaaaagatgtgttctatctgcccccggaaaagtgtgacacccttctgtgcgatattggcgagtccagcccttctcccacagtcgaagagtcccgcaccatcagagtgctcaagatggttgagccctggctgaaaaacaatcagttctgtattaaggtgctgaacccttacatgcccacagtcatcgaacacctcgagcggcttcaacgcaaacacggcgggatgctggtgagaaatcctctgagccggaactctacccatgaaatgtattggatttccaatggaacgggcaacatcgttgctagcgtgaatatggtctctcgcctcctgcttaacagatttacaatgacccaccggagaccgaccatcgagaaggacgtggatctgggggccggaacacgccatgtgaacgctgaacccgagacgcctaatatggacgtcattggcgagcggatcaaaagaattaaggaagaacacaacagcacctggcactacgacgatgaaaatccctataagacatgggcctaccatgggtcctatgaggttaaagcgaccggatctgccagctccatgatcaacggcgtggtgaagctcctgacaaaaccttgggacgtcgtgcccatggttacccagatggctatgacagataccacgccgttcggccagcaacgcgtgtttaaggaaaaagtcgacacccggacacctaagagcatgcccgggaccagacgcgtgatgggaattacagccgagtggctgtggcggaccctcggcagaaataagaaacctcgcctgtgcacgcgggaggagttcacaaagaaagttagaaccaacgctgccatgggggccgtgtttacagaggaaaatcagtgggattccgcgaaggctgccgtcgaggacgaagatttctggaaacttgtggaccgcgagcgggagctgcacaagctcggaaaatgtggctcttgcgtttacaacatgatggggaagagagaaaagaaactgggcgagtttggaaaggccaaaggcagccgcgctatctggtacatgtggcttggggccagatatctggagttcgaggctctcggatttctgaatgaggatcattggttctcccgggaaaactcttacagcggcgtggagggggaaggactgcacaagctcggctatatcctgcgcgacatttccaaaatccccgggggcgccatgtacgcggatgacaccgccggatgggacacgagaattaccgaggatgaccttcataatgaagagaagatcacacagcagatggatcctgagcaccggcaactggctaacgccatttttaagctcacctatcagaataaagtcgtgaaggtccagagacccacaccgaccggcacagtgatggacatcatctctcggaaagatcagcgcgggagcggacaagttggcacctacgggctgaacacgttcacaaatatggaagctcagcttattagacagatggagggagaaggcgtgctgtccaaggccgacctcgagaaccctcatctgcccgagaagaagatcacccagtggctggagaccaagggggtcgagcggctcaaacgcatggcgattagcggcgatgactgcgtggtgaagcccatcgatgacagatttgccaacgctctgcttgccctgaatgatatgggaaaagttcggaaggacattcctcaatggcagccgtctaaaggctggcatgattggcaacaggtgcccttctgttcccaccatttccacgaactcatcatgaaggacgggcgcaagctggtcgtgccttgcagaccccaagacgagcttattggacgggctcgcatcagccagggcgccgggtggtctctgagagaaacagcttgtctcggaaaagcctatgcgcagatgtggtccctgatgtactttcaccggcgcgatctgagactcgccagcaacgctatctgctctgccgttcctgtgcattgggtccccacctcccggacaacgtggagcattcacgcccatcaccaatggatgaccacagaggacatgctgaccgtgtggaatcgcgtctggatcgaagataacccttggatggaggacaagacacccgtgaccacgtgggagaatgttccgtaccttggcaaaagagaagatcagtggtgtgggtccctgattggcctcaccagccgggctacatgggcccagaacatccctaccgcgattcagcaagtgagatctctgatcggaaatgaggagttccttgactatatgcccagcatgaagcgctttcggaaagaggaggaatccgagggcgctatctggtga

SEQ ID NO: 20731 - RNA, 9873 nt, synthetic construct
  misc_feature 1..9873: note = derived and/or modified CDS sequence (opt5) from DENV-3__FJ547079__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtcacctacaagtgtccgcatatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatgacagtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaggccgctgacgtgacatgggaggaagaggccgaacagacgggagtcagccataacctcatgatcaccgtggacgatgacggcacaatgcggattaaagatgacgagaccgagaatatcctgacagtccttctgaagaccgcgctgctcatcgtgtctggcatttttccgtactccatccctgctacgctgcttgtttggcacacctggcataaacagacacagcgcagcggggtgctgtgggatgtcccctctcctcccgaaacccaaaaggccgagctcgaagagggagtgtatagaattaaacagcagggcatcttcgggaagacacaggttggagtgggcgtccaaaaggagggggtgtttcacaccatgtggcacgtgacacggggagccgttctgacgtacaacggcaaacgcctcgaaccgaattgggcttccgtcaagaaagacctgattagctatggcgggggatggagactttctgcccagtggcagaagggcgaggaagtgcaagtgatcgcggtcgagcctgggaaaaaccccaagaatttccagaccatgcctggaacattccagaccaccacaggcgaaattggggctatcgccctggattttaagcccggaacgtccggcagccccatcattaaccgggagggcaaagtggttgggctgtacggaaatggcgtggtcaccaagaacgggggatatgtgtccggcatcgcccagacaaatgctgagcctgacgggccgacccccgaactcgaggaagagatgttcaaaaagcgcaacctgacaattatggatcttcatcctggcagcggaaaaaccagaaagtacctgcccgccatcgttcgggaagctattaagcgcagactccggacgctgatcctcgcccctacaagagtggtcgcggccgagatggaggaagctctgaaaggccttcccatccgctatcaaaccaccgccacaaagtctgagcacaccgggcgggaaattgtggacctgatgtgccatgctacatttaccatgagactgctcagccctgttcgcgtgccgaattacaacctgatcattatggatgaggcccacttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaaaaccgtgtggttcgtgcctagcattaaggccggcaacgacatcgccaactgtcttcgcaaaaatggaaagaaggtcattcagctgtccagaaaaacatttgataccgaatatcaaaagacaaaactcaacgactgggatttcgttgtgaccacagacatctctgagatgggcgctaattttaaggccgatcgggtgattgaccccagacggtgcctgaaacccgtcatcctgaccgatgggcctgagcgcgtgatcctcgcgggacccatgcctgttacggccgctagcgccgctcagagacggggccgcgtggggagaaacccgcagaaggaaaatgaccagtacattttcacaggacaaccccttaacaatgatgaggaccatgcccactggaccgaagctaagatgctgctggacaacatcaatacccctgagggcattatccccgccctcttcgaacctgagcgggagaaatccgcggccattgatggggaatatagactgaagggcgagagccgcaaaacatttgtcgaacttatgcggagaggagacctgcccgtgtggctcgctcacaaggttgcctctgagggcatcaaatacaccgatcgcaagtggtgcttcgacgggcagcggaacaatcagatcctggaagagaacatggatgtggagatttggacaaaagaaggagagaagaagaaactgagaccgcgctggctcgacgctcggacgtattccgatcctcttgccctgaaggaatttaaagacttcgccgctggcagaaagagcatcgcgctggatctcgtcaccgagattgggcgcgtgccctctcatctggcccacagaacacggaatgctcttgacaacctggtcatgctccatacctccgaacacggaggcaaagcctaccgccacgccgtggaggagctgcctgaaacaatggagaccctgctccttctgggcctgatgatcctcctgacagggggagctatgctttttctgattagcggcaaggggatcggaaagacctccatcggcctcatttgtgttatcgcctctagcgggatgctgtggatggcggaaattcccctgcagtggatcgcctccgctattgtgctcgagttctttatgatggtgcttctgatccctgagcccgaaaaacaaagaacaccgcaggataatcagctggcctatgtcgttattggaatcctcaccctggctgccatcattgcggccaacgagatgggccttctggaaacaaccaagcgggacctcggcatgagcaaagagcctggggtggtgtctcccacgtcctacctggatgtcgacctgcatcccgctagcgcctggacactctacgctgtggccaccacagttatcacccctatgcttcgccacaccattgaaaattctacagctaacgtgagcctggccgcgatcgccaaccaagctgtcgtgctgatgggactcgacaagggctggccgatttccaaaatggatctgggggtcccccttctggccctcggatgctattctcaggtgaatcctctgacgctgaccgctgccgttctccttctgatcacacattacgccatcattggccccgggctgcaggcgaaggctaccagagaggcccagaagcggacagctgccggaatcatgaaaaaccctaccgtggacggcattatgacgatcgatctcgaccccgtcatttatgatagcaagttcgagaaacaactgggccaggtgatgcttctggttctctgtgccgtgcagctgctgctcatgagaacatcctgggctctttgcgaagccctgaccctggcgaccgggcctatcacaaccctctgggagggatctccgggcaagttttggaatacaacgatcgccgtcagcatggctaacattttccgcgggtcctacctggccggagctggccttgcctttagcatcatgaaatctgtggggaccggaaagcggggcacaggctcccagggggaaaccctgggagagaagtggaaaaagaaactcaatcaactgagcagaaaggagttcgacctgtataaaaagtccggcattacagaggtggatcgcaccgaggcgaaagaagggctcaagcggggagagatcacgcaccatgccgtttctagaggcagcgctaaacttcagtggtttgtcgaacggaacatggtgattcccgaggggcgcgtgatcgacctgggatgtggcagaggcgggtggtcctactattgcgccggactgaaaaaggtcaccgaagttcggggctacacaaaagggggacctggccacgaggagcccgtgcctatgtctacctacgggtggaatattgtgaagctcatgagcggaaaagatgtcttctatctgcccccggaaaagtgtgacacacttctgtgcgatatcggcgagtccagcccttctcccaccgtggaagagtcccgcacaatcagagttctcaagatggtggagccctggctgaaaaacaatcagttctgtattaaggtcctgaacccttacatgcccaccgtgatcgaacacctcgagcggcttcagcgcaaacatggcgggatgctggttagaaatcctctgagccggaactctacgcacgaaatgtattggatttccaatggaacaggcaacatcgtggctagcgtcaatatggtgtctcgcctcctgcttaacagatttaccatgacccatcggagaccgacaattgagaaggacgtggatctgggggccggaacgcgccacgtcaacgctgaacccgagacccctaatatggacgttatcggcgagcggatcaaaagaattaaggaagaacacaacagcacatggcattacgacgatgaaaatccctataagacctgggcctaccacgggtcctatgaggtgaaagcgacaggatctgccagctccatgatcaacggcgtggtcaagctcctgaccaaaccttgggacgtggttcccatggtgacacaaatggctatgaccgatacgaccccgttcggccagcagcgcgtctttaaggaaaaagtggacacacggacccctagaagcatgcccgggacacgccgggttatgggaattaccgccgagtggctgtggagaacgctcggccgcaataagaagcctcggctgtgcacaagagaggagttcaccaaaaaggtgcgcacaaacgctgccatgggggccgtctttaccgaggaaaatcaatgggattccgcgaaagctgccgtggaggacgaagatttctggaaacttgttgaccgggagagagagctgcataaactcggaaagtgtggctcttgcgtgtacaacatgatggggaaacgcgaaaagaagctgggcgagtttggaaaagccaagggcagcagagctatctggtacatgtggcttggggcccggtatctggagttcgaggctctcggatttctgaatgaggatcactggttctcccgcgaaaactcttacagcggcgtcgagggggaaggactgcataaactcggctatattctgagagacatctccaagatccccgggggcgccatgtacgcggatgacacggccggatgggacacccggattacagaggatgaccttcacaatgaagagaaaatcacccagcagatggatcctgagcacagacagctggctaacgccatttttaagctcacatatcaaaataaggtggtcaaagtgcagcggcccaccccgacaggcaccgttatggacatcatttctcgcaaggatcagagagggagcggacaggtgggcacgtacgggctgaacacattcaccaatatggaagctcaacttatccggcagatggagggagaaggcgtcctgtccaaagccgacctcgagaaccctcatctgcccgaaaagaaaatcacccagtggctggagacaaagggggtggagcgcctcaagagaatggcgattagcggcgatgactgcgtggttaaacccatcgatgaccggtttgccaacgctctgcttgccctgaatgatatgggaaaggtgcgcaaagacattcctcagtggcaaccgtctaagggctggcacgattggcagcaggtccccttctgttcccatcacttccacgaactcatcatgaaagacgggagaaagctggtggttccttgccggccccaggacgagcttattggacgcgctagaatcagccaaggcgccgggtggtctctgcgggaaaccgcttgtctcggaaaggcctatgcgcagatgtggtccctgatgtactttcatcgcagagatctgcggctcgccagcaacgctatttgctctgccgtgcctgtccactgggtgcccacatcccgcacgacctggagcatccatgcccaccatcagtggatgacaaccgaggacatgctgacagtctggaatagagtgtggatcgaagataacccttggatggaggacaaaacccccgttacgacctgggagaatgtgccgtaccttggcaagcgggaagatcaatggtgtgggtccctgattggcctcacaagcagagctacctgggcccagaacatccctacagcgattcagcaggtccgctctctgatcggaaatgaggagttccttgactatatgcccagcatgaaacggtttagaaaggaggaggaatccgagggcgctatttggtga

SEQ ID NO: 20732 - RNA, 9873 nt, synthetic construct
  misc_feature 1..9873: note = derived and/or modified CDS sequence (opt5) from DENV-3__FJ547080__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagcatgaaaatctcaagtatacagtcatcatcaccgtgcacacaggggaccagcatcaggttggaaacgagacgcaaggcgtgaccgctgaaattacacctcaggcctctaccacagaggctatcctgcccgaatacggcaccctggggctcgagtgctcccctcgcacgggactggacttcaatgagatgattcttctgaccatgaaaaacaaggcctggatggtccacagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcataccgctctgacaggcgccaccgaaatccaaaattccgggggcaccagcattttcgccggacacctgaagtgtcgcctcaaaatggacaagctggagcttaaaggcatgtcttatgctatgtgcacaaacacgtttgtgctgaagaaagaggtctccgaaacccagcatgggacaatcctcatcaaggtggagtacaagggagaagatgttccctgtaaaattcctttcagcaccgaggacggccaagggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtacaagaagggatctagcattggcaaaatgtttgaagccacggctagaggggccagacgcatggctatccttggagacacagcctgggatttcggctccgttgggggagtcctcaacagcctgggcaagatggtgcatcagatttttgggtctgcgtataccgccctgttctccggcgtgagctgggtcatgaaaatcggaattggcgtgctcctgacctggatcgggcttaattctaagaacacaagcatgtccttttcttgcattgttatcggaatcattaccctgtacctcggcgctgtggtccaggccgacatggggtgtgtgatcaattggaaaggaaaggagctgaagtgcggcagcgggattttcgttacaaacgaggtgcacacgtggaccgaacagtataaatttcaagctgattcccccaagcggctggccacagcgatcgccggcgcttgggagaatggagtctgtggcattagaagcaccacacgcatggaaaaccttctctggaaacagatcgccaatgagctgaactacatcctgtgggaaaataacattaagctcaccgtggttgtgggggacatcattggagtcctggagcagggcaaacggacgcttacccctcagcccatggagctgaagtattcttggaaaacatgggggaaggctaagatcgtgaccgccgaaacacaaaactccagcttcattatcgatggacctaatacccccgagtgcccgtctgcctccagagcttggaacgtgtgggaagtcgaggactacggctttggcgttttcacaaccaatatctggctcaaactgcgcgaagtgtatacgcagctgtgtgaccaccggcttatgagcgcggccgtgaaggatgagagagctgtccatgccgacatggggtactggattgagtcccagaaaaacggatcttggaagctcgaaaaagccagcctgatcgaggtgaagacatgcacctggcctaagtcccacaccctgtggtctaatggcgttctcgaaagcgatatgattatccccaaatccctggctgggcctattagccagcataactaccgccccggatatcacacacaaaccgccggcccttggcaccttgggaagctggagctcgactttaattactgcgagggaacgacagtggtcatcaccgaaaactgtggcacacggggcccctctctgagaaccacaaccgtgtccgggaaactgatccatgagtggtgctgtcgcagctgcacgcttccgcctctccggtatatgggagaagatggctgttggtacgggatggagattagacccatctctgaaaaggaggagaatatggttaaatccctggtgagcgcgggatctggcaaggtcgacaacttcaccatgggggtgctgtgcctcgctattctgtttgaagaggttatgcggggaaagttcggcaaaaagcacatgatcgccggcgtgttctttacattcgtccttctgctcagcgggcagattacctggcgcgatatggcccatacactgatcatgattggatccaatgctagcgacagaatgggcatgggggtgacctatctggcccttatcgcgacgtttaaaatccagcccttcctggctctcggatttttcctgcggaagctcacatctagagaaaacctgcttctgggcgtggggctcgccatggccaccacactgcaactgcctgaggatattgaacagatggctaatggaatcgcccttggcctgatggctctcaaactgattacccagtttgagacctaccagctctggacagccctgatctcccttacgtgtagcaacaccattttcacactgaccgtcgcgtggcgcacagccaccctcatcctggctggcgtttccctgcttccggtgtgccaatctagctccatgcggaagacggactggctgcccatgacagtggccgctatgggggtccctcccctccctctgtttatcttctctctcaaggataccctgaaaagacgcagctggccccttaatgagggagtgatggccgttggcctggtgtccattctggcctctagcctcctgagaaacgacgtccctatggctgggccccttgtggcgggaggcctgctcatcgcctgttatgttattaccgggacatccgctgatctgaccgtggaaaaggccgccgacgtcacatgggaggaagaggctgaacagacgggagtgagccacaacctcatgatcaccgtcgacgatgacggcacaatgcggattaaagatgacgagaccgagaatatcctgacagtgcttctgaagaccgccctgctcatcgtttctggcatttttccgtactccatccctgcgacgctgcttgtgtggcatacctggcagaaacagacacaacgcagcggggtcctgtgggatgtgccctctcctcccgaaacccagaaggctgagctcgaagagggagtttacagaattaaacagcagggcatcttcgggaagacacaagtgggagtcggcgtgcagaaggagggggtgtttcacaccatgtggcacgttacacggggagccgtcctgacgtataacggcaaacgcctcgaaccgaattgggcctccgtgaagaaagacctgattagctacggcgggggatggagactttctgctcagtggcaaaagggcgaggaagtgcaggtcatcgccgtggagcctgggaaaaaccccaagaatttccagaccatgcctggaacattccagaccaccacaggcgaaattggggcgatcgctctggattttaagcccggaacgtccggcagccccatcattaaccgggagggcaaagttgtggggctgtatggaaatggcgtcgtgaccaagaacgggggatacgtttccggcatcgcccaaacaaatgccgagcctgacgggccgacccccgaactcgaggaagagatgttcaaaaagcgcaacctgacaattatggatcttcatcctggcagcggaaaaaccagaaagtatctgcccgctatcgtgcgggaagccattaagcgcagactccggacgctgatcctcgctcctacaagagtcgtggccgcggagatggaggaagccctgaaaggccttcccatccgctaccagaccaccgctacaaagtctgagcacaccgggcgggaaattgttgacctgatgtgccatgccacatttaccatgagactgctcagccctgtgcgcgtcccgaattataacctgatcattatggatgaggctcacttcacggaccccgcctccatcgccgctcggggatacatttctacaagagtgggcatgggggaagcggccgctatctttatgaccgccacacctcccggaaccgccgatgctttccctcagagcaatgcccccatccaggacgaggagcgcgacattccggaacggtcctggaactctggcaatgagtggatcacggattttgcggggaaaaccgtgtggttcgtccctagcattaaggctggcaacgacatcgccaactgtcttcgcaaaaatggaaagaaggttattcaactgtccagaaaaacatttgataccgaataccagaagacaaaactcaacgactgggatttcgtggtgaccacagacatctctgagatgggcgccaattttaaggctgatcgggtcattgaccccagacggtgcctgaaacccgtgatcctgaccgatgggcctgagcgcgttatcctcgccggacccatgcctgtgacggcggccagcgctgcccagagacggggccgcgtcgggagaaacccgcggaaggaaaatgaccagtatattttcacaggacaaccccttaacaatgatgaggaccatgctcactggaccgaagccaagatgctgctggacaacatcaatacccctgagggcattatccccgctctcttcgaacctgagagagagaaatccgccgcgattgatggggaataccgcctgaagggcgagagccggaaaacatttgtggaacttatgagacgcggagacctgcccgtttggctcgcccacaaggtggcttctgagggcatcaaatataccgatcggaagtggtgcttcgacgggcagagaaacaatcagatcctggaagagaacatggatgtcgagatttggacaaaagaaggagagaagaagaaactgcgcccgcggtggctcgacgccagaacgtactccgatcctcttgctctgaaggaatttaaagacttcgccgccggccgcaagagcatcgctctggatctcgtgaccgagattgggagagtcccctctcatctggcgcaccggacacgcaatgcccttgacaacctggtgatgctccatacctccgaacacggaggcaaggcttatagacacgccgttgaggagctgcctgaaacaatggagaccctgctccttctgggcctgatgatcctcctgacagggggagccatgctttttctgattagcggcaaggggatcggaaagacctccatcggcctcatttgtgtgatcgcttctagcgggatgctgtggatggccgaaattcccctgcagtggatcgcgtccgccattgtgctcgagttctttatgatggtccttctgatccctgagcccgaaaaacaacggacaccgcaggataatcagctggcttacgttgtgattggaatcctcaccctggccgctatcattgccgcgaacgagatgggccttctggaaacaaccaagcgcgacctcggcatgagcaaagagcctggggtggtctctcccacgtcctatctggatgtggacctgcatcccgccagcgcttggacactctacgccgttgctaccacagtgatcacccctatgcttagacacaccattgaaaattctacagccaacgtcagcctggctgccatcgcgaaccaagccgtggtcctgatgggactcgacaagggctggccgatttccaaaatggatctgggggtgccccttctggctctcggatgctactctcaggttaatcctctgacgctgaccgccgctgtgctccttctgatcacacattatgccatcattggccccgggctgcaggccaaggcgacccgggaggctcagaagagaacagccgctggaatcatgaaaaaccctaccgtcgacggcattatgacgatcgatctcgaccccgtgatttacgatagcaagttcgagaaacaactgggccaggttatgcttctggtgctctgtgccgtccagctgctgctcatgcgcacatcctgggccctttgcgaagctctgaccctggccaccgggcctatcacaaccctctgggagggatctccgggcaagttttggaatacaacgatcgcggtgagcatggccaacattttccgggggtcctatctggctggagccggccttgcttttagcatcatgaaatctgtggggaccggaaagagaggcacaggctcccagggggaaaccctgggagagaagtggaaaaagaaactcaatcaactgagccgcaaggagttcgacctgtacaaaaagtccggcattacagaggttgatcggaccgaggccaaagaagggctcaagagaggagagatcacgcaccatgcggtctctcggggcagcgccaaacttcagtggtttgtggaacgcaacatggtgattcccgaggggagagtcatcgacctgggatgtggccggggcgggtggtcctattactgcgctggactgaaaaaggttaccgaagtgcgcggctatacaaaagggggacctggccacgaggagcccgtgcctatgtctacctacgggtggaatattgtcaagctcatgagcggaaaagatgtgttctacctgcccccggaaaagtgtgacacacttctgtgcgatatcggcgagtccagcccttctcccaccgttgaagagtccagaacaatccgggtgctcaagatggtcgagccctggctgaaaaacaatcagttctgtattaaggtgctgaacccttatatgcccaccgttatcgaacacctcgagcgccttcagagaaaacatggcgggatgctggtgcggaatcctctgagccgcaactctacgcacgaaatgtactggatttccaatggaacaggcaacatcgtcgccagcgtgaatatggtgtctagactcctgcttaaccggtttaccatgacccatagacgcccgacaattgagaaggacgtcgatctgggggctggaacgcggcacgttaacgccgaacccgagacccctaatatggacgtgatcggcgagagaatcaaacgcattaaggaagaacacaacagcacatggcattatgacgatgaaaatccctacaagacctgggcttatcacgggtcctacgaggtgaaagccacaggatctgcgagctccatgatcaacggcgtcgtgaagctcctgaccaaaccttgggacgttgtgcccatggtcacacaaatggccatgaccgatacgaccccgttcggccagcagcgggtgtttaaggaaaaagttgacacaagaacccctcgcagcatgcccgggacacggagagtgatgggaattaccgctgagtggctgtggcgcacgctcggccggaataagaagcctagactgtgcacacgcgaggagttcaccaaaaaggtccggacaaacgccgctatgggggccgtgtttaccgaggaaaatcaatgggattccgccaaagcggctgttgaggacgaagatttctggatccttgtggacagagagcgcgagctgcataagctcggaaaatgtggctcttgcgtctataacatgatggggaagagagagaaaaagctgggcgagtttggaaaggccaaaggcagccgggccatttggtacatgtggcttggggctcgctacctggagttcgaggccctcggatttctgaatgaggatcactggttctccagagaaaactcttatagcggcgtggagggggaaggactgcataagctcggctacatcctgcgggacatctccaaaattcccgggggcgctatgtatgccgatgacacggcgggatgggacaccagaatcacagaggatgaccttcacaatgaagagaagattacccagcagatggatcctgagcaccggcagctggccaacgctatctttaaactcacataccaaaataaggtcgtgaaggttcagcgccccaccccgacaggcaccgtgatggacattatctctagaaaagatcagcgggggagcggacaggtcggcacgtatgggctgaacacattcaccaatatggaagcccaacttatccgccagatggagggagaaggcgtgctgtccaaggctgacctcgagaaccctcatctgcccgagaaaaagattacccagtggctggagacaaaaggggtggagagactcaagcggatggccatcagcggcgatgactgcgttgtgaagcccattgatgaccgctttgcgaacgccctgcttgctctgaatgatatgggaaaagtcagaaaggacatccctcagtggcaaccgtctaaaggctggcacgattggcaacaggtgcccttctgttcccatcacttccacgaactcattatgaaggacgggcggaaactggttgtgccttgccgcccccaggacgagcttatcggacgggcccggattagccaaggcgctgggtggtctctgcgcgaaaccgcctgtctcggaaaggcttacgcccagatgtggtccctgatgtattttcatagacgggatctgcgcctcgcgagcaacgccatctgctctgctgtccctgtgcactgggtccccacatccagaacgacctggagcatccatgcccaccatcagtggatgacaaccgaggacatgctgacagtgtggaatcgggtttggattgaagataacccttggatggaggacaagacccccgtgacgacctgggagaatgtcccgtaccttggcaaaagagaagatcaatggtgtgggtccctgatcggcctcacaagccgcgccacctgggctcagaacattcctacagccatccaacaggtgcggtctctgattggaaatgaggagttccttgactacatgcccagcatgaagagatttcgcaaagaggaggaatccgagggcgcgatctggtga

SEQ ID NO: 20733 - RNA, 9873 nt, synthetic construct
  misc_feature 1..9873: note = derived and/or modified CDS sequence (opt5) from DENV-3__FJ547081__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttctctggacatctgaagtgtcgcctcaaaatggacaagctggagcttaaaggcatgtcctacgccatgtgcacaaacacgtttgtgctgaagaaagaggtcagcgaaacccagcacgggacaatcctcatcaaggtggagtacaagggagaagatgttccctgtaaaattcctttctccaccgaggacggccaagggaaggctcataacggaagactgatcacagccaatcccgtggtcaccaaaaaggaggaacccgtgaacattgaggcggaacctccgttcggcgagtctaatatcgtgattgggatcggcgataacgctctgaaaatcaattggtataagaagggaagctccattggcaaaatgtttgaagccacggccagaggggctagacgcatggccatccttggagacacagcttgggatttcggcagcgttgggggagtcctcaactctctgggcaagatggtgcaccagatttttgggtccgcctacaccgcgctgttcagcggcgtgtcttgggtcatgaaaatcggaattggcgtgctcctgacctggatcgggcttaatagcaagaacacatccatgtcttttagctgcattgccatcggaatcattaccctgtatctcggcgctgttgtgcaggccgacatggggtgtgtcatcaattggaaaggaaaggagctgaagtgcggctccgggattttcgtgacaaacgaggttcatacgtggaccgaacagtacaaatttcaagctgatagccccaagcggctggccacagcgatcgccggcgcttgggagaatggagtgtgtggcattagatctaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcctggaaaacatgggggaaggctaagatcgtcaccgccgaaacacaaaacagctctttcattatcgatggacctaatacccccgagtgcccgtccgccagcagagcttggaacgtgtgggaagtggaggactatggctttggcgtcttcacaaccaatatctggctcaaactgcgcgaagtttacacgcagctgtgtgaccaccggcttatgtccgcggccgtgaaggatgagagagctgtgcacgccgacatggggtactggattgagtctcagaaaaacggaagctggaagctcgaaaaagcctccctgatcgaggtcaagacatgcacctggcctaagtctcataccctgtggagcaatggcgtgctcgaatccgatatgattatccccaaaagcctggctgggcctatttctcagcacaactatcgccccggataccatacacaaaccgccggcccttggcaccttgggaagctggagctcgactttaattattgcgagggaacgacagttgtgatcaccgaaaactgtggcacacggggcccctccctgagaaccacaaccgtcagcgggaaactgatccacgagtggtgctgtcgctcttgcacgcttccgcctctccggtacatgggagaagatggctgttggtatgggatggagattagacccatctccgaaaaggaggagaatatggtgaaaagcctggtttctgcgggaagcggcaaggtggacaacttcaccatgggggtcctgtgcctcgctattctgtttgaagaggtgatgcggggaaagttcggcaaaaagcatatgatcgccggcgttttctttacattcgtgcttctgctctccgggcagattacctggcgcgatatggcccacacactgatcatgattggaagcaatgcttctgacagaatgggcatgggggtcacctacctggcccttatcgcgacgtttaaaatccagcccttcctggctctcggatttttcctgcggaagctcacatccagagaaaacctgcttctgggcgtggggctcgccatggccaccacactgcaactgcctgaggatattgaacagatggctaatggaatcgcccttggcctgatgaccctcaaactgattacccagtttgagacatatcagctctggacggctctgatcagccttacctgttccaacacaattttcaccctgacagtggcctggcgcaccgcgacgctcatcctggccggcgtctctctgcttccggtttgccaaagctcctctatgcggaagacagactggctgcccatgaccgtggctgccatgggggtgcctcccctccctctgtttatcttcagcctcaaggataccctgaaaagacgctcctggccccttaatgagggagtcatggctgtgggcctggtttctattctggccagctccctcctgagaaacgacgtgcctatggccgggccccttgtcgctggaggcctgctcatcgcgtgttacgtgattacagggaccagcgccgatctgacagttgaaaaggctgccgacgtgacgtgggaggaagaggccgaacagaccggagtctctcataacctcatgatcacagtggacgatgacggcaccatgcggattaaagatgacgagacagagaatatcctgaccgtccttctgaagacggctctgctcatcgtgtccggcatttttccgtacagcatccctgccaccctgcttgtttggcacacatggcagaaacagacccaacgctctggggtgctgtgggatgtcccctcccctcccgaaacacagaaggcggagctcgaagagggagtgtatagaattaaacagcagggcatcttcgggaagacccaagttggagtgggcgtccagaaggagggggtgtttcatacaatgtggcacgtgacgcggggagctgttctgacctacaacggcaaacgcctcgaaccgaattgggccagcgtcaagaaagacctgatttcttatggcgggggatggagactttccgcccagtggcaaaagggcgaggaagtccaggtgatcgctgtcgagcctgggaaaaaccccaagaatttccagacaatgcctggaaccttccagaccacaacgggcgaaattggggccatcgcgctggattttaagcccggaaccagcggctcccccatcattaaccgggagggcaaagtggttgggctgtacggaaatggcgtggtcacaaagaacgggggatatgtgagcggcatcgctcaaaccaatgccgagcctgacgggccgacacccgaactcgaggaagagatgttcaaaaagcgcaacctgaccattatggatcttcaccctggctctggaaaaacgagaaagtacctgcccgccatcgttcgggaagctattaagcgcagactccggacactgatcctcgcccctaccagagtggtcgctgccgagatggaggaagcgctgaaaggccttcccatccgctatcagaccacagccaccaagagcgagcatacagggcgggaaattgtggacctgatgtgccacgctacctttacgatgagactgctctcccctgttcgcgtgccgaattacaacctgatcattatggatgaggcccatttcacagaccccgcttctatcgccgcccggggatacattagcaccagagtcggcatgggggaagctgcggccatctttatgacagctacccctcccggaacggccgatgccttccctcagtccaatgctcccatccaggacgaggagcgcgacattccggaacggtcttggaacagcggcaatgagtggatcaccgattttgccgggaaaacagtgtggttcgtgccttccattaaggcgggcaacgacatcgctaactgtcttcgcaaaaatggaaagaaggtcattcaactgtctagaaaaacctttgatacagaatatcagaagaccaaactcaacgactgggatttcgttgtgacaaccgacatcagcgagatgggcgccaattttaaggccgatcgggtgattgaccccagacggtgcctgaaacccgtcatcctgacggatgggcctgagcgcgtgatcctcgctggacccatgcctgttacagccgcgtccgccgctcagagacggggccgcgtggggagaaacccgcagaaggaaaatgaccaatacattttcaccggacagccccttaacaatgatgaggaccacgcccattggaccgaagctaagatgctgctggacaacatcaatacacctgagggcattatccccgccctcttcgaacctgagcgggagaaaagcgctgccattgatggggaatatagactgaagggcgagtctcgcaaaacctttgtcgaacttatgcggagaggagacctgcccgtgtggctcgcgcacaaggttgcctccgagggcatcaaatacgctgatcgcaagtggtgcttcgacgggcagcggaacaatcagatcctggaagagaacatggatgtggagatttggacaaaagaaggagagaagaagaaactgagaccgcgctggctcgacgcccggacgtatagcgatcctcttgctctgaaggaatttaaagacttcgccgccggcagaaagtctatcgctctggatctcgtcaccgagattgggcgcgtgccctcccacctggcgcatagaacacggaatgcccttgacaacctggtcatgctccacaccagcgaacatggaggcaaggcttaccgccacgccgtggaggagctgcctgaaacaatggagaccctgctccttctgggcctgatgatcctcctgacagggggagccatgctttttctgatttccggcaaggggatcggaaagacctctatcggcctcatttgtgttatcgctagctccgggatgctgtggatggccgaaattcccctgcaatggatcgcgagcgccattgtgctcgagttctttatgatggtgcttctgatccctgagcccgaaaaacagagaacaccgcaggataatcaactggcttatgtcgttattggaatcctcaccctggccgctatcattgccgcgaacgagatgggccttctggaaacaaccaagcgggacctcggcatgtctaaagagcctggggtggtgtccagcacgtcttacctggatgtcgacctgcaccccgccagcgcttggacactctacgccgtggctaccacagttatcacccccatgcttcgccataccattgaaaattccacagccaacgtgtctctggctgccatcgcgaaccaggccgtcgtgctgatgggactcgacaagggctggcctattagcaaaatggatctgggggtcccgcttctggctctcggatgctattcccaggtgaatcccctgacgctgaccgccgctgttctccttctgatcacacactacgccatcattggccctgggctgcaggccaaggcgaccagagaggctcaaaagcggacagccgctggaatcatgaaaaaccccaccgtggacggcattatgacgatcgatctcgaccctgtcatttatgattctaagttcgagaaacagctgggccaggtgatgcttctggttctctgtgccgtgcagctgctgctcatgagaacaagctgggccctttgcgaagctctgaccctggccaccgggcccatcacaaccctctgggagggatcccctggcaagttttggaatacaacgatcgcggtcagcatggccaacattttccgcgggtcttacctggctggagccggccttgctttttccatcatgaaaagcgtggggaccggaaagcggggcacaggctcccaaggggaaaccctgggagagaagtggaaaaagaaactcaatcagctgtctagaaaggagttcgacctgtataaaaagagcggcattacagaggtggatcgcaccgaggccaaagaagggctcaagcggggagagatcacgcatcacgcggtttccagaggctctgccaaacttcagtggtttgtcgaacggaacatggtgattccggaggggcgcgtgatcgacctgggatgtggcagaggcgggtggagctactattgcgctggactgaaaaaggtcaccgaagttcggggctacacaaaagggggacccggccatgaggagcctgtgcccatgtccacctacgggtggaatattgtgaagctcatgagcggaaaagatgtcttctatctgcctcccgaaaagtgtgacacacttctgtgcgatatcggcgagtcttccccgagccctaccgtggaagagtctcgcacaatcagagttctcaagatggtggagccctggctgaaaaacaatcagttctgtattaaggtcctgaacccctacatgcctaccgtgatcgaacacctcgagcggcttcaacgcaaacacggcgggatgctggttagaaatcccctgtcccggaacagcacgcatgaaatgtattggatttctaatggaacaggcaacatcgtggccagcgtcaatatggtgtcccgcctcctgcttaacagatttaccatgacccaccggagacctacaattgagaaggacgtggatctgggggctggaacgcgccatgtcaacgccgaaccggagacccccaatatggacgttatcggcgagcggatcaaaagaattaaggaagaacacaactctacatggcactacgacgatgaaaatccttataagacctgggcttaccatgggagctatgaggtgaaagccacaggatccgcgagctccatgatcaacggcgtggtcaagctcctgaccaaaccctgggacgtggttcctatggtgacacagatggccatgaccgatacgacccccttcggccagcaacgcgtctttaaggaaaaagtggacacacggaccccgagatctatgcctgggacacgccgggttatgggaattaccgctgagtggctgtggagaacgctcggccgcaataagaagccccggctgtgcacaagagaggagttcaccaaaaaggtgcgcacaaacgccgctatgggggccgtctttaccgaggaaaatcagtgggatagcgccaaagcggctgtggaggacgaagatttctggaaacttgttgaccgggagagagagctgcacaaactcggaaagtgtggctcctgcgtgtacaacatgatggggaaacgcgaaaagaagctgggcgagtttggaaaagccaagggctctagagccatctggtacatgtggcttggggctcggtatctggagttcgaggccctcggatttctgaatgaggatcattggttcagccgcgaaaactcctactctggcgtcgagggggaaggactgcacaaactcggctatattctgagagacatcagcaagatccctgggggcgctatgtacgccgatgacacggcgggatgggacacccggattacagaggatgaccttcataatgaagagaaaatcacccagcagatggatcccgagcacagacaactggccaacgctatttttaagctcacatatcagaataaggtggtcaaagtgcagcggcctacccccacaggcaccgttatggacatcatttcccgcaaggatcagagagggagcggacaagtgggcacgtactctctgaacacattcaccaatatggaagcccagcttatccggcagatggagggggaaggagtcctgtccaaagctgacctcgagaacccgcatctgcctgaaaagaaaatcacccagtggctggagacaaagggcgtggagcgcctcaagagaatggccattagcggggatgactgcgtggttaaacccatcgatgaccggtttgcgaacgccctgcttgctctgaatgatatgggcaaggtgcgcaaagacattccccaatggcagccttctaagggatggcatgattggcagcaggtcccgttctgttcccaccatttccacgaactcatcatgaaagacggcagaaagctggtggttccctgccggcctcaagacgagcttattgggcgcgccagaatcagccagggagctggctggtctctgcgggaaaccgcctgtctcgggaaggcttatgcccagatgtggtccctgatgtactttcaccgcagagatctgcggctcgcgagcaacgccatttgctccgctgtgcccgtccattgggtgcctacaagccgcacgacctggtctatccacgcccatcaccaatggatgacaaccgaggacatgctgacagtctggaatagagtgtggatcgaagataacccctggatggaggacaaaacccctgttacgacctgggagaatgtgccctaccttggaaagcgggaagatcagtggtgtggcagcctgattgggctcacatccagagccacctgggctcagaacatcccgacagccattcagcaagtccgctctctgatcggcaatgaggagttccttgactatatgcctagcatgaaacggtttagaaaggaggaggaatccgagggagcgatttggtga

SEQ ID NO: 20734 - RNA, 9873 nt, synthetic construct
  misc_feature 1..9873: note = derived and/or modified CDS sequence (opt5) from DENV-3__FJ547082__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcacaaaaaaggaggaacccgtgaacattgaggccgaacctccgttcggcgagtccaatatcgtgattgggatcggcgataacgccctgaaaatcaattggtataagaagggatctagcattggcaaaatgtttgaagctaccgcccggggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcttggaaaatgtgggggaaggccaagatcgtcacagctgaaacccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggagctcgactttaattattgcgagggaaccacggttgtgatcacagaaaactgtggcacccggggcccctctctgagaacaaccacagtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgccggatctggcaaggtggacaacttcacgatgggggtcctgtgcctcgccattctgtttgaagaggtgatgcggggaaagttcggcaaaaagcatatgatcgctggcgttttctttaccttcgtgcttctgctcagcgggcagattacatggcgcgatatggcccacaccctgatcatgattggatccaatgcgagcgacagaatgggcatgggggtcacatacctggctcttatcgccacctttaaaatccagcccttcctggccctcggatttttcctgcggaagctcacgtctagagaaaacctgcttctgggcgtggggctcgctatggccacaaccctgcaactgcctgaggatattgaacagatggctaatggaatcgcccttggcctgatggcgctcaaactgattacacagtttgagacctatcagctctggaccgccctgatctcccttacatgtagcaacacgattttcaccctgacagtggcttggcgcaccgccacactcatcctggctggcgtctccctgcttccggtttgccaatctagctccatgcggaagtctgactggctgcccatgaccgtggccgccatgggggtgcctcccctccctctgtttatcttcagcctcaaggatacgctgaaaagacgctcctggccccttaatgagggagtcatggctgtgggcctggtttctattctggcgagctccctcctgagaaacgacgtgcctatggccgggccccttgtcgctggaggcctgctcatcgcctgttacgtgattacagggaccagcgccgatctgaccgttgaaaaggctgccgacgtgacatgggaggaagaggcggaacagaccggagtctctcataacctcatgatcacagtggacgatgacggcacgatgcggattaaagatgacgagaccgagaatatcctgacagtccttctgaagaccgctctgctcatcgtgtccggcatttttccgtacagcatccctgccacactgcttgtttggcacacctggcagaaacagacgcgcagatctggggtgctgtgggatgtcccctcccctcccgaaacccaaaaggccgagctcgaagagggagtgtatcggattaaacagcagggcatcttcgggaagacacaggttggagtgggcgtccaaaaggagggggtgtttcataccatgtggcacgtgacacgcggagctgttctgacctacaacggcaaaagactcgaaccgaattgggccagcgtcaagaaagacctgatttcttatggcgggggatggcggctttccgcgcagtggcagaagggcgaggaagtgcaagtgatcgctgtcgagcctgggaaaaaccccaagaatttccagacaatgcctggaacgttccagaccacaaccggcgaaattggggccatcgccctggattttaagcccggaaccagcggctcccccatcattaaccgcgagggcaaagtggttgggctgtacggaaatggcgtggtcacaaagaacgggggatatgtgagcggcatcgctcagacgaatgccgagcctgacgggccgacccccgaactcgaggaagagatgttcaaaaagagaaacctgacaattatggatcttcaccctggctctggaaaaacccggaagtacctgcccgctatcgttcgcgaagccattaagagacggctcagaacactgatcctcgcgcctacccgcgtggtcgccgctgagatggaggaagccctgaaaggccttcccatccggtatcaaacgacagctaccaagagcgagcataccgggagagaaattgtggacctgatgtgccacgccacatttaccatgcgcctgctctcccctgttcgggtgccgaattacaacctgatcattatggatgaggcccatttcacagaccccgcttctatcgcggccagaggatacattagcacccgcgtcggcatgggggaagctgccgccatctttatgacggctacacctcccggaaccgccgatgcgttccctcagtccaatgctcccatccaggacgaggagcgggacattccggaaagatcttggaacagcggcaatgagtggatcacagattttgccgggaaaaccgtgtggttcgtgccttccattaaggccggcaacgacatcgctaactgtcttcgcaaaaatggaaagaaggtcattcagctgtctcggaaaacgtttgataccgaatatcaaaagacaaaactcaacgactgggatttcgttgtgaccacagacatcagcgagatgggcgccaattttaaggcggatagagtgattgacccccggcgctgcctgaaacccgtcatcctgaccgatgggcctgagagagtgatcctcgccggacccatgcctgttacagctgcctccgctgcccagcggcgcggcagagtggggcggaacccgcagaaggaaaatgaccagtacattttcaccggacaaccccttaacaatgatgaggaccacgctcattggacggaagccaagatgctgctggacaacatcaatacacctgagggcattatccccgcgctcttcgaacctgagagagagaaaagcgccgctattgatggggaatatcgcctgaagggcgagtctcggaaaacctttgtcgaacttatgagacgcggagacctgcccgtgtggctcgcccacaaggttgcttccgagggcatcaaatacaccgatcggaagtggtgcttcgacgggcagagaaacaatcagatcctggaagagaacatggatgtggagatttggacaaaagaaggagagaagaagaaactgcgcccgcggtggctcgacgccagaacctatagcgatcctcttgccctgaaggaatttaaagacttcgctgcgggccgcaagtctatcgccctggatctcgtcacagagattgggagagtgccctcccacctggctcatcggacgcgcaatgcccttgacaacctggtcatgctccacaccagcgaacatggaggcaaagcctacagacacgctgtggaggagctgcctgaaacaatggagaccctgctccttctgggcctgatgatcctcctgacagggggagccatgctttttctgatttccggcaaggggatcggaaagacctctatcggcctcatttgtgttatcgcgagctccgggatgctgtggatggccgaaattcccctgcagtggatcgctagcgccattgtgctcgagttctttatgatggtgcttctgatccctgagcccgaaaaacaacggacgccgcaggataatcagctggcttatgtcgttattggaatcctcaccctggccgcgatcattgccgctaacgagatgggccttctggaaacaaccaagcgcgacctcggcatgtctaaagagcctggggtggtgtcccccacaagctacctggatgtcgacctgcaccccgcctctgcttggaccctctacgccgtggctacgacagttatcacccctatgcttagacatacaattgaaaatagcaccgccaacgtgtccctggcggccatcgctaaccaagccgtcgtgctgatgggactcgacaagggctggccgatttctaaaatggatctgggggtcccccttctggctctcggatgctatagccaggtgaatcctctgaccctgacagccgccgttctccttctgatcacgcactacgcgatcattggccccgggctgcaggctaaggccacccgggaggctcagaagagaacagccgccggaatcatgaaaaaccctaccgtggacggcattatgacaatcgatctcgaccccgtcatttatgattccaagttcgagaaacaactgggccaggtgatgcttctggttctctgtgctgtgcagctgctgctcatgcgcacctcttgggccctttgcgaagcgctgacgctggccacagggcctatcaccaccctctgggagggaagcccgggcaagttttggaatacaaccatcgctgtctccatggccaacattttccgggggagctacctggctggagccggccttgcgttttctatcatgaaatccgtggggacaggaaagagaggcacgggcagccagggggaaaccctgggagagaagtggaaaaagaaactcaatcaactgtcccgcaaggaattcgacctgtataaaaagtctggcattacagaggtggatcggaccgaggccaaagaagggctcaagagaggagagatcacacatcacgctgttagccggggctccgccaagcttcagtggtttgtcgaacgcaacatggtgattcccgaggggagagtgatcgacctgggatgtggccggggcgggtggtcttactattgcgctggactgaaaaaggtcaccgaagttcgcggctacacgaaagggggacctggccatgaggagcccgtgcctatgagcacctacgggtggaatattgtgaagctcatgtccggaaaagatgtcttctatctgcccccggaaaagtgtgacacacttctgtgcgatatcggcgagagctctccttcccccaccgtggaagagagcagaacaatccgggttctcaagatggtggagccctggctgaaaaacaatcagttctgtattaaggtcctgaacccttacatgcccaccgtgatcgaacacctcgagcgccttcagagaaaacacggcgggatgctggttcggaatcctctgtctcgcaactccacacatgaaatgtattggattagcaatggaaccggcaacatcgtggcctctgtcaatatggtgagcagactcctgcttaaccggtttacgatgacacacagacgcccgaccattgagaaggacgtggatctgggggctggaacccggcatgtcaacgccgaacccgagacacctaatatggacgttatcggcgagagaatcaaacgcattaaggaagagcacaactccacgtggcactacgacgatgaaaatccctataagacctgggcgtaccatgggtcttatgaggtgaaagccacaggaagcgcttccagcatgatcaacggcgtggtcaagctcctgaccaaaccttgggacgtggttcccatggtgacacaaatggccatgaccgatacaaccccgttcggccagcagcgggtctttaaggaaaaagtggacacgagaacccctcgctccatgcccgggacacggagagttatgggaattaccgctgagtggctgtggcgcacactcggccggaataagaagcctagactgtgcacccgcgaggaattcacgaaaaaggtgcggacaaacgccgccatgggggcggtctttaccgaggaaaatcaatgggattctgctaaagccgccgtggaggacgaagatttctggaagcttgttgacagagagcgcgagctgcacaaactcggaaagtgtggcagctgcgtgtacaacatgatggggaaaagagaaaagaagctgggcgagtttggaaaagctaagggctcccgggccatctggtacatgtggcttggggctcgctatctggaattcgaggccctcggatttctgaatgaggatcattggttctctagagaaaacagctactccggcgtcgagggggaaggactgcacaaactcggctatattctgcgggacatctctaagatccccgggggcgcgatgtacgccgatgacacagctggatgggacaccagaattacggaggatgaccttcataatgaagagaaaatcacccagcagatggatcctgagcaccggcagctggccaacgctatttttaagctcacatatcaaaataaggtggtcaaagtgcagcgccccaccccgacaggcaccgttatggacatcattagcagaaaggatcagcgggggtccggacaggtgggcacatacgggctgaacaccttcacgaatatggaagcccaacttatccgccagatggagggagaaggcgtcctgagcaaagcggacctcgagaaccctcacctgtctgaaaagaaaatcacacagtggctggagaccaagggggtggagagactcaagcggatggccatttccggcgatgactgcgtggttaaacccatcgatgaccgctttgctaacgccctgcttgctctgaatgatatgggaaaggtgagaaaagacattccccagtggcaacctagcaagggctggcatgattggcagcaggtcccgttctgttctcaccatttccacgaactcatcatgaaagacgggcggaagctggtggttccctgccgccctcaggacgagcttattggaagagcccggatctcccaaggcgctgggtggagcctgcgcgaaaccgcctgtctcggaaaggcgtatgcccagatgtggtctctgatgtactttcacagacgggatctgcgcctcgcttccaacgccatttgcagcgccgtgcccgtccattgggtgcctacatccagaaccacatggagcatccacgctcatcaccagtggatgacgaccgaggacatgctgacagtctggaatcgggtgtggatcgaagataacccctggatggaggacaaaacccctgttacaacctgggagaatgtgccctaccttggcaagagagaagatcaatggtgtgggtctctgattggcctcacgagccgcgccacctgggcgcagaacatcccgacagctattcagcaggtccggtccctgatcggaaatgaggaattccttgactatatgccttctatgaaaagatttcgcaaggaggaggaaagcgagggcgccatttggtga

SEQ ID NO: 20735 - RNA, 9873 nt, synthetic construct
  misc_feature 1..9873: note = derived and/or modified CDS sequence (opt5) from DENV-3__FJ547083__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagagctatgtgtgtaaacacacctacgtcgatcgcggctgggggaatggatgcggcctgttcgggaagggatctcttgtgacctgcgccaagtttcaatgtctggagcccattgagggcaaagttgtgcagtatgaaaacctcaagtacacagtcatcatcaccgtgcacacaggggaccagcatcaggttggaaatgagacgcaaggcgtgaccgctgaaattacacctcaggcctccaccacagaggctatcctgcccgaatatggcaccctggggctcgagtgcagccctagaacgggactggacttcaacgagatgattcttctgaccatgaaaaataaggcctggatggtccaccggcagtggtttttcgatctccccctgccgtggacatctggcgccaccacagaaacccctacgtggaaccgcaaagagcttctggtgacatttaagaatgctcatgcgaaaaagcaagaagtcgtggttctcgggtcccaggagggagccatgcacaccgctctgacaggcgccaccgaaatccagaacagcgggggcacctctattttcgccggacacctgaagtgtagactcaaaatggacaagctggagcttaaaggcatgtcctacgctatgtgcacaaatacgtttgtgctgaagaaagaggtcagcgaaacccagcatgggacaatcctcatcaaggtggagtacaagggagaagatgccccctgtaaaattcctttctccaccgaggacggccaagggaaggcgcacaacggacggctgatcacagctaaccccgttgtgaccaaaaaggaggaacccgtcaatattgaggccgaacctccgttcggcgagtctaacatcgtgattgggatcggcgataatgccctgaaaatcaactggtataagaagggaagctccattggcaaaatgtttgaagctacggccagaggggctcgccggatggccatccttggagacacagcgtgggatttcggcagcgtggggggagttctcaattctctgggcaagatggtccatcagatttttgggtccgcctacaccgctctgttcagcggcgtgtcttgggtgatgaaaatcggaattggcgtcctcctgacctggatcgggcttaacagcaagaatacatccatgtcttttagctgcattgccatcggaatcattaccctgtatctcggcgctgtggttcaggccgacatggggtgtgtgatcaactggaaaggaaaggagctgaagtgcggctccgggattttcgtcacaaatgaggtgcacacgtggaccgaacagtacaaatttcaagcggatagccccaagagactggccacagctatcgccggcgcttgggagaacggagtttgtggcattcgctctaccacacggatggaaaatcttctctggaaacagatcgccaacgagctgaattatatcctgtgggaaaacaatattaagctcaccgtggtcgtgggggacacgatcggagttctggagcagggcaaaagaacccttacacctcagcccatggagctgaagtactcctggaaaacctgggggaaggccaagattgtgacagctgaaacccaaaacagctctttcatcattgatggacctaacacacccgagtgcccgtccgcgagccgcgcctggaatgtctgggaagtggaggactatggctttggcgtgttcaccacgaacatctggctcaaactgcgggaagtctacacacagctgtgtgaccatagacttatgtccgctgccgttaaggatgagcgcgccgtgcacgctgacatggggtactggatcgagtctcagaaaaatggaagctggaagctcgaaaaagcctccctgattgaggtgaagacctgcacctggcctaagtctcacacactgtggagcaacggcgtcctcgaatccgatatgatcattcccaaaagcctggcggggcctatctctcagcataatcaccggcccggatatcatacccaaacggctggcccttggcaccttgggaagctggagctcgactttaactactgcgagggaacaaccgtggttattacagaaaattgtggcaccagaggcccctccctgcgcacaaccacggtgagcgggaaactgatccacgagtggtgctgtcggtcttgcacccttccgcctctcagatatatgggagaagatggctgttggtacgggatggagatccggcccatttccgaaaaggaggagaacatggtcaaaagcctggtgtctgccggaagcggcaaggttgacaatttcacaatgggggtgctgtgcctcgccatcctgtttgaagaggtcatgcgcggaaagttcggcaaaaagcatatgattgctggcgtgttctttaccttcgttcttctgctctccgggcagatcacatggagagatatggcccacaccctgattatgatcggaagctctgcgtccgaccggatgggcatgggggtgacgtatctggctcttattgccacatttaaaatccagcccttcctggccctcggatttttcctgagaaagctcaccagccgcgaaaacctgcttctgggcgtcgggctcgctatggccacaaccctgcaactgcctgaggatatcgaacagatggctaatggaattgcccttggcctgatggcgctcaaactgatcacccagtttgagacataccagctctggacggccctgatttcccttacctgttctaacacaatgttcaccctgacagtggcttggcggaccgccacgctcatcctggctggcgtgagcctgcttccggtctgccaatcctctagcatgagaaagacagactggctgcccatggccgttgccgctatgggggtgcctcccctccctctgtttattttctccctcaaggataccctgaaacgcagatcttggccccttaatgagggagtgatggcggtcggcctggtgagcatcctggcctccagcctcctgcggaacgacgttcctatggctgggccccttgtggccggaggcctgctcatcgcctgttatgtcattaccgggacatctgctgatctgaccgtggaaaaggccgcggacatcacatgggaggaagaggctgaacagacgggagtttcccataatctcatgattaccgtggacgatgacggcacaatgcgcatcaaagatgacgagaccgagaacattctgacagtccttctgaagaccgccctgctcatcgtgagcggcgtctttccgtactctatccctgccacgctgcttgtgtggcacacctggcagaaacagacacaaagatccggggttctgtgggatgtgcccagccctcccgaaacccagaaggctgagctcgaagagggagtctaccggattaaacagcagggcatcttcgggaagacacaagtgggagttggcgtgcagaaggagggggtctttcataccatgtggcacgtgacacgcggagccgtgctgacgtataacggcaaaagactcgaaccgaattgggcgtctgttaagaaagacctgatttcctacggcgggggatggcggcttagcgctcagtggcaaaagggcgaggaagtccaggtgatcgccgtggagcctgggaaaaaccccaagaatttccagaccatgcctggaacattccagaccaccacaggcgaaattggggccatcgctctggattttaagcccggaacgtccggcagccccattatcaaccgcgagggcaaagtcgtggggctgtatggaaatggcgttgtgaccaagaacgggggatacgtctctggcatcgcccaaacaaatgctgagcctgacgggccgacccccgaactcgaggaagagatgttcaaaaagagaaacctgacaattatggatcttcaccctggcagcggaaaaacccggaagtatctgcccgccatcgtgcgcgaagcgattaagagacggctcagaacgctgatcctcgcccctacacgcgttgtggctgccgagatggaggaagctctgaaaggccttcccattcggtaccagaccaccgccacaaagtccgagcataccgggagagaaatcgtcgacctgatgtgccacgccacatttaccatgcgcctgctctctcctgtgcgggttccgaattataacctgatcattatggatgaggctcatttcacggaccccgcgagcatcgccgctagaggatacatttccacacgcgtgggcatgggggaagccgccgctatctttatgaccgccacacctcccggaaccgcggatgctttccctcagtctaatgcccccattcaggacgaggagcgggacatcccggaaagaagctggaactccggcaatgagtggatcacggattttgccgggaaaaccgtctggttcgtgccttctattaaggctggcaacgacatcgccaattgtcttcgcaaaaacggaaagaaggtgattcaactgagccggaaaacatttgataccgaataccagaagacaaaactcaacgactgggatttcgtcgttaccacagacatctccgagatgggcgcgaattttaaggccgatagagtgattgacccccggcgctgcctgaaacccgtgatcctgaccgatgggcctgagagagtcattctcgctggacccatgcctgtgacggccgctagcgccgctcagcggcgcggcagagttgggcggaacccgcagaaggaaaatgaccaatatatcttcacaggacagccccttaacaatgatgaggaccacgcccattggaccgaagcgaagatgctgctggacaacatcaatacccctgagggcattatccccgccctcttcgaacctgagagagagaaatctgctgccattgatggggaataccgcctgaagggcgagtcccggaaaacatttgtggaacttatgagacgcggagacctgcccgtctggctcgctcacaaggtggccagcgagggcatcaaatataccgatcggaagtggtgcttcgacgggcagagaaacaatcagattctggaagagaacatggatgttgagatctggacaaaagaaggagagaagaagaaactgcgcccgcggtggctcgacgccagaacgtactctgatcctcttgctctgaaggaatttaaagacttcgcggccggccgcaagtccatcgctctggatctcgtgaccgagattgggagagtccccagccacctggcccatcggacacgcaatgcccttgacaacctggtgatgctccacacctccgaacatggaggcagagcttatcggcacgccgtcgaggagctgcctgaaacaatggagaccctgctccttctgggcctgatgatcctcctgacggggggagcgatgctttttctgatttctggcaaagggatcggaaagaccagcattggcctcatctgtgtgatcgcctccagcgggatgctgtggatggctgaaattcccctgcaatggatcgcctctgctattgttctcgagttctttatgatggtgcttctgatccctgagcccgaaaagcagcgcacaccgcaggataatcaactggcctacgtggtcattggaatcctcaccctggcggccattatcgctgccaacgagatgggccttctggaaacaaccaaaagagacctcggcatgtccaaggagcctggggttgtgagccccacgtcttatctggatgtggacctgcaccccgctagcgcctggacactctacgctgtcgccaccacagtgatcacccctatgcttcggcataccattgaaaattccacagcgaacgtttctctggccgctatcgccaatcaggctgtggtcctgatgggactcgacaaaggctggccgattagcaagatggatctgggggtgccccttctggccctcggatgctactcccaggtcaaccctctgacgctgaccgccgcggtgctccttctgatcacacactatgctattatcggccccgggctgcaggccaaagctaccagagaggcccaaaagcgcacagccgctggaatcatgaagaaccctaccgttgacggcattatgacgatcgatctcgaccccgtgatttacgattctaaattcgagaagcagctgggccaggtcatgcttctggtgctctgtgccgttcagctgctgctcatgcggacaagctgggcgctttgcgaagccctgaccctggctaccgggcctatcacaaccctctgggagggatccccgggcaaattttggaatacaacgattgccgtgagcatggctaacatcttcagagggtcttatctggccggagcgggccttgccttttccatcatgaagagcgtcgggaccggaaaacgcggcacaggctcccaaggggaaaccctgggagagaagtggaagaaaaagctcaatcagctgtctcggaaagaattcgacctgtacaagaaaagcggcattacagaggtggatagaaccgaggctaaggaagggctcaaacggggagagatcacgcatcacgccgtgtcccgcggctctgctaagcttcagtggtttgttgaaagaaacatggtcattcccgaggggcgggtgatcgacctgggatgtggccgcggcgggtggagctattactgcgccggactgaagaaagtgaccgaagtcagaggctatacaaaggggggacctggccatgaggagcccgttcctatgtccacctacgggtggaatattgtgaaactcatgagcggaaaggatgtgttctacctgcccccggaaaaatgtgacacacttctgtgcgatatcggcgagtcttcccctagccccaccgtcgaagagtctcggacaattcgcgtgctcaagatggttgagccctggctgaagaacaatcagttctgtatcaaagtgctgaacccttatatgcccaccgtcatcgaacacctcgagagacttcaacggaagcacggcgggatgctggtgcgcaatcctctgtccagaaacagcacgcatgaaatgtactggatttctaatggaacaggcaacatcgttgctagcgtgaatatggtctcccggctcctgcttaacagatttaccatgacccaccgccggccgacaattgagaaagacgtggatctgggggccggaacgagacatgtgaatgcggaacccgagacccctaacatggacgtcatcggcgagcgcattaagcggatcaaagaagagcacaactctacatggcactatgacgatgaaaatccctacaagacctgggcctatcatgggagctacgaggttaaggctacaggatccgccagctccatgatcaacggcgtggtgaaactcctgaccaagccttgggacgtcgtgcccatggttacacagatggctatgaccgatacgaccccgttcggccagcaaagagtgtttaaagaaaaggtcgacacacgcacccctcggtctatgcccgggacaagacgcgtgatgggaattaccgccgagtggctgtggcggacgctcggcagaaataaaaagcctcgcctgtgcacacgggaggaattcaccaagaaagttagaacaaacgccgcgatgggggctgtgtttaccgaggaaaatcagtgggatagcgccaaggccgctgtcgaggacgaagatttctggaaacttgtggaccgcgagagagagctgcacaagctcggaaaatgtggctcctgcgtttataacatgatggggaagcgggaaaaaaagctgggcgagtttggaaaggccaaaggctctcgcgctatctggtacatgtggcttggggccagatacctggaattcgaggcgctcggatttctgaatgaggatcattggttcagccgggaaaactcctattctggcgtggagggggaaggactgcacaagctcggctacattctgagagacatcagcaaaattcccgggggcgccatgtatgctgatgacacggccggatgggacacccggatcacagaggatgaccttcataatgaagagaagatcacccagcagatggatcctgagcaccgccaactggctaacgccatttttaaactcacataccagaataaggtcgtgaaggtccagagacccaccccgacaggcaccgtgatggacatcatttcccggaaagatcagcgcgggagcggacaagttggcacgtatgggctgaacacattcaccaatatggaagcgcagcttatcagacagatggagggagaaggcgtgctgtctaaggccgacctcgagaaccctcacctgcccgaaaaaaagattacccagtggctggagacaaaaggggtcgagcggctcaagcgcatggctatctccggcgatgactgcgtggtgaagcccatcgatgacagatttgccaatgctctgcttgccctgaacgatatgggaaaagttcggaaggacattcctcaatggcagccgagcaaaggctggcatgattggcagcaggtgcccttctgttctcaccatttccacgaactcatcatgaaggacgggcgcaaactggtcgtgccttgcagaccccaagacgagcttattggacgggctcgcatctcccagggcgccgggtggagcctgagagaaaccgcgtgtctcggaaaggcctacgctcagatgtggtctctgatgtattttcaccggcgcgatctgagactcgcctccaacgccatttgcagcgctgttcctgtgcattgggtccccacatcccggacgacctggagcatccacgcccatcaccaatggatgacaaccgaggacatgctgacagtgtggaatagagtctggattgaagataacccttggatggaggacaagacccccgtgacgacctgggagaatgttccgtaccttggcaaacgcgaagatcagtggtgtgggtctctgatcggcctcacaagccgggcgacctgggctcagaacatccctacagccattcagcaagtgagatccctgatcggaaatgaggaattccttgactacatgccctctatgaagcgctttcggaaagaggaggaaagcgagggcgccatttggtga

SEQ ID NO: 20736 - RNA, 9873 nt, synthetic construct
  misc_feature 1..9873: note = derived and/or modified CDS sequence (opt5) from DENV-3__FJ547084__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagcggggatctagcattggcaagatgtttgaagccacggctagaggggcccgccggatggctatccttggagacacagcctgggatttcggctccgttgggggagtcctcaacagcctgggcaaaatggtgcaccagatttttgggtctgcgtacaccgccctgttctccggcgtgagctgggtcatgaagatcggaattggcgtgctcctgacctggatcgggcttaattctaaaaacacaagcatgtccttttcttgcattgctatcggaatcattaccctgtatctcggcgccgttgtgcaggctgacatggggtgtgtcatcaattggaagggaaaagagctgaagtgcggcagcgggattttcgtgacaaacgaggttcatacgtggaccgaacagtacaagtttcaagccgattcccccaaaagactggcgacagccatcgctggcgcctgggagaatggagtgtgtggcattcgcagcaccacacggatggaaaaccttctctggaagcagatcgctaatgagctgaactatatcctgtgggaaaataacattaaactcaccgtcgtggttggggacacgatcggagtgctggagcagggcaagagaacccttacacctcagcccatggagctgaaatactcttggaagacctgggggaaagccaagattgtcacagccgaaacccaaaactccagcttcatcattgatggacctaatacacccgagtgcccgtctgcttcccgcgcgtggaacgtgtgggaagtggaggactatggctttggcgtcttcaccacgaatatctggctcaagctgcgggaagtttacacacagctgtgtgaccacagacttatgagcgccgctgtgaaagatgagcgcgccgtgcacgccgacatggggtactggatcgagtcccagaagaacggatcttggaaactcgaaaaggctagcctgattgaggtcaaaacctgcacctggcctaagtcccatacactgtggtctaatggcgtgctcgaaagcgatatgatcattcccaagtccctggccgggcctatcagccagcacaactatcggcccggataccatacccaaacggcgggcccttggcaccttgggaaactggagctcgactttaattattgcgagggaacaaccgttgtgattacagaaaactgtggcaccagaggcccctctctgcgcacaaccacggtctccgggaagctgatccacgagtggtgctgtcggagctgcacccttccgcctctcagatacatgggagaagatggctgttggtatgggatggagatccggcccatttctgaaaaagaggagaatatggtgaagtccctggttagcgctggatctggcaaagtggacaacttcacaatgggggtcctgtgcctcgccatcctgtttgaagaggtgatgcgcggaaagttcggcaagaaacatatgattgttggcgtgttctttaccttcgtccttctgctcagcgggcagatcacatggagagatatggcccacaccctgattatgatcggatccaatgctagcgaccggatgggcatgggggtgacgtacctggcccttattgcgacatttaagatccagcccttcctggctctcggatttttcctgagaaaactcacctctcgcgaaaacctgcttctgggcgtggggctcgccatggccacaaccctgcaactgcctgaggatatcgaacagatggctaatggaattgcccttggcctgatggctctcaagctgaccacacagtttgagacgtatcagctctggaccgccctgatctcccttacatgtagcaacaccattttcacactgaccgtcgcgtggcggacggccacactcatcctggctggcgtttccctgcttccggtgtgccaatctagctccatgagaaaaaccgactggctgcccatgaccgtggccgctatgggggtccctcccctccctctgtttattttctctctcaaggatacactgaagcgcagaagctggccccttaatgagggagtgatggccgttggcctggtgtccatcctggcctctagcctcctgcggaacgacgtccctatggctgggccccttgtggcgggaggcctgctcatcgcctgttacgttattaccgggacatccgctgatctgacggtggaaaaagccgccgacgtcacctgggaggaagaggctgaacagacaggagtgagccataacctcatgatcaccgtcgacgatgacggcacaatgcgcattaaggatgacgagaccgagaatatcctgacggtgcttctgaaaaccgccctgctcattgtttctggcatctttccgtactccatccctgcgacactgcttgtgtggcacacctggcagaagcagacacaaagaagcggggtcctgtgggatgtgccctctcctcccgaaacccagaaagctgagctcgaagagggagtttatcggattaagcagcagggcatcttcgggaaaacacaagtgggagtcggcgtgcagaaggagggggtgtttcatacgatgtggcacgttacccgcggagccgtcctgacatacaacggcaagagactcgaaccgaattgggcctccgtgaaaaaggacctgattagctatggcgggggatggcggctttctgctcagtggcaaaaaggcgaggaagtgcaggtcatcgccgtggagcctgggaagaaccccaaaaatttccagaccatgcctggaaccttccagacaacgaccggcgaaattggggcgatcgctctggattttaagcccggaacatccggcagccccattatcaaccgcgagggcaaggttgtggggctgtacggaaatggcgtcgtgaccaaaaacgggggatatgtttccggcatcgcccaaacaaatgccgagcctgacgggccgacccccgaactcgaggaagagatgttcaagaaaagaaacctgacgattatggatcttcaccctggcagcggaaagacacggaaatacctgcccgctatcgtgcgcgaagccattaagagacggctcagaaccctgatcctcgctcctacccgcgtcgtggccgcggagatggaggaagccctgaagggccttcccattcggtatcagacaaccgctacaaaatctgagcataccgggagagaaatcgttgacctgatgtgccacgccacgtttacaatgcgcctgctcagccctgtgcgggtcccgaattacaacctgatcattatggatgaggctcatttcaccgaccccgcctccatcgccgctagaggatacatttctacacgcgtgggcatgggggaagcggccgctatctttatgaccgccacgcctcccggaaccgccgatgctttccctcagagcaatgcccccattcaggacgaggagcgggacatcccggaaagatcctggaactctggcaatgagtggatcacagattttgcggggaagaccgtgtggttcgtccctagcattaaagctggcaacgacatcgccaactgtcttcgcaagaatggaaaaaaggttattcaactgtcccggaagacatttgataccgaatatcagaaaacaaagctcaacgactgggatttcgtggtgaccacggacatctctgagatgggcgccaattttaaagctgatagagtcattgacccccggcgctgcctgaagcccgtgatcctgacagatgggcctgagagagttattctcgccggacccatgcctgtgaccgcggccagcgctgcccagcggcgcggcagagtcgggcggaacccgcagaaagaaaatgaccaatacatcttcaccggacagccccttaacaatgatgaggaccacgctcattggacagaagccaagatgctgctggacaacatcaatacccctgagggcattatccccgctctcttcgaacctgagagagagaagtccgccgcgattgatggggaatatcgcctgaaaggcgagagccggaagacatttgtggaacttatgagacgcggagacctgcccgtttggctcgcccacaaagtggcttctgagggcatcaagtacacggatcggaaatggtgcttcgacgggcagagaaacaatcagattctggaagagaacatggatgtcgagatctggaccaaggaaggagagaaaaagaagctgcgcccgcggtggctcgacgccagaacatattccgatcctcttgctctgaaagaatttaaggacttcgccgccggccgcaaaagcatcgctctggatctcgtgaccgagattgggagagtcccctctcacctggcgcatcggacacgcaatgcccttgacaacctggtgatgctccacacctccgaacatggaggcaaggcttacagacacgccgttgaggagctgcctgaaacgatggagaccctgctccttctgggcctgatgatcctcctgacagggggagccatgctttttctgattagcggcaaagggatcggaaagacctccattggcctcatctgtgtgatcgcttctagcgggatgctgtggatggccgaaattcccctgcaatggatcgcgtccgccattgtgctcgagttctttatgatggtccttctgatccctgagcccgaaaagcagcggacaccgcaggataatcaactggcttatgttgtgattggaatcctcaccctggccgctattatcgccgcgaacgagatgggccttctggaaacgacaaaacgcgacctcggcatgagcaaggagcctggggtggtctctcccacctcctacctggatgtggacctgcaccccgccagcgcttggacactctacgccgttgctaccaccgtgatcacacctatgcttagacatacgattgaaaattctaccgccaacgtcagcctggctgccatcgcgaaccaggccgtggtcctgatgggactcgacaaaggctggccgatttccaagatggatctgggggtgccccttctggctctcggatgctattctcaggttaatcctctgacactgaccgccgctgtgctccttctgatcacacactacgccattatcggccccgggctgcaggccaaagcgacccgggaggctcaaaagagaacggccgctggaatcatgaagaaccctacagtcgacggcattatgaccatcgatctcgaccccgtgatttatgatagcaaattcgagaagcagctgggccaggttatgcttctggtgctctgtgccgtccagctgctgctcatgcgcacctcctgggccctttgcgaagctctgacactggccaccgggcctatcacaacgctctgggagggatctccgggcaaattttggaataccacaattgcggtgagcatggccaacatcttccgggggtcctacctggctggagccggccttgcttttagcatcatgaagtctgtggggaccggaaaaagaggcacaggctcccaaggggaaaccctgggagagaagtggaagaaaaagctcaatcagctgagccgcaaagaattcgacctgtataagaaatccggcattacggaggttgatcggaccgaggccaaggaagggctcaaaagaggagagatcacacatcacgcggtctctcggggcagcgccaagcttcagtggtttgtggaacgcaacatggtgattcccgaggggagagtcatcgacctgggatgtggccggggcgggtggtcctactattgcgctggactgaagaaagttaccgaagtgcgcggctacacaaaggggggacctggccatgaggagcccgtgcctatgtctacctacgggtggaatattgtcaaactcatgagcggaaaggatgtgttctatctgcccccggaaaaatgtgacacacttctgtgcgatatcggcgagtccagcccttctcccaccgttgaagagtccagaacgattcgggtgctcaagatggtcgagccctggctgaagaacaatcagttctgtatcaaagtgctgaacccttacatgcccacagttatcgaacacctcgagcgccttcaaagaaagcacggcgggatgctggtgcggaatcctctgagccgcaactctacccatgaaatgtattggatttccaatggaaccggcaacatcgtcgccagcgtgaatatggtgtctagactcctgcttaaccggtttacaatgacgcacagacgcccgaccattgagaaagacgtcgatctgggggctggaacacggcatgttaacgccgaacccgagacccctaatatggacgtgatcggcgagagaattaagcgcatcaaagaagagcacaacagcacatggcactacgacgatgaaaatccctataagacctgggcttaccatgggtcctatgaggtgaaggccacaggatctgcgagctccatgatcaacggcgtcgtgaaactcctgaccaagccttgggacgttgtgcccatggtcacgcagatggccatgaccgatacaaccccgttcggccagcaacgggtgtttaaagaaaaggttgacacaagaacccctcgcagcatgcccgggacgcggagagtgatgggaattacagctgagtggctgtggcgcaccctcggccggaataaaaagcctagactgtgcacacgcgaggaattcaccaagaaagtccggacgaacgccgctatgggggccgtgtttaccgaggaaaatcagtgggattccgccaaggcggctgttgaggacgaagatttctggaaacttgtggacagagagcgcgagctgcacaagctcggaaaatgtggctcttgcgtctacaacatgatggggaagagagaaaaaaagctgggcgagtttggaaaggccaaaggcagccgggccatctggtacatgtggcttggggctcgctatctggaattcgaggccctcggatttctgaatgaggatcattggttctccagagaaaactcttacagcggcgtggagggggaaggactgcacaagctcggctatattctgcgggacatctccaaaattcccgggggcgctatgtacgccgatgacacagcgggatgggacaccagaatcacagaggatgaccttcataatgaagagaagatcacccagcagatggatcctgagcaccggcaactggccaacgctatttttaaactcacatatcagaataaggtcgtgaaggttcagcgccccaccccgacgggcacagtgatggacatcatttctagaaaagatcagcgggggagcggacaagtcggcacctacgggctgaacaccttcacaaatatggaagcccagcttatccgccagatggagggagaaggcgtgctgtccaaggctgacctcgagaaccctcacctgcccgaaaaaaagattacccagtggctggagacaaaaggggtggagagactcaagcggatggccatcagcggcgatgactgcgttgtgaagcccatcgatgaccgctttgcgaacgccctgcttgctctgaatgatatgggaaaagtcagaaaggacattcctcaatggcagccgtctaaaggctggcatgattggcagcaggtgcccttctgttcccaccatttccacgaactcatcatgaaggacgggcggaaactggttgtgccttgccgcccccaagacgagcttattggaagagcccggatcagccagggcgctgggtggtctctgcgcgaaacggcctgtctcggaaaggcttatgcccagatgtggtccctgatgtactttcacagacgggatctgcgcctcgcgagcaacgccatttgctctgctgtccctgtgcattgggtccccacctccagaacaacctggagcatccacgcccatcaccaatggatgacaaccgaggacatgctgacggtgtggaatcgggtttggattgaagataacccttggatggaggacaagacccccgtgacaacctgggagaatgtcccgtaccttggcaaaagagaagatcagtggtgtgggtccctgatcggcctcacaagccgcgccacctgggctcagaacatccctacggccattcagcaagtgcggtctctgatcggaaatgaggaattccttgactatatgcccagcatgaagagatttcgcaaagaggaggaatccgagggcgcgatttggtga

SEQ ID NO: 20737 - RNA, 9873 nt, synthetic construct
  misc_feature 1..9873: note = derived and/or modified CDS sequence (opt5) from DENV-3__FJ478456__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcgccgaagttgagcccgaagacattgattgctggtgtaacctcacatccacctgggtgacatatggaacctgcaatcaggccggcgagcacagacgggacaagcgctctgtggctctggcccctcatgtcgggatgggactggatacgagaacccaaacatggatgagcgctgagggcgcctggcggcaggtggaaaaagttgagacctgggcgctccgccaccccggcttcacaatcctggccctttttctggctcattacatcgggacctccctcacgcagaaggtggtcattttcatcctgcttatgctggtgacaccttctatgaccatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccaactggcgacacttcgcaaactgtgtatcgagggaaagattaccaacatcacaaccgattccagatgccctacgcagggcgaagccgtgctcccggaggaacaggaccagaattatgtgtgtaaacacacatacgtcgatcggggctgggggaacggatgcggcctgttcgggaagggaagccttgtgacctgcgctaagtttcaatgtctggagcccattgagggcaaagttgtgcagtatgaaaatctcaagtacaccgtcatcatcacagtgcataccggggaccagcaccaggttggaaacgagacacaaggcgtgacggccgaaattacccctcaggcttctacaaccgaggccatcctgcccgaatatggcacactggggctcgagtgctcccctcgcaccggactggacttcaatgagatgattcttctgacgatgaaaaacaaggcctggatggtccatagacagtggtttttcgatctccccctgccgtggaccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccagaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcacaaaaaaggaggaacccgtgaacattgaggccgaacctccgttcggcgagtccaatatcgtgattgggatcggcgataacgccctgaaaatcaattggtataagaagggatctagcattggcaaaatgtttgaagctaccgcccggggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacaccgggtgtgtcatcaattggaaaggaaaggagctgaagtgcggcagcgggattttcgtgacaaacgaggttcatacgtggaccgaacagtacaaatttcaagcggattcccccaagcggctggccacagctatcgccggcgcttgggagaatggagtgtgtggcattagaagcaccacacgcatggaaaaccttctctggaaacagatcgccaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgctgaaacacaaaactccagcttcattatcgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacatgcacctggcctaagtcccataccctgtggtctaatggcgtgctcgaaagcgatatgattatccccaaatccctggcggggcctattagccagcacaactatcgccccggataccatacacaaaccgctggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgccggatctggcaaggtggacaacttcaccatgggggtcctgtgcctcgccattctgtttgaagaggtgatgcggggaaagttcggcaaaaagcatatgatcgctggcgttttctttacattcgtgcttctgctcagcgggcagattacctggcgcgatatggcccacacactgatcatgattggatccaatgcgagcgacagaatgggcatgggggtcacctacctggctcttatcgccacgtttaaaatccagcccttcctggccctcggatttttcctgcggaagctcacatctagagaaaacctgcttctgggcgtggggctcgctatggccaccacactgcaactgcctgaggatattgaacagatggctaatggaatcgcccttggcctgatggcgctcaaactgattacccagtttgagacctatcagctctggacagccctgatctcccttacgtgtagcaacaccattttcacactgaccgtggcttggcgcacagccaccctcatcctggctggcgtctccatcctgccggtttgccaatctagctccatgcggaagtctgactggcttcccatgacggtggccgccatgggggtgcctcccctgcctctctttattttcagcctgaaggatacactcaaaagacgctcctggcccctgaatgagggagtcatggctgtgggccttgtttctatcctggcgagctccctgctcagaaacgacgtgcctatggccgggcccctggtcgctggaggccttctgattgcctgttacgtgatcaccgggaccagcgccgatctcacagttgaaaaggctgccgacgtgacctgggaggaagaggcggaacagacaggagtctctcataacctgatgattacggtggacgatgacggcaccatgcggatcaaagatgacgagacagagaatatcctcaccgtcctgcttaagacagctctgctgattgtgtccggcatctttccgtacagcattcctgccaccctcctggtttggcacacgtggcagaaacagacccgcagatctggggtgctttgggatgtcccctcccctcccgaaacacaaaaggccgagctggaagagggagtgtatcggatcaaacagcagggcattttcgggaagacccaggttggagtgggcgtccaaaaggagggggtgtttcatacaatgtggcacgtgacccgcggagctgttctcacatacaacggcaaaagactggaaccgaattgggccagcgtcaagaaagacctcatctcttatggcgggggatggcggctgtccgcgcagtggcagaagggcgaggaagtgcaagtgattgctgtcgagcctgggaaaaaccccaagaatttccagacgatgcctggaaccttccagacaaccaccggcgaaatcggggccatcgcccttgattttaagcccggaacaagcggctcccccattatcaaccgcgagggcaaagtggttgggctgtacggaaatggcgtggtcacgaagaacgggggatatgtgagcggcattgctcagaccaatgccgagcctgacgggccgacacccgaactggaggaagagatgttcaaaaagagaaacctcaccatcatggatctgcaccctggctctggaaaaacacggaagtaccttcccgctattgttcgcgaagccatcaagagacggctgagaaccctcatcctggcgcctacgcgcgtggtcgccgctgagatggaggaagccctcaaaggcctgcccattcggtatcaaacaaccgctaccaagagcgagcatacagggagagaaatcgtggaccttatgtgccacgccacctttacaatgcgcctgctgtcccctgttcgggtgccgaattacaacctcattatcatggatgaggcccatttcaccgaccccgcttctattgcggccagaggatacatcagcacgcgcgtcggcatgggggaagctgccgccatctttatgacagctacccctcccggaacagccgatgcgttccctcagtccaatgctcccattcaggacgaggagcgggacatcccggaaagatcttggaacagcggcaatgagtggattaccgattttgccgggaaaacggtgtggttcgtgccttccatcaaggccggcaacgacattgctaactgtctgcgcaaaaatggaaagaaggtcatccagctttctcggaaaacctttgatacagaatatcaaaagaccaaactgaacgactgggatttcgttgtgacaaccgacattagcgagatgggcgccaattttaaggcggatagagtgatcgacccccggcgctgcctcaaacccgtcatcctgacagatgggcctgagagagtgattctggccggacccatgcctgttaccgctgcctccgctgcccagcggcgcggcagagtggggcggaacccgcagaaggaaaatgaccagtacatcttcacgggacaacccctcaacaatgatgaggaccacgctcattggacagaagccaagatgcttctggacaacattaatacccctgagggcatcattcccgcgctgttcgaacctgagagagagaaaagcgccgctatcgatggggaatatcgcctcaagggcgagtctcggaaaacctttgtcgaactgatgagacgcggagaccttcccgtgtggctggcccacaaggttgcttccgagggcatcaaatacacagatcggaagtggtgcttcgacgggcagagaaacaatcagattctcgaagagaacatggatgtggagatctggaccaaagaaggagagaagaagaaactgcgcccgcggtggctggacgccagaacatatagcgatcctctcgcccttaaggaatttaaagacttcgctgcgggccgcaagtctattgccctggatctggtcacggagatcgggagagtgccctcccacctcgctcatcggacccgcaatgccctggacaaccttgtcatgctgcacacaagcgaacatggaggcaaagcctacagacacgctgtggaggagctccctgaaaccatggagacactgctgctccttggcctgatgattctgctcaccgggggagccatgctgtttcttatctccggcaaggggatcggaaagacgtctattggcctgatctgtgttattgcgagctccgggatgctctggatggccgaaatccccctgcagtggattgctagcgccatcgtgctggagttctttatgatggtgctccttattcctgagcccgaaaaacaacggaccccgcaggataatcagctggcttatgtcgttatcggaatcctgacactcgccgcgattatcgccgctaacgagatgggcctgcttgaaaccacaaagcgcgacctgggcatgtctaaagagcctggggtggtgtcccccaccagctacctcgatgtcgacctgcaccccgcctctgcttggacgctgtacgccgtggctacaaccgttattacacctatgctcagacataccatcgaaaatagcaccgccaacgtgtcccttgcggccattgctaaccaagccgtcgtgctgatgggactggacaagggctggccgatctctaaaatggatctcggggtccccctgcttgctctgggatgctatagccaggtgaatcctctcacactgacggccgccgttctgctccttatcacccactacgcgattatcggccccgggctgcaggctaaggccacacgggaggctcagaagagaaccgccgccggaattatgaaaaaccctacagtggacggcatcatgaccattgatctggaccccgtcatctatgattccaagttcgagaaacaactcggccaggtgatgctgcttgttctgtgtgctgtgcagctcctgctgatgcgcacgtcttgggccctctgcgaagcgcttacactggccaccgggcctatcaccacactgtgggagggaagcccgggcaagttttggaataccacaattgctgtctccatggccaacatcttccgggggagctacctcgctggagccggcctggcgttttctattatgaaatccgtggggacgggaaagagaggcaccggcagccagggggaaacacttggagagaagtggaaaaagaaactgaatcaactctcccgcaaggaattcgacctgtataaaaagtctggcatcaccgaggtggatcggacagaggccaaagaagggctgaagagaggagagattacccatcacgctgttagccggggctccgccaagctccagtggtttgtcgaacgcaacatggtgatccccgaggggagagtgattgaccttggatgtggccggggcgggtggtcttactattgcgctggactgaaaaaggtcacggaagttcgcggctacaccaaagggggacctggccatgaggagcccgtgcctatgagcacatacgggtggaatatcgtgaagctgatgtccggaaaagatgtcttctatctccccccggaaaagtgtgacaccctgctttgcgatatcggcgagagctctccttcccccacagtggaagagagcagaaccattcgggttctgaagatggtggagccctggctcaaaaacaatcagttctgtatcaaggtcctgaacccttacatgcccacagtgattgaacacctggagcgcctccagagaaaacacggcgggatgcttgttcggaatcctctgtctcgcaactccacccatgaaatgtattggatcagcaatggaacgggcaacattgtggcctctgtcaatatggtgagcagactgctcctgaaccggtttacaatgacccacagacgcccgaccatcgagaaggacgtggatcttggggctggaacacggcatgtcaacgccgaacccgagacgcctaatatggacgttatcggcgagagaattaaacgcatcaaggaagagcacaactccacctggcactacgacgatgaaaatccctataagacatgggcgtaccatgggtcttatgaggtgaaagccaccggaagcgcttccagcatgattaacggcgtggtcaagctgctcacaaaaccttgggacgtggttcccatggtgacccaaatggccatgacagataccacgccgttcggccagcagcgggtctttaaggaaaaagtggacaccagaacacctcgctccatgcccgggacccggagagttatgggaatcacagctgagtggctgtggcgcaccctgggccggaataagaagcctagactctgcacgcgcgaggaattcacaaaaaaggtgcggaccaacgccgccatgggggcggtctttacagaggaaaatcaatgggattctgctaaagccgccgtggaggacgaagatttctggaagctggttgacagagagcgcgagcttcacaaactgggaaagtgtggcagctgcgtgtacaacatgatggggaaaagagaaaagaagctcggcgagtttggaaaagctaagggctcccgggccatttggtacatgtggctgggggctcgctatcttgaattcgaggccctgggatttctcaatgaggatcattggttctctagagaaaacagctactccggcgtcgagggggaaggactgcacaaactgggctatatcctccgggacatctctaagattcccgggggcgcgatgtacgccgatgacaccgctggatgggacacgagaatcaccgaggatgacctgcataatgaagagaaaattacacagcagatggatcctgagcaccggcagcttgccaacgctatctttaagctgacctatcaaaataaggtggtcaaagtgcagcgccccacaccgaccggcacagttatggacattatcagcagaaaggatcagcgggggtccggacaggtgggcacctacgggctcaacacgttcacaaatatggaagcccaactgatccgccagatggagggagaaggcgtccttagcaaagcggacctggagaaccctcacctctctgaaaagaaaattacccagtggctggagaccaagggggtggagagactgaagcggatggccatctccggcgatgactgcgtggttaaacccattgatgaccgctttgctaacgccctcctggctcttaatgatatgggaaaggtgagaaaagacatcccccagtggcaacctagcaagggctggcatgattggcagcaggtcccgttctgttctcaccatttccacgaactgattatgaaagacgggcggaagctcgtggttccctgccgccctcaggacgagctgatcggaagagcccggatttcccaaggcgctgggtggagccttcgcgaaacagcctgtctgggaaaggcgtatgcccagatgtggtctctcatgtactttcacagacgggatctgcgcctggcttccaacgccatctgcagcgccgtgcccgtccattgggtgcctacctccagaacaacgtggagcatccacgctcatcaccagtggatgaccacagaggacatgctcaccgtctggaatcgggtgtggattgaagataacccctggatggaggacaaaacacctgttaccacgtgggagaatgtgccctacctgggcaagagagaagatcaatggtgtgggtctcttatcggcctgaccagccgcgccacatgggcgcagaacattccgaccgctatccagcaggtccggtccctcattggaaatgaggaattcctggactatatgccttctatgaaaagatttcgcaaggaggaggaaagcgagggcgccatctggtga

SEQ ID NO: 20738 - RNA, 9873 nt, synthetic construct
  misc_feature 1..9873: note = derived and/or modified CDS sequence (opt5) from DENV-3__FJ547085__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccagaatcgtcacagccgaaacccaaaactccagcttcattatcgatggacctaatacacccgagtgcccgaacacctctcgcgcttggaatgtgtgggaagtggaggactatggctttggcgtcttcacgacaaacatctggctcaagctgcgggaagtttacacccagctgtgtgaccacagacttatgtccgcggccgtgaaagatgagcgcgctgtgcacgccgacatggggtactggattgagagccagaagaatggatcctggaaactcgaaaaggcctctctgatcgaggtcaaaacctgcacatggcctaagagccataccctgtggtccaacggcgtgctcgaatctgatatgattatccccaagagcctggctgggcctatttcccagcacaattatcggcccggataccatacgcaaacagccggcccttggcaccttgggaaactggagctcgactttaactattgcgagggaaccacagttgtgatcaccgaaaattgtggcacaagaggccccagcctgcgcaccacgaccgtctctgggaagctgatccacgagtggtgctgtcggtcctgcacacttccgcctctcagatacatgggagaagatggctgttggtatgggatggagattcggcccatcagcgaaaaagaggagaacatggtgaagtctctggtttccgcgggaagcggcgaagtggacaatttcaccatgggggtcctgtgcctcgctattctgtttgaggaagtgatgcgcggaaaattcggcaagaagcatatgatcgccggcgttttctttacattcgtgcttctgctctctgggcagattacctggagagatatggcccacacgctgatcatgattggaagcaacgctacagaccggatgggcatgggggtcacctacctggcccttatcgcgacatttaaaatccagcccttcctggctctcggatttttcctgagaaagctcacctcccgcgagaatctgcttctgggcgtggggctcgccatggccaccacactgcaactgcctgaagatattgagcagatggctaacggaatcgcccttggcctgatggctctcaaactgattacgcagtttgagacctatcagctctggacagccctgatcagccttacctgttctaatacaattttcaccctgacggtggcgtggcggacagccaccctcatcctggctggcgtctccctgcttccggtttgccaaagctcctctatgagaaagaccgactggctgcccatgacagtggccgctatgggggtgcctcccctccctctgtttatcttcagcctcaaagataccctgaagcgcagatcctggccccttaacgaaggagtcatggccgtgggcctggtttctattctggccagctccctcctgcggaacgacgtgcctatggctgggccccttgtcgcgggaggcctgctcatcgcctgttacgtgattacagggacgtctgctgatctgaccgttgagaaggccgccgacgtgacatgggaagaggaagctgagcagaccggagtcagccataatctcatgatcacagtggacgatgacggcaccatgcgcattaaagatgacgagacggaaaacatcctgaccgtccttctgaagacagccctgctcatcgtgtccggcatttttccgtacagcatccctgcgaccctgcttgtttggcacacatggcagaaacagacccaaagatctggggtgctgtgggatgtcccctcccctcccgagacacagaaggctgaactcgaggagggagtgtatcggattaaacagcagggcatcttcgggaagacgcaagttggagtgggcgtccagaaagaaggggtgtttcataccatgtggcacgtgacacgcggagccgttctgacctacaatggcaagagactcgagccgaactgggccagcgtcaagaaagacctgatttcttatggcgggggatggcggctttccgctcagtggcaaaagggcgaagaggtgcaggtgatcgccgtcgaacctgggaaaaatcccaagaacttccagaccatgcctggaacattccagacgaccacaggcgagattggggcgatcgctctggattttaaacccggaaccagcggctctcccatcattaatcgcgagggcaaggtggttgggctgtacggaaacggcgtggtcacaaagaatgggggatatgtgtccggcatcgcccaaaccaacgccgaacctgacgggccgacgcccgagctcgaagaggaaatgttcaaaaagagaaatctgacaattatggatcttcaccctggcagcggaaaaacccggaagtacctgcccgctatcgttcgcgaggccattaaaagacggctcagaaccctgatcctcgctcctacacgcgtggtcgccgcggagatggaagaggccctgaagggccttcccatccggtatcagaccacagctaccaagtccgaacatacggggagagagattgtggacctgatgtgccacgccacatttaccatgcgcctgctcagccctgttcgggtgccgaactacaatctgatcattatggatgaagctcatttcacagaccccgcctctatcgccgctagaggatacattagcacccgcgtcggcatgggggaggcggccgctatctttatgacggccacccctcccggaacagccgatgctttccctcagtccaacgcccccatccaggacgaggaacgggacattccggagagatcttggaatagcggcaacgaatggatcaccgattttgcggggaaaacagtgtggttcgtgccttccattaaggctggcaacgacatcgccaattgtcttcgcaaaaacggaaagaaagtcattcaactgtctcggaagacctttgatacagagtatcagaagaccaaactcaatgactgggatttcgttgtgacgacagacatcagcgagatgggcgccaactttaaggctgatagagtgattgacccccggcgctgcctgaaacccgtcatcctgaccgatgggcctgaaagagtgatcctcgccggacccatgcctgttaccgcggcctccgctgcccagcggcgcggcagagtggggcggaatccgcagaaggagaacgaccaatacattttcacaggacagccccttaataacgatgaagaccacgctcattggaccgaggccaaaatgctgctggacaatatcaacacacctgaaggcattatccccgctctcttcgagcctgagagagaaaagtctgccgcgattgatggggagtatcgcctgaagggcgaaagccggaaaacgtttgtcgagcttatgagacgcggagacctgcccgtgtggctcgcccacaaggttgcttccgaaggcatcaaatacaccgatcggaagtggtgcttcgacgggcagagaaataaccagatcctggaggagaatatggatgtggaaatttggacaaaagagggagaaaagaaaaagctgcgcccgcggtggctcgacgccagaacctatagcgatcctcttgctctgaaggagtttaaagacttcgccgccggccgcaagtctatcgctctggatctcgtcacagaaattgggagagtgcccacccacctggcgcatcggacgcgcaacgcccttgacaatctggtcatgctccacacctccgagcatggaggcaaagcttacagacacgccgtggaggaactgcctgagacaatggaaaccctgctccttctgggcctgatgatcctcctgacagggggagccatgctttttctgattagcggcaaggggatcggaaaaacctctatcggcctcatttgtgttatcgcttccagcgggatgctgtggatggccgagattcccctgcaatggatcgcgtccgccattgtgctcgagttctttatgatggtgcttctgatccctgaacccgagaagcagcggacgccgcaggataaccaactggcttatgtcgttattggaatcctcacactggccgctatcattgccgcgaatgaaatgggccttctggagaccacaaagcgcgacctcggcatgtctaaagaacctggggtggtgagccccacctcctacctggatgtcgacctgcaccccgccagcgcttggaccctctacgccgtggctacaacggttatcacccctatgcttagacatacaattgagaactctaccgccaacgtgtccctggctgccatcgcgaatcaggccgtcgtgctgatgggactcgacaagggctggccgattagcaaaatggatctgggggtcccccttctggctctcggatgctattctcaggtgaaccctctgacactgaccgccgctgttctccttctgatcacgcactacgccatcattggccccgggctgcaggccaaggcgacacgggaggctcaaaaaagaaccgccgctggaatcatgaagaatcctaccgtggacggcattatgacaatcgatctcgaccccgtcatttatgatagcaagttcgaaaaacagctgggccaggtgatgcttctggttctctgtgccgtgcagctgctgctcatgcgcacctcctgggccctttgcgaggctctgacactggccacggggcctatcaccacactctgggaaggatctccgggcaagttttggaacaccacaatcgcggtcagcatggccaatattttccgggggtcctacctggctggagccggccttgctttttctatcatgaaaagcgtggggaccggaaagagaggcacgggctcccaaggggagaccctgggagaaaaatggaagaagaaactcaaccagctgagccgcaaggagttcgacctgtataaaaagtctggcattacagaggtggatcggaccgaagccaaagaggggctcaagagaggagaaatcacacatcacgcggtttcccggggcaccgccaaacttcagtggtttgtcgagcgcaatatggtgattcccgaagggagagtgatcgacctgggatgtggccggggcgggtggagctactattgcgctggactgaagaaggtcacagaggttcgcggctacaccaaagggggacctggccatgaggaacccgtgcctatgtccacgtacgggtggaacattgtgaagctcatgtctggaaaagatgtcttctatctgcccccggagaagtgtgacacacttctgtgcgatatcggcgaaagctccccttctcccaccgtggaggagagcagaaccatccgggttctcaaaatggtggaaccctggctgaagaataaccagttctgtattaaggtcctgaatccttacatgcccgccgtgatcgagcacctcgaacgccttcaaagaaaacacggcgggatgctggttcggaaccctctgtcccgcaatagcacacatgagatgtattggatttctaacggaacgggcaatatcgtggcttccgtcaacatggtgagcagactcctgcttaaccggtttaccatgacacacagacgcccgaccattgaaaaggacgtggatctgggggccggaacacggcatgtcaatgctgagcccgagacccctaacatggacgttatcggcgaaagaatcaaacgcattaaggaggaacacaattctacatggcactacgacgatgagaacccctataaaacctgggcctaccatgggtcctatgaagtgaaggcgacgggaagcgcctctagcatgatcaatggcgtggtcaagctcctgaccaaaccttgggacgtggttcccatggtgacacagatggctatgaccgatacaaccccgttcggccagcaacgggtctttaaggagaaagtggacacgagaacacctcgctccatgcccgggacccggagagttatggagattacagccgaatggctgtggcgcaccctcggacggaacaagaaacctagactgtgcacgcgcgaggaattcaccaagaaggtgcggacaaatgctgccatgggcgccgtctttaccgaggaaaaccagtgggattctgcgaaagctgccgtggaggacgaggatttctggaagcttgttgacagagaacgcgagctgcacaaactcgggaagtgtggaagctgcgtgtacaatatgatgggcaaaagagaaaagaaactgggggagtttggcaaggccaagggatcccgggctatctggtacatgtggcttggcgcccgctatctggagttcgaagctctcgggtttctgaacgaggatcattggttcagcagagaaaattcctactctggagtcgagggcgaagggctgcacaaactcggatatattctgcgggacatcagcaagatccccggcggggccatgtacgcggatgacacagccggctgggacaccagaattacagaggatgaccttcataacgaggaaaaaatcacccagcagatggatcctgagcaccggcaactggctaatgccatttttaagctcacgtatcagaacaaagtggtcaaggtgcagcgccccacaccgaccggaaccgttatggacatcatttccagaaaggatcagcggggctctgggcaagtgggaacatacggcctgaataccttcacaaacatggaagctcagcttatccgccagatggagggggaaggagtcctgagcaaagccgacctcgagaaccctcacctgcccgagaagaaaatcacgcagtggctggaaaccaagggcgtggagagactcaaacggatggcgatttccggggatgactgcgtggttaagcccatcgatgaccgctttgccaatgctctgcttgccctgaacgatatgggcaaggtgagaaaagacattcctcaatggcagccgtctaagggatggcatgattggcagcaggtccccttctgtagccaccatttccacgaactcatcatgaaagacggccggaagctggtggttccttgccgcccccaagacgagcttattgggagagctcggatctcccagggagccggctggagcctgcgcgaaacagcttgtctcgggaaagcctatgcgcagatgtggtctctgatgtactttcacagacgggatctgcgcctcgcctccaatgctatttgcagcgccgtgcctgtccattgggtgcccacctctagaacaacctggtccatccacgcccatcaccaatggatgacgaccgaggacatgctgacagtctggaaccgggtgtggatcgaggataatccttggatggaagacaagacccccgttacaacctgggagaacgtgccgtaccttggaaagagagaagatcagtggtgtggcagcctgattgggctcacgtctcgcgctacatgggcccagaatatccctaccgcgattcagcaagtccggtccctgatcggcaacgaggagttccttgactatatgcccagcatgaaaagatttcgcaaggaagaggaatccgagggagctatttggtga

SEQ ID NO: 20739 - RNA, 9873 nt, synthetic construct
  misc_feature 1..9873: note = derived and/or modified CDS sequence (opt5) from DENV-3__EU482595__SS-prME
  source 1..9873: mol_type = other RNA
accagcctgtgcctcatgatgatgctgcccgccgctcttgccttccacctgacatcccgggacggcgaacctcggatgatcgtggggaagaacgaacgcggaaaatctctcctgtttaagacggcgagcggcattaatatgtgtacccttatcgctatggatctgggggaaatgtgcgacgatacagtgacctacaaatgtccgcacattacagaagttgaacccgaagacatcgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccattctggcgctttttctggcccattacgtggggacgtccctcacacagaaggtcgtgatcttcatcctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccattgagggcaaagtggtccagtatgaaaatctcaagtacacagtgatcattaccgttcatacaggggaccagcaccaggtgggaaacgagacgcaaggcgtcaccgctgaaatcacacctcaggcctctaccacagaggctatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtcctgaagaaagaggtgtccgaaacccagcacgggacaatcctcattaaggttgagtacaagggagaagatgtgccctgtaaagtccctttcagcaccgaggacggccaagggaaggcccataacggaagactgatcacagcgaatcccgtggtgaccaaaaaggaggaacccgttaacatcgaggctgaacctccgttcggcgagtccaatattgtcatcgggattggcgataacgccctgaaaatcaattggtataagaagggatctagcattggcaaaatgtttgaagccacggctagaggggccagacgcatggctatccttggagacacagcctgggatttcggctccgtcgggggagtgctcaacagcctgggcaagatggtccaccagatctttgggtctgcgtacaccgccctgttctccggcgtgagctgggttatgaaaattggaatcggcgtgctcctgacctggattgggcttaattctaagaacacaagcatgtccttttcttgcatcgtcattggaatcattaccctgtatctcggcgctgtggttcaggccgacatggggtgtgtgatcaattggaaaggaaaggagctgaagtgcggcagcgggatcttcgtcacaaacgaggtgcatacgtggaccgaacagtacaaatttcaagctgattcccccaagcggctggccacagcgattgccggcgcttgggagaatggagtttgtggcatcagaagcaccacacgcatggaaaaccttctctggaaacagattgccaatgagctgaactatatcctgtgggaaaataacattaagctcaccgtggtcgtgggggacatcatcggagtgctggagcagggcaaacggattcttacgcctcagcccatggagctgaagtactcttggaaaacctgggggaaggctaagatcgtcacagccgaaacccaaaactccagcttcattatcgatggacctaatacacccgagtgcccgtctgcctccagagcttggaacgtttgggaagtggaggactatggctttggcgtgttcagcaccaatatttggctcaaactgcgcgaagtctacacacagctgtgtgaccaccggcttatgtccgcggccgtgaaggatgagagagctgttcacgccgacatggggtactggatcgagtctcagaaaaacggaagctggaagctcgaaaaagcctccctgatcgaggtgaagacctgcacgtggcctaagtctcatacactgtggagcaatggcgtcctcgaatccgatatgattatccccaaaagcctggctgggcctatttctcagcacaactatcgccccggataccatacccaaaccgccggcccttggcaccttgggaagctggagctcgactttaattattgcgagggaacaaccgtggttatcacggaaaactgtggcacacggggcccctccctgagaaccacaaccgtgagcgggaaactgattcacgagtggtgctgtcgctcttgcacacttccgcctctccggtacatgggagaagatggctgttggtatgggatggagatcagacccatctccgaaaaggaggagaatatggtcaaaagcctggtgtctgcgggaagcggcaaggttgacaacttcaccatgggggtgctgtgcctcgctattctgtttgaagaggtcatgcggggaaagttcggcaaaaagcatatgatcgccggcgtgttctttacgttcgtgcttctgctctccgggcagattacctggcgcgatatggcccacacactgatcatgattggaagcaatgcttctgacagaatgggcatgggggtcacctacctggcccttatcgcgacatttaaaattcagcccttcctggctctcggatttttcctgcggaagctcacctccagagaaaacctgcttctgggcgttgggctcgccatggccacgacactgcaactgcctgaggatatcgaacagatggctaatggaatcgcccttggcctgatggctctcaaactgattacccagtttgagacatatcagctctggaccgccctgatcagccttacctgttccaacacaattttcacgctgaccgtggcgtggcgcacagccaccctcatcctggctggcgtgtctctgcttccggtctgccaaagctcctctatgcggaagacagactggctgcccatgaccgtggccgctatgggggttcctcccctccctctgtttattttcagcctcaaggatacgctgaaaagacgctcctggccccttaatgagggagtgatggccgtcggcctggtgtctatcctggccagctccctcctgagaaacgacgttcctatggctgggccccttgtggcgggaggcctgctcatcgcctgttacgtcattacagggaccagcgctgatctgaccgtggaaaaggccgccgacgtcacatgggaggaagaggctgaacagaccggagtgtctcataacctcatgatcacagttgacgatgacggcacgatgcggattaaagatgacgagaccgagaatatcctgacagtgcttctgaagaccgccctgctcattgtctccggcatctttccgtacagcatccctgcgacactgcttgtgtggcacacctggcagaaacagacgcaacgctctggggttctgtgggatgtgccctcccctcccgaaacccagaaggctgagctcgaagagggagtctatagaattaaacagcagggcatcttcgggaagacacaagtgggagtgggcgttcagaaggagggggtctttcataccatgtggcacgtgacacggggagccgtgctgacctacaacggcaaacgcctcgaaccgaattgggccagcgtcaagaaagacctgatttcttatggcgggggatggagactttccgctcagtggcaaaagggcgaggaagtgcaggttatcgccgtggagcctgggaaaaaccccaagaatttccagacaatgcctggaacgttccagaccacaaccggcgaaattggggcgatcgctctggattttaagcccggaaccagcggctcccccattatcaaccgggagggcaaagtcgtggggctgtacggaaatggcgttgtgacaaagaacgggggatatgtcagcggcatcgcccaaacgaatgccgagcctgacgggccggctcccgaactcgaggaagagatgttcaaaaagcgcaacctgaccattatggatcttcaccctggctctggaaaaacaagaaagtacctgcccgccatcgtgcgggaagctattaagcgcagactccggaccctgatcctcgcccctacaagagttgtggcggccgagatggaggaagctctgaaaggccttcccattcgctatcagaccacggccacaaagagcgagcataccgggcgggaaatcgtcgacctgatgtgccacgctacctttacaatgagactgctctcccctgtgcgcgtgccgaattacaacctgatcattatggatgaggcccatttcaccgaccccgcctctatcgctgcgcggggatacattagcacaagagtcggcatgggggaagccgctgccatctttatgaccgccacgcctcccggaacagctgatgccttccctcagtccaatgcgcccattcaggacgaggagcgcgacatcccggaacggtcttggaacagcggcaatgagtggatcaccgattttgctgggaaaacagtttggttcgtgccttccattaaggccggcaacgacatcgccaactgtcttcgcaaaaatggaaagaaggtgattcaactgtctagaaaaacctttgatacggaatatcagaagaccaaactcaacgactgggatttcgtcgtgacaaccgacatcagcgagatgggcgctaattttaaggccgatcgggttattgaccccagacggtgcctgaaacccgtgatcctgacagatgggcctgagcgcgtcattctcgcgggacccatgcctgtgaccgccgcttccgccgctcagagacggggccgcgttgggagaaacccgcagaaggaaaatgaccaatacatcttcacaggacagccccttaacaatgatgaggaccacgcccattggaccgaagctaagatgctgctggacaacatcaatacgcctgagggcattatccccgccctcttcgaacctgagcgggagaaaagcgcggccattgatggggaatatagactgaagggcgagtctcgcaaaacatttgtggaacttatgcggagaggagacctgcccgtctggctcgctcacaaggtggcctccgagggcatcaaatacaccgatcgcaagtggtgcttcgacgggcagcggaacaatcagattctggaagagaacatggatgtcgagatctggaccaaagaaggagagaagaagaaactgagaccgcgctggctcgacgctcggacatatagcgatcctcttgccctgaaggaatttaaagacttcgccgctggcagaaagtctatcgcgctggatctcgtgaccgagattgggcgcgttccctcccacctggcccatagaacacggaatgctcttgacaacctggtgatgctccacacgagcgaacatggaggcaaagcctaccgccacgccgtggaggagctgcctgaaaccatggagacactgctccttctgggcctgatgatcctcctgaccgggggagctatgctttttctgatttccggcaaggggatcggaaagacatctattggcctcatctgtgtcatcgccagctccgggatgctgtggatggcggaaattcccctgcaatggatcgccagcgctattgttctcgagttctttatgatggtgcttctgatccctgagcccgaaaaacagagaaccccgcaggataatcaactggcctatgtggtcattggaatcctcacgctggctgccattatcgcggccaacgagatgggccttctggaaaccacaaagcgggacctcggcatgtctaaagagcctggggtggtttcccccaccagctacctggatgtggacctgcaccccgcttctgcctggacactctacgctgtcgccaccacggtgatcacacctatgcttcgccataccattgaaaatagcacagctaacgtctccctggccgcgatcgccaaccaggctgtggttctgatgggactcgacaagggctggccgatttctaaaatggatctgggggtgccccttctggccctcggatgctatagccaggtcaatcctctgaccctgaccgctgccgtgctccttctgatcacacactacgccattatcggccccgggctgcaggcgaaggctacgagagaggcccaaaagcggaccgctgccggaatcatgaaaaaccctacagttgacggcattatgaccatcgatctcgaccccgtgatttatgattccaagttcgagaaacagctgggccaggtcatgcttctggtgctctgtgccgtgcagctgctgctcatgagaacatcttgggctctttgcgaagccctgaccctggcgacggggcctatcacaaccctctgggagggaagcccgggcaagttttggaataccacaattgccgtttccatggctaacatcttccgcgggagctacctggccggagctggccttgccttttctatcatgaaatccgtcgggaccggaaagcggggcacaggcagccaaggggaaacgctgggagagaagtggaaaaagaaactcaatcagctgtccagaaaggagttcgacctgtataaaaagtctggcattaccgaggtggatcgcacagaggcgaaagaagggctcaagcggggagagatcacccatcacgccgtgagcagaggctccgctaaacttcagtggtttgtcgaacggaacatggttattcccgaggggcgcgtgatcgacctgggatgtggcagaggcgggtggtcttactattgcgccggactgaaaaaggtgacagaagtccggggctacaccaaagggggacctggccatgaggagcccgtgcctatgagcacgtacgggtggaatattgttaagctcatgtccggaaaagatgtgttctatctgcccccggaaaagtgtgacacccttctgtgcgatatcggcgagagctctccttcccccacagtcgaagagagccgcaccattagagtgctcaagatggttgagccctggctgaaaaacaatcagttctgtatcaaggtgctgaacccttacatgcccacagtcatcgaacacctcgagcggcttcaacgcaaacacggcgggatgctggtgagaaatcctctgtctcggaactccacccatgaaatgtattggattagcaatggaacaggcaacatcgtggcttctgtcaatatggttagccgcctcctgcttaacagatttaccatgacgcaccggagaccgacaattgagaaggacgtggatctgggggccggaacccgccatgtgaacgctgaacccgagacccctaatatggacgtcatcggcgagcggattaaaagaatcaaggaagaacacaactccacatggcactacgacgatgaaaatccctataagacgtgggcctaccatgggtcttatgaggtgaaagcgaccggaagcgcctccagcatgatcaacggcgttgtgaagctcctgacaaaaccttgggacgtcgtgcccatggttacccagatggctatgacagataccacaccgttcggccagcaacgcgtgtttaaggaaaaagtcgacacccggacgcctagatccatgcccgggacccgccgggtgatgggaattacagccgagtggctgtggagaaccctcggccgcaataagaagcctcggctgtgcacaagagaggagttcaccaaaaaggttcgcacgaacgctgccatgggggccgtgtttacagaggaaaatcagtgggattctgcgaaagctgccgtcgaggacgaagatttctggatccttgtggaccgggagagagagctgcacaagctcggaaaatgtggcagctgcgtctacaacatgatggggaagcgcgagaagaagctgggcgagtttggaaaggccaaaggctccagagctatttggtacatgtggcttggggcccggtatctggagttcgaggctctcggatttctgaatgaggatcattggttctctcgcgaaaacagctactccggcgtggagggggaaggactgcacaagctcggctatatcctgagagacatttctaaaatccccgggggcgccatgtacgcggatgacaccgccggatgggacacacggatcaccgaggatgaccttcataatgaagagaagattacgcagcagatggatcctgagcacagacaactggctaacgccatctttaaactcacctatcagaataaggttgtgaaggtccagcggcccacaccgaccggcacagtgatggacattatcagccgcaaagatcagagagggtccggacaagtgggcacctacgggctgaacacattcaccaatatggaagctcagcttattcggcagatggagggagaaggcgttctgagcaaggccgacctcgagaaccctcatctgcccgagaaaaagatcacgcagtggctggagacaaaaggggtggagcgcctcaagagaatggcgatctctggcgatgactgcgtcgtgaagcccattgatgaccggtttgccaacgctctgcttgccctgaatgatatgggaaaagttcgcaaggacatccctcaatggcagccgtccaaaggctggcatgattggcaacaggtgcccttctgtagccaccatttccacgaactcattatgaaggacgggagaaaactggtcgtgccttgccggccccaagacgagcttatcggacgcgctagaatttctcagggcgccgggtggtccctgcgggaaaccgcttgtctcggaaaggcctatgcgcagatgtggagcctgatgtactttcaccgcagagatctgcggctcgcctctaacgctatctgctccgccgtccctgtgcattgggttcccaccagccgcacaacctggtccattcacgcccatcaccaatggatgacaacggaggacatgctgaccgtgtggaatagagtctggatcgaagataacccttggatggaggacaagacacccgtgaccacatgggagaatgttccgtaccttggcaaacgggaagatcagtggtgtgggagcctgatcggcctcacctctagagctacgtgggcccagaacattcctaccgcgatccagcaagtgcgcagcctgattggaaatgaggagttccttgactatatgccctccatgaagcggtttagaaaagaggaggaatctgagggcgctatctggtga

SEQ ID NO: 20740 - RNA, 9873 nt, synthetic construct
  misc_feature 1..9873: note = derived and/or modified CDS sequence (opt5) from DENV-3__EU482596__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgaacccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcaaggtggacaacttcaccatgggggtcctgtgcctcgccattctgtttgaagaggtgatgcggggaaagttcggcaaaaagcatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaaaatccagcccttcctggccctcggatttttcctgcggaagctcacatctagagaaaacctgcttctgggcgtggggctcgccatggctaccacactgcaactgcctgaggatattgaacagatggccaatggaatcgctcttggcctgatggccctcaaactgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaagacggactggctgcccatgacagtggctgccatgggggtgcctcccctccctctgtttatcttctctctcaaggataccctgaaaagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaggccgctgacgtgacatgggaggaagaggccgaacagacgggagtcagccataacctcatgatcaccgtggacgatgacggcacaatgcggattaaagatgacgagaccgagaatatcctgacagtccttctgaagaccgcgctgctcatcgtgtctggcatttttccgtactccatccctgctacgctgcttgtttggcacacctggcagaaacagacacaacgcagcggggtgctgtgggatgtcccctctcctcccgaaacccagaaggccgagctcgaagagggagtgtatagaattaaacagcagggcatcttcgggaagacacaagttggagtgggcgtccagaaggagggggtgtttcataccatgtggcacgtgacacggggagccgttctgacgtacaacggcaaacgcctcgaaccgaattgggcttccgtcaagaaagacctgattagctatggcgggggatggagactttctgcccagtggcaaaagggcgaggaagtccaggtgatcgcggtcgagcctgggaaaaaccccaagaatttccagaccatgcctggaacattccagaccaccacaggcgaaattggggctatcgccctggattttaagcccggaacgtccggcagccccatcattaaccgggagggcaaagtggttgggctgtacggaaatggcgtggtcaccaagaacgggggatatgtgtccggcatcgcccaaacaaatgctgagcctgacgggccgacccccgaactcgaggaagagatgttcaaaaagcgcaacctgacaattatggatcttcaccctggcagcggaaaaaccagaaagtacctgcccgccatcgttcgggaagctattaagcgcagactccggacgctgatcctcgcccctacaagagtggtcgcggccgagatggaggaagctctgaaaggccttcccatccgctatcagaccaccgccacaaagtctgagcataccgggcgggaaattgtggacctgatgtgccacgctacatttaccatgagactgctcagccctgttcgcgtgccgaattacaacctgatcattatggatgaggcccatttcacggaccccgcctccatcgctgcgcggggatacatttctacaagagtcggcatgggggaagccgctgccatctttatgaccgccacacctcccggaaccgctgatgccttccctcagagcaatgcgcccatccaggacgaggagcgcgacattccggaacggtcctggaactctggcaatgagtggatcacggattttgctgggaaaaccgtgtggttcgtgcctagcattaaggccggcaacgacatcgccaactgtcttcgcaaaaatggaaagaaggtcattcaactgtccagaaaaacatttgataccgaatatcagaagacaaaactcaacgactgggatttcgttgtgaccacagacatctctgagatgggcgctaattttaaggccgatcgggtgattgaccccagacggtgcctgaaacccgtcatcctgaccgatgggcctgagcgcgtgatcctcgcgggacccatgcctgttacggccgctagcgccgctcagagacggggccgcgtggggagaaacccgcagaaggaaaatgaccaatacattttcacaggacagccccttaacaatgatgaggaccacgcccattggaccgaagctaagatgctgctggacaacatcaatacccctgagggcattatccccgccctcttcgaacctgagcgggagaaatccgcggccattgatggggaatatagactgaagggcgagagccgcaaaacatttgtcgaacttatgcggagaggagacctgcccgtgtggctcgctcacaaggttgcctctgagggcatcaaatacaccgatcgcaagtggtgcttcgacgggcagcggaacaatcagatcctggaagagaacatggatgtggagatttggacaaaagaaggagagaagaagaaactgagaccgcgctggctcgacgctcggacgtattccgatcctcttgccctgaaggaatttaaagacttcgccgctggcagaaagagcatcgcgctggatctcgtcaccgagattgggcgcgtgccctctcacctggcccatagaacacggaatgctcttgacaacctggtcatgctccacacctccgaacatggaggcaaagcctaccgccacgccgtggaggagctgcctgaaacaatggagaccctgctccttctgggcctgatgatcctcctgacagggggagctatgctttttctgattagcggcaaggggatcggaaagacctccatcggcctcatttgtgttatcgcctctagcgggatgctgtggatggcggaaattcccctgcaatggatcgcctccgctattgtgctcgagttctttatgatggtgcttctgatccctgagcccgaaaaacagagaacaccgcaggataatcaactggcctatgtcgttattggaatcctcaccctggctgccatcattgcggccaacgagatgggccttctggaaacaaccaagcgggacctcggcatgagcaaagagcctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaagggctggccgatttccaaaatggatctgggggtcccccttctggccctcggatgctattctcaggtgaatcctctgacgctgaccgctgccgttctccttctgatcacacactacgccatcattggccccgggctgcaggcgaaggctaccagagaggcccaaaagcggacagctgccggaatcatgaaaaaccctaccgtggacggcattatgacgatcgatctcgaccccgtcatttatgatagcaagttcgagaaacagctgggccaggtgatgcttctggttctctgtgccgtgcagctgctgctcatgagaacatcctgggctctttgcgaagccctgaccctggcgaccgggcctatcacaaccctctgggagggatctccgggcaagttttggaatacaacgatcgccgtcagcatggctaacattttccgcgggtcctacctggccggagctggccttgcctttagcatcatgaaatctgtggggaccggaaagcggggcacaggctcccaaggggaaaccctgggagagaagtggaaaaagaaactcaatcagctgagcagaaaggagttcgacctgtataaaaagtccggcattacagaggtggatcgcaccgaggcgaaagaagggctcaagcggggagagatcacgcatcacgccgtttctagaggcagcgctaaacttcagtggtttgtcgaacggaacatggtgattcccgaggggcgcgtgatcgacctgggatgtggcagaggcgggtggtcctactattgcgccggactgaaaaaggtcaccgaagttcggggctacacaaaagggggacctggccatgaggagcccgtgcctatgtctacctacgggtggaatattgtgaagctcatgagcggaaaagatgtcttctatctgcccccggaaaagtgtgacacacttctgtgcgatatcggcgagtccagcccttctcccaccgtggaagagtcccgcacaatcagagttctcaagatggtggagccctggctgaaaaacaatcagttctgtattaaggtcctgaacccttacatgcccaccgtgatcgaacacctcgagcggcttcaacgcaaacacggcgggatgctggttagaaatcctctgagccggaactctacgcatgaaatgtattggatttccaatggaacaggcaacatcgtggctagcgtcaatatggtgtctcgcctcctgcttaacagatttaccatgacccaccggagaccgacaattgagaaggacgtggatctgggggccggaacgcgccatgtcaacgctgaacccgagacccctaatatggacgttatcggcgagcggatcaaaagaattaaggaagaacacaacagcacatggcactacgacgatgaaaatccctataagacctgggcctaccatgggtcctatgaggtgaaagcgacaggatctgccagctccatgatcaacggcgtggtcaagctcctgaccaaaccttgggacgtggttcccatggtgacacagatggctatgaccgatacgaccccgttcggccagcaacgcgtctttaaggaaaaagtggacacacggacccctagaagcatgcccgggacacgccgggttatgggaattaccgccgagtggctgtggagaacgctcggccgcaataagaagcctcggctgtgcacaagagaggagttcaccaaaaaggtgcgcacaaacgctgccatgggggccgtctttaccgaggaaaatcagtgggattccgcgaaagctgccgtggaggacgaagatttctggaaacttgttgaccgggagagagagctgcacaaactcggaaagtgtggctcttgcgtgtacaacatgatggggaaacgcgaaaagaagctgggcgagtttggaaaagccaagggcagcagagctatctggtacatgtggcttggggcccggtatctggagttcgaggctctcggatttctgaatgaggatcattggttctcccgcgaaaactcttacagcggcgtcgagggggaaggactgcacaaactcggctatattctgagagacatctccaagatccccgggggcgccatgtacgcggatgacacggccggatgggacacccggattacagaggatgaccttcataatgaagagaaaatcacccagcagatggatcctgagcacagacaactggctaacgccatttttaagctcacatatcagaataaggtggtcaaagtgcagcggcccaccccgacaggcaccgttatggacatcatttctcgcaaggatcagagagggagcggacaagtgggcacgtacgggctgaacacattcaccaatatggaagctcagcttatccggcagatggagggagaaggcgtcctgtccaaagccgacctcgagaaccctcatctgcccgaaaagaaaatcacccagtggctggagacaaagggggtggagcgcctcaagagaatggcgattagcggcgatgactgcgtggttaaacccatcgatgaccggtttgccaacgctctgcttgccctgaatgatatgggaaaggtgcgcaaagacattcctcaatggcagccgtctaagggctggcatgattggcagcaggtccccttctgttcccaccatttccacgaactcatcatgaaagacgggagaaagctggtggttccttgccggccccaagacgagcttattggacgcgctagaatcagccagggcgccgggtggtctctgcgggaaaccgcttgtctcggaaaggcctatgcgcagatgtggtccctgatgtactttcaccgcagagatctgcggctcgccagcaacgctatttgctctgccgtgcctgtccattgggtgcccacatcccgcacgacctggagcatccacgcccatcaccaatggatgacaaccgaggacatgctgacagtctggaatagagtgtggatcgaagataacccttggatggaggacaaaacccccgttacgacctgggagaatgtgccgtaccttggcaagcgggaagatcagtggtgtgggtccctgattggcctcacaagcagagctacctgggcccagaacatccctacagcgattcagcaagtccgctctctgatcggaaatgaggagttccttgactatatgcccagcatgaaacggtttagaaaggaggaggaatccgagggcgctatttggtga

SEQ ID NO: 20741 - RNA, 9873 nt, synthetic construct
  misc_feature 1..9873: note = derived and/or modified CDS sequence (opt5) from DENV-3__JQ922554__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgcatattaccgaactcgagcccgaagacatcgattgctggtgtaacctgacatccacctgggttacgtatggaacctgcaatcaggctggcgagcacagacgggacaagcgctctgtggccctggcccctcatgtggggatgggactcgatacaagaacccaaacatggatgagcgctgagggcgcctggcggcaggtcgaaaaagtggagacctgggctctgcgccaccccggcttcacgattcttgccctgtttctcgcgcattacatcgggacatccctgacccagaaggttgtgatcttcattcttctgatgctcgtcacaccttctatgaccatgagatgtgtgggagttggcaaccgggactttgtggaagggctgagcggagccacctgggtcgatgtggtgctggagcacggcgggtgcgtcacaacgatggctaagaataaacccaccctcgacatcgagctgcagaagacagaagccacccaacttgctacactgcgcaaactctgtattgagggaaagatcaccaacattacgacagattccagatgccctacccagggcgaagccatcctgccggaggaacaggaccagaattatgtttgtaaacacacctacgtggatcggggctgggggaacggatgcggccttttcgggaagggaagcctggtgacatgcgcgaagtttcaatgtctcgagtctattgagggcaaagtcgtgcagcatgaaaatctgaagtataccgttatcatcacagtgcacacgggggaccagcatcaggtcggaaacgagacccaaggcgtgacagccgaaattacctcccaggctagcacagccgaggctatcctgcccgaatacggcaccctcgggctggagtgctctcctcgcacgggacttgacttcaatgagatgattctgctcaccatgaaaaacaaggcctggatggttcacagacagtggtttttcgatctgccccttccttggacatccggcgccaccacaaaaacccccacgtggaatcggaaggaactgctcgtgacatttaaaaacgctcacgcgaagaagcaagaggtcgtggtcctggggagccaggaaggagccatgcataccgctctgacaggcgccaccgagatccagacctctgggggcacatccattttcgccggacacctcaaatgtcgcctgaagatggacaaacttgaactgaagggcatgagctatgctatgtgcctcaatacgtttgtgctgaaaaaggaggtttccgagacccagcatgggacaatcctgatcaaggtggaatacaaaggagaggatgccccgtgtaagattcctttctctaccgaagacggccaagggaaagcgcacaacggaagacttatcacagctaaccccgtcgtgaccaagaaagaggagcctgttaatattgaagccgagccccccttcggcgaaagcaacatcgtgattgggatcggcgataaggccctcaagatcaattggtaccggaaaggatccagcattggcaagatgtttgaggctacggccagaggggctcgccggatggccatcctgggagacacagcgtgggatttcggctctgtcgggggagtgctgaactccctcggcaaaatggtgcatcagatttttgggagcgcctataccgctctgttctctggcgttagctggatcatgaagattggaatcggcgtccttctgacctggattgggctcaattccaaaaacacatctatggcctttagctgcatcgctatcggaattatcaccctgtacgtgggcgtggtcgtgcaggccgacatggggtgtgttattaattggaagggaaaggaactgaaatgcggctccgggatcttcgtgacaaacgaggtccacacgtggaccgagcagtataagtttcaagcggatagccctaaaagacttgccacagctattgccggcgcttgggaaaatggagtgtgtggcatccgctctaccacacggatggagaacctcctgtggaagcagatcgccaatgaactgaactacattctctgggagaataacatcaaactgaccgttgtggtcggggacattacgggagtgcttgaacagggcgagagaaccctgacaccgcagcccatggagctcaagtattcctggaaaacctgggggaaggccaagatcgttacagctgaaacccaaaatagctctttcattatcgatggaccttccacacccgagtgccctagcgcgtcccgcgcctggaacgtgtgggaagtcgaggactacggctttggcgtgttcaccacgaacatctggctgaaactgcgggaagtgtatacacagctttgtgaccacagactcatgtctgctgccgtcaaggatgagcgcgccgttcatgctgacatggggtactggattgagagccagaaaaatggatcctggaagctggaaaaagcctctctgatcgaggtgaagacctgcacctggcccaagagccacacactctggtccaacggcgtgctggaaagcgatatgattatcccgaaatctcttgcggggcctatttcccagcataatcaccggcccggataccacacccaaacggctggcccttggcatctggggaagctcgagctggactttaactattgcgagggaacaaccgtcgtgatcagcgaaaattgtggcacaagaggcccctctctgcgcaccacaaccgtttccgggaaacttatccacgagtggtgctgtcggagctgcacgctccctcccctgagatacatgggagaagatggctgttggtatgggatggagattcggccgatcaacgaaaaggaggagaatatggtgaaatctctggccagcgccggatccggcaaggtcgacaacttcaccatgggggtgctctgcctggctattctttttgaagaggttatgcgcggaaagttcagaaaaaagcatatgatcgccggcgtgctgttcacatttgtcctcctgctgagcggccagattacctggcgggatatggcgcacacacttatcatgattgggtctaatgcttccgacagaatgggaatgggcgtgacctacctggccctcatcgccacgttcaaaatccagccttttctggctctcgggttctttctgcgcaagcttacaagccgggaaaacctgctcctgggagttggcctggccatggctgccacccttagactgcccgaggatattgaacaaatggcgaatgggatcgccctcggactgatggctctcaaactgattacacagttcgagacctatcagctttggaccgccctggtgtccctcacatgttctaacacgatctttaccctgacagtcgcttggcgcaccgccacactgattcttgccggcatcagcctgctccccgtgtgccagtcctctagcatgagaaagaccgactggctgcctatgacggtggctgcgatgggcgtcccgcccctccctctgttcatcttttcccttaaggatacactgaaacggcgctcttggcccctgaatgagggggttatggccgtgggactcgtgagcattctggcttccagccttctgagaaacgacgtccctatggccggccccctcgtggccgggggactgctcatcgcttgttacgttattaccggcacctctgccgatctgacagtggaaaaggcggctgacgtcacctgggaggaagaggccgaacaaacaggggtgtcccataatcttatgatcacggttgacgatgacggaaccatgcggattaaagatgacgagacagagaacatcctgaccgtgctgctcaagacagccctgcttatcgtcagcggcattttcccttattctatccccgctaccctgctcgtgtggcacacgtggcagaaacagacccagcgctccggcgtcctgtgggatgtgccgagccctcccgaaacacaaaaggccgagctcgaagagggggtttacagaattaaacagcagggaatctttggcaagacccaggtgggggtcggagtgcaaaaggagggcgttttccacacaatgtggcatgtgacccggggggcggtcctgacacacaacggaaaacgccttgaacctaattgggcttctgtgaagaaagacctgatttcctacggcggcgggtggagactgagcgcccagtgggccaagggaggcgagacgcaggtgatcgctgttgaacccgggaaaaacccgaagaattttcaaaccatgcctggaattttccagacaaccaccggcgagatcggggccatcgctctcgatttcaagcccggaacatccggcagccctattatcaaccgggaaggcaaagtcgtggggctgtatggaaatggcgtggtcacgaagaacgggggatacgtgtctggcattgcccagaccaatgcggagcttgacgggcccacacccgagctggaagaggaaatgtttaaaaagcgcaacctcaccatcatggatctgcatcctggcagcggaaaaacaagaaagtatctcccggccattgttcgggaggctatcaagagacgcctgcggacccttatcctggcccccacgagagtggtcgctgccgaaatggaggaggccctgaaaggcctccctattcgctaccagacaaccgctaccaagtccgaacacacagggcgggagatcgtggacctgatgtgccatgcgaccttcacaatgagacttctgtctcccgttcgcggaagcaattataacctcattatcatggatgaagcccactttaccgaccctgcttccattgccgccatcggctacatctctacgcgggtggggatgggagaggctgccgcgattttcatgacagctaccccccctggcacagtcgatgcctttccgcaaagcatcccccctattcaggacgaagagagagacatccccgagcgctcctggaattctgggaacgaatggattaccgatttcgtgggcaaaacggtttggtttgtgcctagcatcaaggccggaaatgacattgctaactgtctgcggaaaaatggcaagaaggtcatccagctgtccagaaaaaccttcgatacagagtatcagaagaccaaactcaacgactgggattttgtggtgacaaccgacatcagcgaaatgggggccaacttcaaggcggatcgggtcatttaccttcgcagatgcctgaaacccgttatcctgacaaatggaccggagcgggtgattctcgccggccctatgcccgtgaccgtcgcttctgccgctcaacgcagagggcgggtgggaagaaacccccagaaggagaatgaccagtacatctttatgggccagcctctgaacaatgatgaagaccacgcccattggacggaggctaagatgcttctggataacattaatacacccgaagggatcatccctgccctcttcgagccggaacgcgagaaatccgcggccattgacggcgagtatcggctgaagggagaaagcagaaaaaccttcgttgagctgatgcgccggggcgacctccccgtgtggcttgctcacaaggtcgcctctgaagggatcaaatacaccgatagaaagtggtgctttgacggagagcgcaacaatcaaattctggaagagaacatggatgtggagatctggacaaaagaaggcgagaagaagaattggcggcctagatggctggacgctcgcacctattccgatcccctcgccctgaaagaattcaaggactttgccgctgggagaaaaagcattgcgcttgatctggttacagagatcggacgggtgccttcccatctcgcccacacggtccgcaacgctctggacaatctggtgatgctccacacctctgaacatggcggcagagcctaccggcacgccgtcgaggagcttcccgaaacaatggagaccctgctgctcctggggcttatgatcctgctcacaggaggcgctatgctgttcctgattagcgggaagggaatcggcaaaacctccattgggctcatctgtgtgattgccagctctggaatgctttggatggcggatgttccgctgcagtggatcgcctccgctattgtgctggaatttttcatgatggtgctcctgatccctgagcccgagaagcagcgcacgcctcaggacaaccaacttgcctatgtcgttatcggcattctgaccctcgctgccatcgtggcggccaatgaaatgggcctgctggagacaaccaagagagatctcgggatgagcaaagaacccggagtggtctctcctacaagctaccttgacgtggatctgcatcccgcttccgcctggaccctgtatgctgttgccacgccggtgattacacctatgctccggcacaccatcgagaactctacagctaatgtcagcctggccgcgattgccaaccaggctgtggtccttatgggcctggacaaggggtggcccatctccaaaatggacctcggagtgcccctgctggccctcggctgctactctcaggttaaccctcttaccctggctgccgccgtgctgctcctggtcacccattacgcgatcattgggccgggacttcaagctaaggccacaagagaagctcagaaacgcacggccgccggcatcatgaagaatcccaccgtggatggcattatgacaatcgacctggatcctgttatttatgacagcaagtttgagaaacagctcgggcaggtgatgctgctggtcctctgtgctgtgcaacttctgctgatgcggacctcctggcccctctgcgaggtgctggcccttgcgacaggacctatcaccacgctgtgggaaggcagccccgggaagttctggaacacaaccatcgccgtttctatggctaatatttttagaggatcctacctcgccggcgctgggctggccttcagcatcatgaaatccgtcggaaccggcaagcgcggcacagggtctcagggagagaccctgggcgaaaaatggaagaagaaactcaaccagcttagccggaaggagtttgatctgtataaaaagtccgggattacagaagtggacagaacggaggcgaaagagggactgaagcggggcgaaatcacccaccacgccgtgtctcgcgggagcgctaaactccagtggttcgtcgagagaaatatggtttttcctgaaggacgggtgattgatctgggctgtggccgcgggggatggtcctactattgcgccggccttaagaaggtgacagaggtcagagggtacaccaaaggaggcccggggcatgaagagcccgtgcctatgagcacatatggatggaacatcgttaagctgatgtctggcaaagacgtgttctacctcccccctgagaagtgtgataccctgctgtgcgacattggcgaatccagcccctctccgacggtcgaggaatcccggaccatccgcgtgctcaaaatggttgagccttgggtgaagaataaccaattctgtatcaaggtccttaatccctacatgcccagcgtgattgagcacctggaaaacctgcagagaaaacatgggggaatcctcgtgcggaatcctctgtctcgcaacagcacacacgagatgtattggatttccaatggcaccgggaacatcgtctctagcgttaatatggtgtccagacttctgctcaaccggtttacaatgacccacagacgccccacaattgaaaaggatgtggacctgggagctggcacccggcatgtcaacgccgagcctgaaacgccgaatatggatgtgatcggggagagaatcaaacgcattaaggaggaacacagctccacatggcattacgacgacgagaacccctataaaacctgggcttaccacggatcttatgaagttaaggccaccggcagcgcgtcctctatgatcaatggcgtggtcaagctgctcacaaaaccttgggatgtggttcccatggtgacgcagatggccatgaccgacacaacccctttcgggcagcaacgggtctttaaggagaaagtggatacaagaaccccccgcccgatgcctggaacacggaaggttatggaaattaccgctgagtggctgtggagaacgcttggccgcaacaaacggcccagactgtgcacccgcgaggaattcacaaagaaggtgcggaccaatgccgctatgggggccgtctttacagaggaaaaccagtgggacagcgccagagcggctgtggaggatgaagagttctggaaactcgtcgaccgcgagagagaactgcataagcttggaaaatgtggctcctgcgtgtacaatatgatggggaagcgggagaaaaagctgggcgaatttggaaaagccaaggattctcgcgccatctggtatatgtggctcggcgctagatacctggagttcgaggccctggggtttctcaacgaagaccactggttcagccgggagaattcctacagcggagttgaaggcgaggggctgcacaagcttggatatattctgagagatatctctaaaatccctggcggggctatgtacgccgacgataccgcgggctgggacacgcggattacagaagacgatctccataacgaggagaagatcacccagcaaatggcccgcgaacacagacagctggctaatgccatttttaaacttacatatcagaacaaggtggtcaaagtgcagcggcccacccctaagggaacggtgatggacatcatttcccgcaaggatcaaagaggcagcgggcaggttggaacctacggcctgaatacattcaccaacatggaggctcagctcatccggcagatggaaggggagggagtgctgtctaaagccgacctggaaaatccccatccgctcgagaagaaaatcacacaatggctggagaccaagggcgtcgaacgccttaaaagaatggcgatttccggggatgactgcgtggttaagcctatcgatgaccggtttgccaacgctctgctcgccctgaacgatatgggcaaggtgcgcaaagacattccccagtggcagcccagcaagggatggcacgattggcagcaagtccctttctgttctcaccatttccacgagcttatcatgaaagacggcagaaagctggtggtcccgtgccggccccaggatgaactcctggggaaagctcgcatttcccagggagccggctggagcctgagagagacagcttgtctcgggaaggcctatgcgcagatgtggaccctgatgtactttcatcggcgcgaccttagactggcctccaatgctatctgcagcgccgtgcctgttcactgggtgcccacgtctcggacaacctggagcattcatgcccaccaccaatggatgaccacagaagacatgctcaccgtctggaacagagtgtggatcgaggataatccttggatggaggacaagacacccgttacgacctgggaagatgtgccttatctgggaaaacgcgaggaccagtggtgtggctcccttatcgggctgacatctcgggctacctgggcccagaacattctcacagcgatccaacaggtcagaagcctgattggcaatgaagagttcctggattacatgccctccatgaagcgctttcggaaagaggaagagtctgaaggagctatctggtga
